(12) United States Patent
Garcia-Garcia et al.

(10) Patent No.: US 10,519,430 B2
(45) Date of Patent: Dec. 31, 2019

(54) BIFIDOBACTERIUM LONGUM

(71) Applicant: Alimentary Health Ltd., Cork (IE)

(72) Inventors: Jose Carlos Garcia-Garcia, Cincinnati, OH (US); Michael John Janusz, West Chester, OH (US); Barry Kiely, Cork (IE); Eileen Frances Murphy, Cork (IE); Liam O'Mahony, Cork (IE)

(73) Assignee: Alimentary Health Ltd., Cork (IE)

( * ) Notice: Subject to any disclaimer, the term of this patent is extended or adjusted under 35 U.S.C. 154(b) by 0 days.

(21) Appl. No.: 16/266,372

(22) Filed: Feb. 4, 2019

(65) Prior Publication Data

US 2019/0153408 A1    May 23, 2019

Related U.S. Application Data

(63) Continuation of application No. 15/247,997, filed on Aug. 26, 2016, now Pat. No. 10,233,433.

(30) Foreign Application Priority Data

Aug. 27, 2015 (EP) ..................................... 15182695

(51) Int. Cl.
| | | |
|---|---|---|
| *A61K 35/745* | (2015.01) | |
| *A61K 35/74* | (2015.01) | |
| *A23L 33/135* | (2016.01) | |
| *A23C 9/12* | (2006.01) | |
| *C12N 9/12* | (2006.01) | |

(52) U.S. Cl.
CPC .............. *C12N 9/12* (2013.01); *A23C 9/1203* (2013.01); *A23L 33/135* (2016.08); *A61K 35/74* (2013.01); *A61K 35/745* (2013.01); *C12Y 207/10002* (2013.01); *A23V 2002/00* (2013.01); *A23Y 2300/55* (2013.01)

(58) Field of Classification Search
CPC . A23C 9/1203; A23L 33/135; A23V 2002/00; A23Y 2300/55; A61K 35/74; A61K 35/745; C12N 9/12; C12Y 207/10002
See application file for complete search history.

(56) References Cited

U.S. PATENT DOCUMENTS

| | | |
|---|---|---|
| 7,195,906 B2 | 3/2007 | Collins et al. |
| 7,923,000 B2 | 4/2011 | Chen et al. |
| 8,168,170 B2 | 5/2012 | Myatt |
| 8,216,563 B2 | 7/2012 | Chen et al. |
| 8,357,794 B2 | 1/2013 | Grant et al. |
| 8,926,952 B2 | 1/2015 | Trejo et al. |
| 2008/0145341 A1 | 6/2008 | Myatt et al. |
| 2009/0196921 A1 | 8/2009 | Ebel et al. |
| 2010/0183559 A1 | 7/2010 | Van Sinderen et al. |
| 2016/0228476 A1 | 8/2016 | Cutcliffe et al. |

FOREIGN PATENT DOCUMENTS

| | | |
|---|---|---|
| WO | WO2003010299 A1 | 2/2003 |
| WO | WO2008117267 A2 | 10/2008 |

OTHER PUBLICATIONS

International Search Report and Written Opinion for PCT/US2016/048853 dated Nov. 18, 2016.
Routray, Winny et al. "Scientific and Technical Aspects of Yogurt Aroma and Taste: A Review", Comprehensive Reviews in Food Science and Food Safety 10: 208-220, 2011.
Wu, Ming-Hsiu et al., "Exopolysaccharide activities from probiotic bifidobacteriurn: Immunomodulatory effects (on J774A.1 macrophages) and antimicrobial properties" International Journal of Food Microbiology, vol. 144, No. 1, Nov. 15, 2010, pp. 104-110.
All Office Actions from U.S. Appl. No. 15/247,997, filed Aug. 26, 2016.

*Primary Examiner* — Sarvamangala Devi
*Assistant Examiner* — S. Devi
(74) *Attorney, Agent, or Firm* — Bookoff McAndrews, PLLC

(57) ABSTRACT

A formulation comprising an ingestible carrier and an isolated strain of *Bifidobacterium longum*.

5 Claims, 6 Drawing Sheets

Specification includes a Sequence Listing.

BIFIDOBACTERIUM LONGUM

FIELD OF THE INVENTION

The invention relates to the genome of a probiotic bifidobacteria strain, proteins encoded by the genome and exopolysaccharides produced by the proteins. Bifidobacteria are one of several predominant culturable bacteria present in human colonic microflora.

BACKGROUND OF THE INVENTION

Bifidobacteria are considered to be probiotics as they are living organisms which exert healthy effects beyond basic nutrition when ingested in sufficient numbers. A high level of ingested bifidobacteria must reach their site of action in order to exert a probiotic effect. A minimum level of approximately $10^6$-$10^7$ viable bifidobacteria per gram intestinal contents has been suggested (Bouhnik, Y., Lait 1993). There are reports in the literature which show that in vivo studies completed in adults and in infants indicate that some strains of bifidobacteria are capable of surviving passage through the gastrointestinal tract. Significant differences have been observed between the abilities of different bifidobacteria strains to tolerate acid and bile salts, indicating that survival is an important criterion for the selection of potential probiotic strains.

Ingestion of bifidobacteria can improve gastrointestinal transit and may prevent or assist in the treatment of illnesses which may be caused by deficient or compromised microflora such as gastrointestinal tract (GIT) infections, constipation, irritable bowel syndrome (IBS), inflammatory bowel disease (IBD)—Crohn's disease and ulcerative colitis, food allergies, antibiotic-induced diarrhoea, cardiovascular disease, and certain cancers (e.g. colorectal cancer).

Because of their perceived health-promoting activities, bifidobacteria have in recent years enjoyed an increased amount of scientific scrutiny, which included the full genomic sequencing of a number of strains (reviewed by Liu et al., 2005). These genomic sequences will provide the genetic platforms that allow the study of the molecular mechanisms by which these micro organisms interact with their human host and elicit their probiotic function.

SUMMARY OF THE INVENTION

According to the invention there is provided an isolated and purified *Bifidobacterium longum* strain, wherein the strain:
  a) expresses an exopolysaccharide containing 6-deoxy tabs; and
  b) comprises nucleic acid sequence SEQ ID NO. 86 or nucleic acid sequences with at least 95% sequence homology thereto that codes for protein-tyrosine-phosphatase.

Excluded are the following strains:
35624 (NCIMB 41003)
BL1207 (PTA-9608);
AH121A (NCIMB 41675);
AH1714 (NCIMB 41676); and
AH1206 (NCIMB 41382)

In one embodiment the *Bifidobacterium longum* strain comprises:
  nucleic acid SEQ. ID NO. 86 or a nucleic acid sequence with at least 95% sequence homology thereto;
  nucleic acid SEQ. ID NO. 62 or a nucleic acid sequence with at least 95% sequence homology thereto that codes for priming glcosyltransferase; and
  at least one selected from the group comprising nucleic acid, SEQ ID No. 65, SEQ ID No. 66, SEQ ID No. 69, SEQ ID No. 72, SEQ ID No. 74 or nucleic acid sequences with at least 95% sequence homology thereto that codes for glcosyltransferase.

The strain may comprise at least two selected from the group comprising nucleic acid SEQ ID No. 65, SEQ ID No. 66, SEQ ID No. 69, SEQ ID No. 72, SEQ ID No. 74 or nucleic acid sequences with at least 95% sequence homology thereto.

The strain may comprise at least three selected from the group comprising nucleic acid SEQ ID No. 65, SEQ ID No. 66, SEQ ID No. 69, SEQ ID No. 72, SEQ ID No. 74 or nucleic acid sequences with at least 95% sequence homology thereto.

The strain may comprise at least four selected from the group comprising nucleic acid SEQ ID No. 65, SEQ ID No. 66, SEQ ID No. 69, SEQ ID No. 72, SEQ ID No. 74 or nucleic acid sequences with at least 95% sequence homology thereto.

The strain may comprise nucleic acid SEQ ID No. 65, SEQ ID No. 66, SEQ ID No. 69, SEQ ID No. 72, and SEQ ID No. 74 or nucleic acid sequences with at least 95% sequence homology thereto.

The strain may comprise at least one selected from the group comprising nucleic acid SEQ ID No. 71, SEQ ID No. 76 or nucleic acid sequences with at least 95% sequence homology thereto that codes for acyltransferase.

The strain may comprise nucleic acid SEQ ID No. 71 and SEQ ID No. 76 or nucleic acid sequences with at least 95% sequence homology thereto that codes for acyltransferase.

The invention also provides *Bifidobacterium longum* strain AH0097 having NCIMB accession number 41712 or mutants or variants thereof.

The invention also provides *Bifidobacterium longum* strain AH1172 having NCIMB accession number 41714 or mutants or variants thereof.

The mutant may be a genetically modified mutant.

The variant may be a naturally occurring variant of *Bifidobacterium*.

The *Bifidobacterium* strain may be probiotic.

In some cases the strain is in the form of a biologically pure culture.

Also provided is an isolated strain of *Bifidobacterium longum* AH0097 (NCIMB 41712).

Also provided is an isolated strain of *Bifidobacterium longum* AH1172 (NCIMB 41714).

The strain may be in the form of viable cells or in the form of non-viable cells.

In one case the *Bifidobacterium* strain is isolated from human faeces.

The isolated and purified *Bifidobacterium longum* strain may be in the form of a bacterial broth.

The isolated and purified *Bifidobacterium longum* strain may be in the form of a freeze-dried powder.

The invention also provides a formulation comprising an isolated strain of *Bifidobacterium longum* of the invention.

The formulation may comprise an ingestable carrier.

The ingestable carrier may be a pharmaceutically acceptable carrier.

The ingestable carrier may be a food product

The food product may be selected from the group comprising acidified milk, yoghurt, frozen yoghurt, milk powder, milk concentrate, cheese spread, dressing and beverage.

The formulation may be in the form of a fermented food product.

The formulation may be in the form of a fermented milk product.

In one embodiment the carrier does not occur in nature.

The formulation may be the form of a capsule, a tablet, a pellet, or a powder.

In some cases the strain is present in the formulation at more than $10^6$ CFU per gram of ingestable carrier.

The invention also provides the use of a *Bifidobacterium longum* strain as a probiotic strain.

According to another aspect, the invention provides a method for identifying an exopolysaccharide expressing *Bifidobacterium longum* strain comprising the steps of:

a) obtaining a sample comprising bacteria;
b) extracting nucleic acid from the sample;
c) amplifying the extracted nucleic acid in the presence of at least two primers derived from a nucleic acid sequence selected from the group comprising: SEQ ID No 62 to SEQ ID No 86 or a nucleic acid sequence with at least 95% sequence homology thereto
d) identifying a bacterial strain that expresses an exopolysaccharide.

In one case the primer comprises at least 10 consecutive bases from a nucleic acid sequence selected from the group comprising: SEQ ID No. 62 to SEQ ID No. 86.

The primer may comprise a nucleic acid sequence selected from the group comprising: SEQ ID No. 12 to SEQ ID No. 61 or a nucleic acid sequence with at least 95% sequence homology thereto.

The step of identifying a bacterial strain that expresses an exopolysaccharide may comprise growing the bacterial strain on a Congo red agar plate.

In one case the sample is a mammalian sample.

The sample may be a human derived sample.

In one case the sample is a fecal sample.

Also provided is a *Bifidobacterium longum* strain identified by a method of the invention.

The invention also provides a method for the prophylaxis and/or treatment of undesirable inflammatory activity comprising administering a strain of the invention or a formulation of the invention.

The undesirable inflammatory activity may be undesirable gastrointestinal inflammatory activity such as inflammatory bowel disease eg. Crohns disease or ulcerative colitis, irritable bowel syndrome; pouchitis; or post infection colitis.

Also provided is a method for the prophylaxis and/or treatment of gastrointestinal cancer(s) comprising administering a strain of the invention or a formulation of the invention.

Also provided is a method for the prophylaxis and/or treatment of systemic disease such as rheumatoid arthritis comprising administering a strain of the invention or a formulation of the invention.

Also provided is a method for the prophylaxis and/or treatment of autoimmune disorders due to undesirable inflammatory activity comprising administering a strain of the invention or a formulation of the invention.

Also provided is a method for the prophylaxis of cancer comprising administering a strain of the invention or a formulation of the invention.

The invention also provides a method for the prophylaxis and/or treatment of diarrhoeal disease due to undesirable inflammatory activity, such as *Clostridium difficile* associated diarrhoea, Rotavirus associated diarrhoea or post infective diarrhoea or diarrhoeal disease due to an infectious agent, such as *E. coli* comprising administering a strain of the invention or a formulation of the invention.

Also provided is a method for the prevention and/or treatment of inflammatory disorders, immunodeficiency, inflammatory bowel disease, irritable bowel syndrome, cancer (particularly of the gastrointestinal and immune systems), diarrhoeal disease, antibiotic associated diarrhoea, paediatric diarrhoea, appendicitis, autoimmune disorders, multiple sclerosis, Alzheimer's disease, rheumatoid arthritis, coeliac disease, diabetes mellitus, organ transplantation, bacterial infections, viral infections, fungal infections, periodontal disease, urogenital disease, sexually transmitted disease, HIV infection, HIV replication, HIV associated diarrhoea, surgical associated trauma, surgical-induced metastatic disease, sepsis, weight loss, anorexia, fever control, cachexia, wound healing, ulcers, gut barrier function, allergy, asthma, respiratory disorders, circulatory disorders, coronary heart disease, anaemia, disorders of the blood coagulation system, renal disease, disorders of the central nervous system, hepatic disease, ischaemia, nutritional disorders, osteoporosis, endocrine disorders, epidermal disorders, psoriasis and/or acne vulgaris comprising administering a strain of the invention or a formulation of the invention.

A *Bifidobacterium longum* strain in accordance with an embodiment of the invention may express or produce EPS at a yield of between about 1 mg/L to about 1000 mg/L of bacterial culture depending on growth conditions.

BRIEF DESCRIPTION OF THE DRAWINGS

The invention will be more clearly understood from the following description thereof given by way of example only with reference to the accompanying drawings in which.

DETAILED DESCRIPTION OF THE INVENTION

Figure 1:
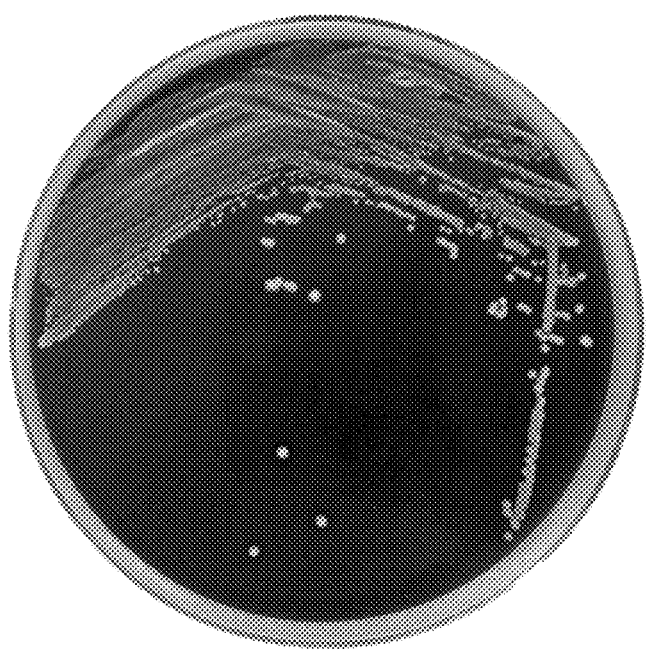
FIG. 1 is a photograph of *B. longum* NCIMB 41712 (AH0097) grown on a Congo Red Agar plate.

A deposit of *Bifidobacterium longum* 35624 was made at the National Collections of Industrial and Marine Bacteria Limited (NCIMB) Ferguson Building, Craibstone Estate, Bucksburn, Aberdeen, AB21 9YA, Scotland, UK on Jan. 13, 1999 and accorded the accession number NCIMB 41003.

A deposit of *Bifidobacterium longum* strain AH0097 was made at the National Collections of Industrial and Marine Bacteria Limited (NCIMB) Ferguson Building, Craibstone Estate, Bucksburn, Aberdeen, AB21 9YA, Scotland, UK on May 6, 2010 and accorded the accession number NCIMB 41712.

A deposit of *Bifidobacterium longum* strain AH1172 was made at the National Collections of Industrial and Marine Bacteria Limited (NCIMB) Ferguson Building, Craibstone Estate, Bucksburn, Aberdeen, AB21 9YA, Scotland, UK on May 6, 2010 and accorded the accession number NCIMB 41714.

Given the size of the isolated polynucleotide it would not be uncommon for a point mutation or some other form of mutation to be present in the sequence. As such we encompass variants of SEQ ID No. 1 in the disclosure. As used herein, the term "variants", means strains of Bifidobacteria that have a sequence identity of at least 99.5% or more with SEQ ID No. 1.

As used herein, the term "sequence homology" encompasses sequence homology at a nucleic acid and/or an amino acid (protein) level. Sequence homology is indicated as the overall percentage of identity across the nucleic acid and/or amino acid sequence. The sequence homology may be determined using standard techniques known to those skilled in the art. For example sequence homology may be determined using the on-line homology algorithm "BLAST" program. A sequence may have at least at least 95% or at least 96% or at least 97% or at least 98% or at least 99% sequence homology with the nucleic acid sequences described herein or the amino acid (protein) encoded thereby.

The present invention is based on the whole genome sequence of *Bifidobacterium longum* NCIMB 41003 (35624™). The genome sequence is listed in SEQ ID No. 1 of the attached sequence listing and comprises 2,264,056 base pairs. Analysis of the genome sequence identified 1,734 genes having the open reading frames as set out in Table 1 below.

TABLE 1

Open reading frames of the genome of 35624.

| Gene ID | Start | End | Strand | Predicted Function |
|---|---|---|---|---|
| B624_0001 | 1 | 1500 | + | chromosomal replication initiator protein DnaA |
| B624_0002 | 2239 | 3360 | + | DNA polymerase III, beta subunit |
| B624_0003 | 3442 | 4626 | + | recF protein |
| B624_0004 | 4626 | 5093 | + | hypothetical protein |
| B624_0005 | 5277 | 7364 | + | DNA gyrase, B subunit |
| B624_0006 | 7435 | 10083 | + | DNA gyrase, A subunit |
| B624_0007 | 10156 | 10719 | + | hypothetical protein |
| B624_0008 | 11406 | 12116 | + | hypothetical protein |
| B624_0009 | 12116 | 13699 | + | Pectinesterase |
| B624_0010 | 14103 | 15446 | − | NADP-specific glutamate dehydrogenase |
| B624_0011 | 15768 | 16199 | − | AsnC-type transcriptional regulator |
| B624_0012 | 16405 | 17736 | + | aspartate aminotransferase |
| B624_0013 | 17757 | 18746 | − | hypothetical protein |
| B624_0014 | 19007 | 19600 | + | hypothetical protein |
| B624_0015 | 19617 | 20462 | + | hypothetical protein |
| B624_0016 | 20579 | 20821 | + | hypothetical protein |
| B624_0017 | 21403 | 21735 | − | transposase |
| B624_0018 | 22130 | 23497 | − | Transcriptional regulatorscontaining a DNA-binding HTH domain and anaminotransferase domain (MocR family) |
| B624_0019 | 24132 | 25454 | + | gabt-aminotransferase, class III superfamily |
| B624_0020 | 25675 | 26397 | + | Metal-dependent hydrolase |
| B624_0021 | 26487 | 26849 | + | Gluconate kinase |
| B624_0022 | 27115 | 28424 | − | Hypothetical protein |
| B624_0023 | 28662 | 29138 | − | Dps family protein |
| B624_0024 | 29263 | 30578 | − | CBS domain protein |
| B624_0025 | 30841 | 31521 | − | Prokaryotic-type carbonic anhydrases |
| B624_0026 | 31727 | 32287 | + | alkyl hydrogen peroxide reductase |
| B624_0027 | 32458 | 34371 | + | thioredoxin reductase |
| B624_0028 | 34494 | 35777 | − | hypothetical protein |
| B624_0029 | 36333 | 37328 | + | LacI-type transcriptional regulator |
| B624_0030 | 37558 | 40308 | − | phosphoenolpyruvate carboxylase |
| B624_0031 | 40594 | 42471 | + | protein of unknown function |
| B624_0032 | 42707 | 44342 | + | possible sodium/proline symporter |
| B624_0033 | 44680 | 45663 | − | hypothetical protein |
| B624_0034 | 45917 | 47533 | + | amidohydrolase 3 |
| B624_0035 | 47717 | 48805 | − | tryptophanyl-tRNA synthetase |
| B624_0036 | 48939 | 49325 | + | hypothetical protein |
| B624_0037 | 49437 | 49841 | − | hypothetical protein |
| B624_0038 | 49986 | 52505 | + | glycogen phosphorylase |
| B624_0039 | 52725 | 52940 | − | hypothetical protein |
| B624_0040 | 53045 | 53880 | + | Rhomboid family protein |
| B624_0041 | 54557 | 55029 | − | hypothetical protein |
| B624_0042 | 55119 | 55907 | + | hypothetical protein |
| B624_0043 | 55907 | 57142 | + | Sortase |
| B624_0044 | 57196 | 57837 | + | para-aminobenzoate synthase glutamineamidotransferase component II |
| B624_0045 | 58067 | 60136 | − | serine/threonine protein kinase |
| B624_0046 | 60136 | 61083 | − | serine/threonine protein kinase |
| B624_0047 | 61083 | 62546 | − | pbpA |
| B624_0048 | 62546 | 64204 | − | cell cycle protein |
| B624_0049 | 64204 | 65895 | − | possible phosphoprotein phosphatase |
| B624_0050 | 65903 | 66430 | − | FHA-domain-containing proteins |
| B624_0051 | 66463 | 67161 | − | FHA domain protein |
| B624_0052 | 67349 | 69790 | − | dipeptidyl peptidase IV |
| B624_0053 | 69900 | 70997 | + | lysophospholipase L2 |
| B624_0054 | 71089 | 72221 | + | von Willebrand factor type A domain protein |

TABLE 1-continued

Open reading frames of the genome of 35624.

| Gene ID | Start | End | Strand | Predicted Function |
|---|---|---|---|---|
| B624_0056 | 72947 | 73348 | + | hypothetical protein |
| B624_0058 | 75108 | 75608 | + | heat shock protein, Hsp20 family |
| B624_0059 | 75938 | 76891 | + | Methyl viologen exporter |
| B624_0060 | 77065 | 77520 | − | hypothetical protein |
| B624_0061 | 77753 | 79132 | + | esterase |
| B624_0062 | 79132 | 81702 | + | Uncharacterized BCR |
| B624_0063 | 82241 | 83212 | + | peptide methionine sulfoxide reductase |
| B624_0064 | 83506 | 86709 | − | helicase-related protein |
| B624_0065 | 86785 | 87195 | − | mutator MutT protein |
| B624_0066 | 88258 | 88587 | + | hypothetical protein |
| B624_0067 | 88678 | 89139 | + | acetyltransferase, GNAT family family |
| B624_0068 | 89226 | 90080 | − | Hemolysin III-like membrane protein |
| B624_0069 | 90480 | 90842 | + | hypothetical protein |
| B624_0070 | 91329 | 92639 | − | queuine tRNA-ribosyltransferase |
| B624_0071 | 93056 | 95065 | + | peptidase S1 and S6, chymotrypsin/Hap |
| B624_0072 | 95477 | 97636 | + | cation-transporting ATPase, E1-E2 family |
| B624_0073 | 97816 | 98862 | + | transcriptional regulator, LacI family |
| B624_0074 | 98874 | 99131 | − | Sec-independent protein translocase protein TatB-like protein |
| B624_0075 | 99173 | 100215 | − | Twin arginine targeting (Tat) protein translocase TatC |
| B624_0076 | 100215 | 100502 | − | Twin-arginine translocationprotein, TatA/E family |
| B624_0077 | 101182 | 103584 | + | Hypothetical protein |
| B624_0078 | 103674 | 106151 | + | Bacterial surface proteins containing Ig-like domains |
| B624_0079 | 106547 | 107707 | − | AAA+ superfamily ATPase |
| B624_0080 | 107911 | 109359 | + | ferredoxin/ferredoxin--NADP reductase |
| B624_0081 | 109533 | 110450 | + | heat shock protein HtpX |
| B624_0082 | 110667 | 111731 | − | fructose-bisphosphate aldolase, class II |
| B624_0083 | 111947 | 113230 | + | adenylosuccinate synthetase |
| B624_0084 | 113257 | 114837 | + | CPA2 family monovalent cation:proton (H+) antiporter-2 |
| B624_0085 | 115027 | 116094 | + | CrcB-like protein family |
| B624_0086 | 116097 | 116489 | + | protein with similarity to CrcB |
| B624_0087 | 116767 | 117849 | + | sugar-binding transcriptional regulator, LacIfamily |
| B624_0088 | 118052 | 119842 | + | Kup system potassium uptake protein [imported] |
| B624_0089 | 120262 | 121806 | + | alpha-L-arabinofuranosidase |
| B624_0090 | 121993 | 123012 | + | transcription regulator, LacI family [imported] |
| B624_0091 | 123104 | 124012 | − | Alpha-glucosidase |
| B624_0093 | 124604 | 125803 | + | probable integrase/recombinase |
| B624_0094 | 125803 | 126765 | + | probable integrase/recombinase |
| B624_0095 | 126765 | 127817 | + | integrase/recombinase XerC, probable [imported] |
| B624_0096 | 127910 | 128956 | − | IS3 family transposase |
| B624_0097 | 129291 | 130814 | + | ScrP-sucrose phosphorylase |
| B624_0098 | 131035 | 132669 | + | ScrT |
| B624_0099 | 132736 | 133776 | + | LacI family transcriptional regulator |
| B624_0100 | 134407 | 135771 | + | major facilitator family transporter |
| B624_0101 | 135971 | 137020 | + | ketol-acid reductoisomerase |
| B624_0102 | 137452 | 138501 | + | ketol-acid reductoisomerase |
| B624_0103 | 138689 | 140500 | − | alpha-amylase family protein |
| B624_0104 | 140663 | 141694 | − | transcription regulator, LacI family [imported] |
| B624_0105 | 142008 | 144242 | − | 4-alpha-glucanotransferase |
| B624_0107 | 144829 | 145482 | + | alpha-amylase |
| B624_0108 | 145500 | 146507 | − | transcription regulator, LacI family [imported] |
| B624_0109 | 146777 | 147490 | + | sugar ABC transporter, permease protein |
| B624_0110 | 147605 | 150139 | + | glycosyl hydrolase, family 31 |
| B624_0111 | 151125 | 153002 | + | dnaK protein |
| B624_0112 | 153005 | 153658 | + | co-chaperone GrpE |
| B624_0113 | 153753 | 154769 | + | DnaJ protein |
| B624_0114 | 154787 | 155371 | + | hspR |
| B624_0115 | 155647 | 156996 | + | xanthine permease |
| B624_0116 | 157036 | 158154 | + | possible acyl protein synthase/acyl-CoAreductase-like protein |
| B624_0117 | 158144 | 159640 | + | possible acyl-CoA reductase |
| B624_0118 | 159697 | 160497 | + | 3-oxoacyl-acyl carrier protein reductase |
| B624_0119 | 160613 | 161281 | + | Haloacid dehalogenase-like hydrolase, HAD superfamily |
| B624_0120 | 161435 | 162157 | + | DedA protein |
| B624_0121 | 162635 | 163330 | + | ATPase for chromosome partitioning |
| B624_0122 | 163340 | 164404 | + | tadA ATPase |
| B624_0123 | 164407 | 165060 | + | Flp pilus assembly protein |
| B624_0124 | 165060 | 165659 | + | tadC |
| B624_0125 | 165947 | 166231 | + | hypothetical protein |
| B624_0126 | 166240 | 166614 | + | hypothetical protein |
| B624_0127 | 166667 | 167041 | + | oppa3 |
| B624_0128 | 167093 | 168220 | + | BmrU protein |
| B624_0129 | 168424 | 169020 | − | Transcriptional regulator |
| B624_0130 | 169216 | 172125 | + | DNA polymerase III, tau/gamma subunit |
| B624_0131 | 172154 | 172753 | + | recombination protein RecR |
| B624_0132 | 172756 | 173886 | − | sortase family protein |

TABLE 1-continued

Open reading frames of the genome of 35624.

| Gene ID | Start | End | Strand | Predicted Function |
|---|---|---|---|---|
| B624_0134 | 174774 | 176054 | + | hypothetical protein |
| B624_0135 | 176418 | 177179 | + | aspartokinase, alpha and beta subunits |
| B624_0136 | 177238 | 177801 | + | aspartokinase, alpha and beta subunits |
| B624_0137 | 177889 | 178980 | − | aspartate-semialdehyde dehydrogenase |
| B624_0138 | 179148 | 179765 | + | hypothetical protein |
| B624_0139 | 179774 | 181351 | − | Calcineurin-like phosphoesterase |
| B624_0140 | 182040 | 183953 | + | 2-isopropylmalate synthase |
| B624_0141 | 184031 | 186433 | − | penicillin-binding protein |
| B624_0142 | 186811 | 187959 | + | phosphoesterase |
| B624_0143 | 188086 | 191169 | + | DNA topoisomerase I |
| B624_0144 | 191450 | 192067 | + | thymidylate kinase |
| B624_0145 | 192067 | 193215 | + | DNA polymerase III, delta subunit |
| B624_0146 | 193337 | 193888 | + | hypothetical protein |
| B624_0147 | 194034 | 195632 | + | Dipeptidase |
| B624_0148 | 195767 | 197281 | + | formate--tetrahydrofolate ligase |
| B624_0149 | 197684 | 198028 | − | hypothetical protein |
| B624_0150 | 198230 | 198763 | + | hypothetical protein |
| B624_0151 | 198817 | 200259 | − | hypothetical protein |
| B624_0152 | 200521 | 201177 | + | phosphoglycerate mutase family protein |
| B624_0153 | 201278 | 202228 | + | hypothetical protein |
| B624_0154 | 202352 | 203224 | + | Aldose 1-epimerase-like protein |
| B624_0155 | 203348 | 204496 | − | extensin precursor (cell wallhydroxyproline-rich glycoprotein) |
| B624_0156 | 204684 | 204866 | + | hypothetical protein |
| B624_0157 | 205053 | 206570 | + | glutamyl-tRNA synthetase |
| B624_0158 | 207503 | 207988 | + | hypothetical protein |
| B624_0159 | 208388 | 214285 | + | endo-alpha-N-acetylgalactosaminidase |
| B624_0160 | 214390 | 215208 | − | hypothetical protein |
| B624_0161 | 216652 | 218460 | + | hypothetical protein |
| B624_0162 | 218640 | 219317 | + | membrane antigen |
| B624_0163 | 219470 | 220744 | + | Integral membrane protein |
| B624_0164 | 220769 | 222070 | + | possible permease protein of ABC transportersystem |
| B624_0165 | 222107 | 223327 | + | possible permease protein of ABC transportersystem |
| B624_0166 | 223346 | 224140 | + | ABC transporter, ATP-binding protein |
| B624_0167 | 224259 | 224819 | + | FMN-binding domain |
| B624_0168 | 224831 | 225427 | − | Bacterial regulatory proteins, TetR family |
| B624_0169 | 225545 | 227704 | − | phage infection protein |
| B624_0170 | 227704 | 230331 | − | phage infection protein |
| B624_0171 | 230686 | 231969 | + | membrane protein |
| B624_0172 | 232151 | 233602 | + | 6-phosphogluconate dehydrogenase, decarboxylating |
| B624_0173 | 233756 | 234595 | − | 6-phosphogluconolactonase |
| B624_0174 | 234825 | 235847 | − | oxppcycle protein OpcA |
| B624_0175 | 235847 | 237382 | − | glucose-6-phosphate 1-dehydrogenase |
| B624_0176 | 237706 | 239337 | + | dipeptidase |
| B624_0177 | 239417 | 240448 | − | Glycosyltransferase involved in cell wallbiogenesis |
| B624_0178 | 240475 | 241293 | − | transcriptional regulator, TetR family |
| B624_0179 | 241407 | 242675 | + | signal recognition particle-docking protein FtsY |
| B624_0180 | 243046 | 244338 | + | ammonium transporter |
| B624_0181 | 244343 | 244678 | + | Nitrogen regulatory protein P-II |
| B624_0182 | 244790 | 246613 | + | protein-pII; uridylyltransferase |
| B624_0183 | 246653 | 248095 | − | DNA-damage-inducible protein F |
| B624_0184 | 248370 | 249827 | + | replicative DNA helicase |
| B624_0185 | 249830 | 251299 | + | UDP-N-acetylmuramoylalanyl-D-glutamate--2,6-diaminopimelate ligase |
| B624_0186 | 251405 | 252154 | + | cobyric acid synthase |
| B624_0187 | 252306 | 252590 | + | hypothetical protein |
| B624_0188 | 252590 | 254407 | + | ABC1 family |
| B624_0189 | 254428 | 255447 | − | transcriptional regulator, LacI family |
| B624_0190 | 255933 | 257255 | + | ABC superfamily ATP binding cassette transporter |
| B624_0191 | 257546 | 258469 | + | sugar ABC transporter, permease protein |
| B624_0192 | 258493 | 259308 | + | sugar permease of ABC transporter system |
| B624_0193 | 259473 | 261446 | + | hypothetical protein |
| B624_0194 | 262147 | 267966 | + | hypothetical |
| B624_0195 | 268074 | 271778 | + | Glycosyl hydrolase |
| B624_0196 | 271911 | 272741 | + | Hypothetical protein |
| B624_0197 | 272825 | 273835 | − | prsA |
| B624_0198 | 273960 | 274439 | − | hypothetical protein |
| B624_0199 | 274601 | 274891 | + | ribosomal protein S6 |
| B624_0200 | 274951 | 275604 | + | Single-strand binding protein |
| B624_0201 | 275668 | 275913 | + | ribosomal protein S18 |
| B624_0202 | 275936 | 276379 | + | ribosomal protein L9 |
| B624_0203 | 276769 | 277026 | + | ptsH |
| B624_0204 | 277029 | 278705 | + | PTS Enzyme I |
| B624_0205 | 278942 | 279673 | + | glycerol uptake facilitator protein |
| B624_0206 | 279763 | 282468 | − | copper-translocating P-type ATPase |
| B624_0207 | 282580 | 282858 | + | Conserved Protein Domain Family FrmR |

TABLE 1-continued

Open reading frames of the genome of 35624.

| Gene ID | Start | End | Strand | Predicted Function |
|---|---|---|---|---|
| B624_0208 | 282904 | 284325 | + | possible DNA recombination protein RmuC |
| B624_0209 | 284325 | 284951 | + | hypothetical protein |
| B624_0210 | 285048 | 285893 | + | SpoU3 |
| B624_0211 | 286063 | 286359 | + | glutamyl-tRNA(Gln) amidotransferase, C subunit |
| B624_0212 | 286366 | 287904 | + | glutamyl-tRNA(Gln) amidotransferase, A subunit |
| B624_0213 | 287933 | 289429 | + | glutamyl-tRNA(Gln) amidotransferase, B subunit |
| B624_0214 | 289728 | 290789 | + | acetyltransferase |
| B624_0215 | 290803 | 291114 | + | hypothetical protein |
| B624_0216 | 291276 | 293141 | + | hypothetical protein |
| B624_0217 | 293363 | 294973 | + | hypothetical protein |
| B624_0218 | 295182 | 297248 | + | transcription termination factor Rho |
| B624_0219 | 297559 | 297945 | + | chorismate mutase |
| B624_0220 | 298190 | 300151 | + | hypothetical protein |
| B624_0221 | 300383 | 303115 | − | valyl-tRNA synthetase |
| B624_0222 | 303262 | 304785 | − | ABC-type dipeptide transport system, periplasmic component |
| B624_0223 | 304850 | 305533 | − | endonuclease III |
| B624_0224 | 305595 | 306392 | − | Response regulator |
| B624_0225 | 306556 | 307257 | − | hypothetical protein |
| B624_0226 | 307369 | 307950 | − | integral membrane protein |
| B624_0227 | 308187 | 308678 | − | inorganic pyrophosphatase |
| B624_0228 | 308908 | 310980 | − | alpha-amylase family protein |
| B624_0229 | 311386 | 313377 | + | LPXTG-motif cell wall anchor domain-containing protein |
| B624_0230 | 313988 | 315019 | + | homoserine O-succinyltransferase |
| B624_0231 | 315484 | 316293 | + | ATP synthase F0, A subunit |
| B624_0232 | 316400 | 316624 | + | ATP synthase F0, C subunit |
| B624_0233 | 316684 | 317199 | + | ATP synthase F0, B subunit |
| B624_0234 | 317237 | 318070 | + | ATP synthase F1, delta subunit |
| B624_0235 | 318149 | 319777 | + | ATP synthase F1, alpha subunit |
| B624_0236 | 319784 | 320704 | + | ATP synthase F1, gamma subunit |
| B624_0237 | 320716 | 322185 | + | ATP synthase F1, beta subunit |
| B624_0238 | 322188 | 322478 | + | ATP synthase F1, epsilon subunit |
| B624_0239 | 322569 | 323336 | + | nuclease of the RecB family |
| B624_0240 | 323388 | 324374 | − | possible secreted peptidyl-prolyl cis-transisomerase protein |
| B624_0241 | 324455 | 325531 | + | hypothetical protein |
| B624_0242 | 325534 | 326538 | + | hypothetical protein |
| B624_0243 | 326790 | 327761 | + | hypothetical protein |
| B624_0244 | 327850 | 328473 | − | Uncharacterized protein in bacteria |
| B624_0245 | 329012 | 329398 | + | endoribonuclease L-PSP |
| B624_0246 | 329584 | 330498 | + | phospholipid/glycerol acyltransferase |
| B624_0247 | 330595 | 331593 | + | glycerol-3-phosphate dehydrogenase, NAD-dependent |
| B624_0248 | 331783 | 332967 | + | D-ala D-ala ligase |
| B624_0249 | 333223 | 334386 | + | ABC transporter, periplasmic substrate-binding protein |
| B624_0250 | 334401 | 335348 | + | spermidine/putrescine ABC transporter, permease protein |
| B624_0251 | 335348 | 336199 | + | spermidine/putrescine ABC transporter, permeaseprotein |
| B624_0252 | 336207 | 337481 | + | spermidine/putrescine ABC transporter, ATP-binding protein |
| B624_0253 | 337788 | 338828 | + | CAAX amino terminal protease family proteinfamily |
| B624_0254 | 338873 | 339667 | − | Mechanosensitive ion channel family |
| B624_0255 | 339751 | 341181 | − | aspartate ammonia-lyase |
| B624_0256 | 341302 | 342030 | − | Transcriptional regulator |
| B624_0257 | 342124 | 343527 | − | hypothetical protein |
| B624_0258 | 343852 | 344400 | − | methylated-DNA--protein-cysteinemethyltransferase |
| B624_0259 | 345162 | 346055 | + | hypothetical protein |
| B624_0260 | 345928 | 347202 | − | MFS transporter family protein |
| B624_0261 | 347393 | 348406 | − | ribokinase |
| B624_0262 | 348810 | 349001 | + | ribosomal protein L28 |
| B624_0263 | 349104 | 351944 | + | ATP-dependent DNA helicase RecG |
| B624_0264 | 352174 | 352782 | + | methyltransferase |
| B624_0265 | 352812 | 353624 | − | tRNA (guanine-N1)-methyltransferase |
| B624_0266 | 353698 | 355341 | + | protease or peptidase |
| B624_0267 | 355422 | 356399 | + | hypothetical protein |
| B624_0268 | 356482 | 357354 | + | 4-diphosphocytidyl-2C-methyl-D-erythritolsynthase |
| B624_0269 | 357367 | 358041 | + | pyrrolidone-carboxylate peptidase |
| B624_0270 | 358192 | 359766 | + | hypothetical protein |
| B624_0271 | 359884 | 361224 | + | aminopeptidase C |
| B624_0272 | 361519 | 362649 | + | phospho-2-dehydro-3-deoxyheptonate aldolase |
| B624_0273 | 362781 | 364010 | + | phospho-2-dehydro-3-deoxyheptonate aldolase |
| B624_0274 | 364135 | 364845 | + | MTA/SAH nucleosidase |
| B624_0275 | 365099 | 366427 | + | ATPase, histidine kinase domain protein |
| B624_0276 | 366629 | 367330 | + | response regulator |
| B624_0277 | 367583 | 368713 | + | phosphate ABC transporter, phosphate-binding protein |
| B624_0278 | 368927 | 369877 | + | pstC2 |
| B624_0279 | 369880 | 370875 | + | phosphate ABC transporter, permease protein |
| B624_0280 | 370931 | 371707 | + | Phosphate import ATP-binding protein pstB |

TABLE 1-continued

Open reading frames of the genome of 35624.

| Gene ID | Start | End | Strand | Predicted Function |
|---|---|---|---|---|
| B624_0281 | 372005 | 372580 | + | lemA protein |
| B624_0282 | 372647 | 374902 | + | Membrane protein |
| B624_0283 | 374971 | 375831 | + | oxidoreductase, aldo/keto reductase family |
| B624_0284 | 375932 | 376981 | + | inosine-uridine preferring nucleoside hydrolase |
| B624_0285 | 377109 | 377729 | − | 16S rRNA processing protein RimM |
| B624_0286 | 377755 | 377985 | − | KH domain protein |
| B624_0287 | 378009 | 378467 | − | ribosomal protein S16 |
| B624_0288 | 378703 | 379809 | − | Endonuclease/Exonuclease/phosphatase familyfamily |
| B624_0289 | 379889 | 381547 | − | signal recognition particle protein |
| B624_0290 | 381843 | 382748 | + | Co/Zn/Cd cation transporter |
| B624_0291 | 382773 | 384419 | − | cysteinyl-tRNA synthetase |
| B624_0292 | 384518 | 385363 | + | amidotransferase |
| B624_0293 | 385414 | 387687 | + | ABC transporter, ATP-binding protein |
| B624_0294 | 387746 | 388162 | − | plasmid stability protein StbB |
| B624_0295 | 388175 | 388450 | − | Plasmid stability protein |
| B624_0296 | 388609 | 389160 | − | acetolactate synthase, small subunit |
| B624_0297 | 389180 | 391144 | − | acetolactate synthase, large subunit, biosynthetic type |
| B624_0298 | 391308 | 392033 | − | ribonuclease III |
| B624_0299 | 392189 | 392380 | − | Ribosomal protein L32 |
| B624_0300 | 392472 | 393098 | − | Uncharacterized ACR protein |
| B624_0301 | 393191 | 394078 | − | hypothetical protein |
| B624_0302 | 394089 | 394586 | − | pantetheine-phosphate adenylyltransferase |
| B624_0303 | 394860 | 395150 | + | hypothetical protein |
| B624_0304 | 395198 | 396205 | − | K channel, beta subunit |
| B624_0305 | 396379 | 396804 | + | transcription regulator, MerR family |
| B624_0306 | 396910 | 397533 | − | hypothetical protein |
| B624_0307 | 397764 | 399083 | + | nicotinate phosphoribosyltransferase |
| B624_0308 | 399369 | 400142 | + | ribonuclease PH |
| B624_0309 | 400189 | 400944 | + | Ham1 family |
| B624_0310 | 401394 | 402659 | + | Methicillin resistance protein |
| B624_0311 | 402736 | 404043 | + | FemAB family protein |
| B624_0312 | 404096 | 405373 | + | Methicillin resistance protein |
| B624_0313 | 405462 | 406460 | − | auxin efflux carrier |
| B624_0314 | 407182 | 408879 | + | glucose-6-phosphate isomerase |
| B624_0315 | 409515 | 409877 | + | ribosomal protein L19 |
| B624_0316 | 410047 | 410901 | + | lepB2 |
| B624_0317 | 411024 | 411860 | + | ribonuclease HII |
| B624_0318 | 411990 | 413102 | + | transcription regulator, LacI family [imported] |
| B624_0319 | 413261 | 414904 | + | probable sugar kinase |
| B624_0320 | 414992 | 415681 | + | L-ribulose-5-phosphate 4-epimerase |
| B624_0321 | 415916 | 417430 | + | L-arabinose isomerase |
| B624_0322 | 417620 | 418333 | − | Glutamine amidotransferase |
| B624_0323 | 418607 | 420178 | + | hypothetical protein |
| B624_0324 | 420330 | 421694 | + | ABC superfamily ATP binding cassette transporter, membrane protein |
| B624_0325 | 421694 | 422914 | + | permease protein |
| B624_0326 | 422930 | 423562 | + | ABC transporter ATP-binding protein |
| B624_0327 | 423886 | 425706 | − | long-chain-fatty-acid--CoA ligase |
| B624_0329 | 426606 | 429890 | + | ABC transporter |
| B624_0331 | 431272 | 432618 | + | solute binding protein of ABC transportersystem |
| B624_0332 | 432840 | 433799 | + | sugar ABC transporter, permease protein |
| B624_0333 | 433805 | 434809 | + | ABC-type sugar transport systems, permease components |
| B624_0334 | 434999 | 437128 | + | beta-galactosidase |
| B624_0335 | 437175 | 438227 | + | transcription regulator, LacI family [imported] |
| B624_0336 | 438426 | 441116 | + | arabinogalactan endo-1,4-beta-galactosidase |
| B624_0337 | 441755 | 442621 | + | 2,5-didehydrogluconate reductase |
| B624_0338 | 442691 | 443368 | + | extracellular deoxyribonuclease |
| B624_0339 | 443378 | 444745 | − | Hypothetical protein |
| B624_0340 | 445003 | 446367 | + | transport protein, NRAMP family |
| B624_0341 | 446472 | 448073 | − | LinCd |
| B624_0342 | 448412 | 450007 | + | glycosyl transferase CpsD |
| B624_0343 | 450098 | 452029 | + | hypothetical protein |
| B624_0344 | 452091 | 453566 | + | chain length determinant protein |
| B624_0345 | 453574 | 454725 | + | glycosyl transferase, group 1family protein |
| B624_0346 | 454725 | 456065 | + | Glycosyltransferase protein |
| B624_0347 | 456065 | 457126 | + | UDP-glucuronate 5'-epimerase |
| B624_0348 | 457201 | 458448 | + | UDP-glucose 6-dehydrogenase |
| B624_0349 | 458489 | 459550 | + | glycosyl transferase, group 1 family protein |
| B624_0350 | 459581 | 460408 | + | NAD dependent epimerase/dehydratase family |
| B624_0351 | 460446 | 460952 | + | acetyltransferase |
| B624_0352 | 460985 | 461998 | + | Glycosyl transferase |
| B624_0353 | 462020 | 463360 | + | polymerase involved in polysaccharide synthesis |
| B624_0354 | 463363 | 464292 | + | rhamnosyl transferase |
| B624_0355 | 464311 | 465753 | + | flippase protein involved in polysaccharide biosynthesis |
| B624_0356 | 465774 | 466280 | + | acetyltransferase |
| B624_0357 | 466366 | 467514 | − | NAD-dependent epimerase/dehydratase family protein |

TABLE 1-continued

Open reading frames of the genome of 35624.

| Gene ID | Start | End | Strand | Predicted Function |
|---|---|---|---|---|
| B624_0358 | 467785 | 468615 | − | integrase, catalytic region |
| B624_0359 | 468615 | 468770 | − | transposase IS3/IS911 family protein |
| B624_0360 | 469189 | 470208 | + | dTDP-glucose 4,6-dehydratase |
| B624_0361 | 470218 | 471303 | + | dTDP-4-dehydrorhamnose 3,5-epimerase/dTDP-4-dehydrorhamnose reductase |
| B624_0362 | 471349 | 472245 | + | glucose-1-phosphate thymidylyltransferase |
| B624_0364 | 472715 | 472858 | + | hypothetical protein |
| B624_0365 | 473371 | 473802 | − | hypothetical protein |
| B624_0366 | 474083 | 474640 | − | phosphotyrosine protein phosphatase |
| B624_0367 | 474825 | 475331 | − | hypothetical protein |
| B624_0368 | 475655 | 475867 | − | transcriptional regulator |
| B624_0369 | 475860 | 476282 | − | hypothetical protein |
| B624_0370 | 476415 | 477422 | − | hypothetical protein |
| B624_0371 | 477495 | 477866 | − | thioredoxin 2 |
| B624_0372 | 478122 | 478751 | + | hypothetical protein |
| B624_0373 | 478880 | 479734 | + | alpha beta hydrolase |
| B624_0374 | 479747 | 481036 | + | npyl |
| B624_0375 | 481065 | 481475 | + | glycine cleavage system H protein |
| B624_0376 | 481547 | 482875 | + | hypothetical protein |
| B624_0377 | 482940 | 485453 | + | protease II |
| B624_0378 | 485521 | 486549 | + | 3-isopropylmalate dehydrogenase |
| B624_0379 | 486610 | 487692 | + | lipoate-protein ligase a |
| B624_0380 | 487934 | 488650 | + | probable transcriptional regulator |
| B624_0381 | 488766 | 491069 | + | penicillin-binding protein |
| B624_0382 | 491264 | 492634 | + | NADH-dependent flavin oxidoreductase |
| B624_0383 | 492807 | 493955 | − | dihydroorotate dehydrogenase |
| B624_0384 | 494310 | 495122 | + | DeoR-type regulator |
| B624_0385 | 495118 | 496365 | + | galactose-1-phosphate uridylyltransferase |
| B624_0386 | 496385 | 497632 | + | galactokinase |
| B624_0387 | 497718 | 497987 | + | ACT domain protein |
| B624_0388 | 498126 | 499487 | + | hypothetical protein |
| B624_0389 | 499800 | 500396 | − | spoU |
| B624_0390 | 500480 | 501463 | + | mutY |
| B624_0391 | 501531 | 502250 | + | hypothetical protein |
| B624_0392 | 502408 | 505968 | + | DNA-directed RNA polymerase, beta subunit |
| B624_0393 | 506139 | 510173 | + | DNA-directed RNA polymerase, beta-prime subunit |
| B624_0394 | 510338 | 510967 | − | FHA domain protein |
| B624_0395 | 510986 | 511498 | − | hypothetical protein |
| B624_0396 | 511528 | 512457 | − | phosphoprotein phosphatase |
| B624_0397 | 512457 | 514967 | − | membrane protein |
| B624_0398 | 514967 | 516187 | − | Protein of unknown function family |
| B624_0399 | 516215 | 517585 | − | moxR2 |
| B624_0400 | 517599 | 523580 | − | fibronectin type III domain-containing protein |
| B624_0401 | 523750 | 525168 | − | serine/threonine protein kinase |
| B624_0402 | 525300 | 529592 | + | uvrd4 |
| B624_0403 | 529592 | 533620 | + | UvrD/REP helicase domain protein |
| B624_0404 | 533836 | 535152 | + | transport protein |
| B624_0405 | 535491 | 536243 | + | dihydrodipicolinate reductase |
| B624_0406 | 536409 | 537311 | + | dihydrodipicolinate synthase |
| B624_0407 | 537399 | 539246 | + | metallo-beta-lactamase superfamily protein |
| B624_0408 | 539291 | 541897 | + | Peptidase family M1 domain protein |
| B624_0409 | 542078 | 542971 | + | hypothetical protein |
| B624_0411 | 543954 | 545336 | + | phosphoglucosamine mutase |
| B624_0412 | 545362 | 546012 | + | polypeptide deformylase |
| B624_0413 | 546012 | 547472 | + | DNA polymerase III |
| B624_0414 | 547492 | 547620 | + | hypothetical protein |
| B624_0415 | 547858 | 548979 | + | peptide chain release factor 2 |
| B624_0416 | 548991 | 550121 | + | ftsE |
| B624_0417 | 550135 | 551055 | + | cell division ABC transporter, permease proteinFtsX |
| B624_0418 | 551161 | 552519 | + | CHAP domain containing protein |
| B624_0419 | 552673 | 553146 | + | SsrA-binding protein |
| B624_0420 | 553312 | 554265 | + | amino acid ABC transporter, permease protein |
| B624_0421 | 554479 | 555420 | + | hisj5 |
| B624_0422 | 555554 | 556546 | + | amino acid ABC transporter, permease protein |
| B624_0423 | 556566 | 557393 | + | glutamine ABC transporter, ATP-binding protein |
| B624_0424 | 557604 | 559493 | + | glucosamine--fructose-6-phosphateaminotransferase, isomerizing |
| B624_0425 | 559510 | 560271 | + | Pseudouridylate synthases |
| B624_0426 | 560313 | 560525 | − | hypothetical protein |
| B624_0427 | 560565 | 561554 | − | transcriptional regulator, LacI family |
| B624_0428 | 561794 | 562717 | + | sugar ABC transporter, permease protein |
| B624_0429 | 562776 | 563780 | + | ABC-type sugar transport system, permease component |
| B624_0430 | 563975 | 566047 | + | beta-D-galactosidase |
| B624_0431 | 566169 | 567185 | + | transcriptional regulator, LacI family |
| B624_0432 | 567311 | 569008 | − | alpha-L-arabinofuranosidase |
| B624_0433 | 569168 | 570517 | + | solute binding protein of ABC transportersystem |

TABLE 1-continued

Open reading frames of the genome of 35624.

| Gene ID | Start | End | Strand | Predicted Function |
|---|---|---|---|---|
| B624_0434 | 570852 | 572192 | + | probable solute binding protein of ABCtransporter system for sugars |
| B624_0435 | 572341 | 573729 | + | sugar binding protein Sbp |
| B624_0436 | 573795 | 574562 | − | transcription activator, probable Baf family[imported] |
| B624_0437 | 574688 | 576304 | + | ABC transporter, periplasmic substrate-bindingprotein |
| B624_0438 | 576372 | 577346 | + | membrane protein |
| B624_0439 | 577346 | 578245 | + | peptide ABC transporter, permease protein |
| B624_0440 | 578245 | 579033 | + | ABC transporter, nucleotide binding/ATPase protein |
| B624_0441 | 579029 | 579811 | + | ABC transporter, ATP-binding protein |
| B624_0442 | 580296 | 581360 | + | cystathionine beta-synthase |
| B624_0443 | 581455 | 582636 | + | cystathionine gamma-synthase |
| B624_0444 | 582780 | 584501 | − | ErfK/YbiS/YcfS/YnhG family |
| B624_0445 | 584661 | 586613 | + | ATP-dependent DNA helicase RecQ |
| B624_0446 | 586729 | 587220 | + | autoinducer-2 production protein LuxS |
| B624_0447 | 587378 | 587917 | + | acetyltransferase, GNAT family |
| B624_0448 | 588181 | 589317 | − | hypothetical protein |
| B624_0449 | 589890 | 591347 | − | amino acid permease |
| B624_0450 | 591536 | 592891 | + | alanine racemase |
| B624_0451 | 593099 | 594370 | + | deoxyguanosinetriphosphate triphosphohydrolase |
| B624_0452 | 594537 | 596642 | + | DNA primase |
| B624_0453 | 596838 | 597710 | + | pyridoxine biosynthesis protein |
| B624_0454 | 597799 | 598434 | + | glutamine amidotransferase subunit PdxT |
| B624_0455 | 598495 | 600156 | + | aminotransferase, class I |
| B624_0456 | 600514 | 601443 | + | possible beta-aspartyl-peptidase |
| B624_0457 | 601574 | 601726 | − | hypothetical protein |
| B624_0458 | 601995 | 603179 | + | Di- and tricarboxylate transporters |
| B624_0459 | 603210 | 603467 | − | hypothetical protein |
| B624_0460 | 603651 | 605888 | − | similar to alpha-L-arabinofuranosidase A |
| B624_0461 | 605923 | 606921 | + | transcriptional regulator |
| B624_0462 | 607014 | 608219 | − | Hypothetical protein |
| B624_0463 | 608621 | 609373 | + | ABC transporter, ATP-binding protein |
| B624_0464 | 609373 | 610545 | + | S-layer domain |
| B624_0465 | 610560 | 612116 | + | ABC transporter, ATP-binding protein |
| B624_0466 | 612106 | 614232 | − | 1-deoxyxylulose-5-phosphate synthase |
| B624_0467 | 614478 | 615467 | + | oxidoreductase |
| B624_0468 | 615566 | 616069 | + | phosphoribosylaminoimidazole carboxylase, catalytic subunit |
| B624_0469 | 616095 | 617231 | + | phosphoribosylaminoimidazole carboxylase, ATPasesubunit |
| B624_0470 | 617243 | 617668 | + | furB |
| B624_0472 | 618183 | 619103 | + | possible solute binding protein of ABCtransporter system |
| B624_0473 | 619367 | 621439 | + | Phosphoglycerol transferase |
| B624_0474 | 621563 | 623197 | + | Aldehyde dehydrogenase (NAD(P)(+)) |
| B624_0475 | 623577 | 624842 | − | phosphoribosylamine--glycine ligase |
| B624_0476 | 624872 | 625906 | − | phosphoribosylformylglycinamidine cyclo-ligase |
| B624_0477 | 626029 | 627537 | − | amidophosphoribosyltransferase |
| B624_0478 | 627944 | 628726 | − | glutamine ABC transporter, ATP-binding protein |
| B624_0479 | 628726 | 629610 | − | amino acid ABC transporter, permease protein |
| B624_0480 | 629723 | 630583 | − | amino acid ABC transporter, periplasmic aminoacid-binding protein |
| B624_0481 | 630788 | 631255 | − | hypothetical protein |
| B624_0482 | 631328 | 632698 | − | Atz/Trz family protein |
| B624_0483 | 632741 | 634222 | − | S-adenosyl-L-homocysteine hydrolase, NAD bindingdomain |
| B624_0484 | 634405 | 635991 | + | structural gene for ultraviolet resistance |
| B624_0485 | 635991 | 636206 | + | hypothetical protein |
| B624_0486 | 636246 | 637220 | − | K channel, beta subunit |
| B624_0487 | 637331 | 638293 | − | transcriptional regulator, HTH_1 family |
| B624_0488 | 638512 | 640023 | + | Na/H antiporter |
| B624_0489 | 640043 | 640699 | − | hypothetical protein |
| B624_0490 | 640699 | 642066 | − | hypothetical protein |
| B624_0491 | 642042 | 643337 | − | hypothetical protein |
| B624_0492 | 643478 | 647209 | − | phosphoribosylformylglycinamidine synthase |
| B624_0493 | 647275 | 648024 | − | phosphoribosylaminoimidazole-succinocarboxamidesynthase |
| B624_0494 | 648420 | 649754 | − | phosphoribosylglycinamide formyltransferase |
| B624_0495 | 649928 | 651085 | + | type 1 capsular polysaccharide biosynthesisprotein J (capJ) |
| B624_0496 | 651238 | 652260 | − | hypothetical protein |
| B624_0497 | 652822 | 653880 | + | transporter protein |
| B624_0498 | 654599 | 654967 | + | ribosomal protein S12 |
| B624_0499 | 654976 | 655443 | + | ribosomal protein S7 |
| B624_0500 | 655478 | 657598 | + | translation elongation factor G |
| B624_0501 | 657774 | 658970 | + | translation elongation factor Tu |
| B624_0502 | 659184 | 659909 | + | hypothetical protein |
| B624_0503 | 660049 | 660864 | + | transcriptional regulator, LysR family |

TABLE 1-continued

Open reading frames of the genome of 35624.

| Gene ID | Start | End | Strand | Predicted Function |
|---|---|---|---|---|
| B624_0504 | 661037 | 662098 | + | membrane protein |
| B624_0505 | 662161 | 662643 | − | Membrane protein |
| B624_0506 | 662721 | 663086 | − | CrcB protein |
| B624_0507 | 663086 | 663619 | − | protein with similarity to CrcB |
| B624_0508 | 663631 | 663987 | + | hypothetical protein |
| B624_0509 | 664023 | 665063 | + | alcohol dehydrogenase, zinc-containing |
| B624_0510 | 665416 | 665625 | + | hypothetical protein |
| B624_0511 | 665652 | 667028 | − | Hypothetical protein |
| B624_0512 | 667295 | 667462 | − | hypothetical protein |
| B624_0513 | 667902 | 670487 | + | excinuclease ABC, subunit A |
| B624_0514 | 670548 | 671903 | + | MATE efflux family protein |
| B624_0515 | 671914 | 672603 | + | endonuclease III |
| B624_0516 | 672783 | 673076 | − | hypothetical protein |
| B624_0517 | 673095 | 673766 | + | galactoside O-acetyltransferase |
| B624_0519 | 674207 | 675292 | + | possible integral membrane permease protein |
| B624_0520 | 675318 | 675902 | + | Beta-glucuronidase |
| B624_0521 | 676090 | 677523 | − | glutamine synthetase, type I |
| B624_0522 | 677846 | 678625 | + | hypothetical protein |
| B624_0523 | 678712 | 680199 | − | dihydrolipoamide dehydrogenase |
| B624_0524 | 680351 | 680971 | − | integral membrane protein |
| B624_0525 | 681063 | 682427 | + | widely conserved protein in peptidase ordeacetlylase family |
| B624_0526 | 682730 | 683326 | + | ABC superfamily ATP binding cassette transporter, membrane protein |
| B624_0527 | 683329 | 684801 | + | ABC transporter, ATP-binding protein |
| B624_0528 | 684801 | 685625 | + | possible permease protein of ABC transporter forcobalt |
| B624_0529 | 685824 | 686699 | + | spoU rRNA methylase family protein [imported] |
| B624_0530 | 686756 | 687820 | + | phenylalanyl-tRNA synthetase, alpha subunit |
| B624_0531 | 687831 | 690437 | + | phenylalanyl-tRNA synthetase, beta subunit |
| B624_0532 | 690471 | 691154 | + | hypothetical protein |
| B624_0533 | 691256 | 692347 | + | N-acetyl-gamma-glutamyl-phosphate reductase |
| B624_0534 | 692347 | 693519 | + | ornithine acetyltransferase/N-acetylglutamate synthase protein |
| B624_0535 | 693659 | 694612 | + | acetylglutamate kinase |
| B624_0536 | 694605 | 695897 | + | acetylornithine aminotransferase |
| B624_0537 | 695944 | 696906 | + | ornithine carbamoyltransferase |
| B624_0538 | 696906 | 697415 | + | arginine repressor |
| B624_0539 | 697501 | 698736 | + | argininosuccinate synthase |
| B624_0540 | 699184 | 700653 | + | argininosuccinate lyase |
| B624_0541 | 701005 | 701196 | + | Sulfur transfer protein involved in thiamine biosynthesis |
| B624_0542 | 701211 | 702077 | + | thiG protein |
| B624_0543 | 702157 | 702963 | + | moeB |
| B624_0544 | 703023 | 703376 | + | rhodanese-like domain protein |
| B624_0545 | 703550 | 704071 | + | HD domain protein |
| B624_0546 | 704071 | 704835 | + | hypothetical protein |
| B624_0547 | 704964 | 706283 | + | tyrosyl-tRNA synthetase |
| B624_0548 | 706314 | 708086 | + | hypothetical protein |
| B624_0549 | 708098 | 709135 | + | Sugar phosphatases of the HADsuperfamily |
| B624_0550 | 709395 | 710165 | + | hemolysin A |
| B624_0551 | 710153 | 710824 | − | hypothetical protein |
| B624_0552 | 710965 | 711624 | − | similar to a bacterial K( )-uptake system |
| B624_0553 | 711678 | 713141 | − | Cation transport protein domain protein |
| B624_0554 | 713388 | 714407 | + | poly(P)/ATP-NAD kinase |
| B624_0555 | 714410 | 716233 | + | DNA repair protein RecN |
| B624_0556 | 716266 | 716910 | + | hydrolase, haloacid dehalogenase-like family |
| B624_0557 | 717154 | 717525 | + | transcriptional regulator, GntR family |
| B624_0558 | 717544 | 718467 | + | ABC transporter, ATP-binding protein |
| B624_0559 | 718477 | 719091 | + | hypothetical protein |
| B624_0560 | 719187 | 719903 | + | hypothetical protein |
| B624_0561 | 719985 | 722768 | − | calcium-translocating P-type ATPase, PMCA-type |
| B624_0562 | 722966 | 723238 | + | hypothetical protein |
| B624_0563 | 723291 | 724778 | − | threonine synthase |
| B624_0564 | 725001 | 725699 | + | serine hydroxymethyltransferase |
| B624_0565 | 725707 | 727116 | + | gamma-glutamyl phosphate reductase |
| B624_0566 | 727116 | 727694 | + | phosphoribosylformylglycinamidine (FGAM) synthase, synthetase domain protein |
| B624_0567 | 727694 | 728476 | + | nicotinate (nicotinamide) nucleotideadenylyltransferase |
| B624_0568 | 728580 | 729779 | − | possible B-hexosaminidase |
| B624_0569 | 729952 | 733203 | + | hypothetical protein |
| B624_0570 | 733340 | 733834 | + | phosphinothricin acetyltransferase |
| B624_0571 | 734033 | 734629 | + | peptidyl-tRNA hydrolase |
| B624_0572 | 734622 | 738203 | + | transcription-repair coupling factor |
| B624_0573 | 738346 | 739290 | + | oxidoreductase |
| B624_0574 | 739444 | 740739 | + | phosphopyruvate hydratase |
| B624_0575 | 740833 | 741423 | + | hypothetical protein |
| B624_0576 | 741423 | 741986 | + | hypothetical protein |

TABLE 1-continued

Open reading frames of the genome of 35624.

| Gene ID | Start | End | Strand | Predicted Function |
|---|---|---|---|---|
| B624_0577 | 742052 | 743050 | + | Ppx/GppA phosphatase |
| B624_0578 | 743410 | 744711 | + | IS30 family, transposase [imported] |
| B624_0580 | 745605 | 747062 | + | L-serine dehydratase 1 |
| B624_0581 | 747207 | 747611 | + | peptidyl-prolyl cis-trans isomerase, FKBP-type |
| B624_0582 | 747713 | 748189 | + | transcription elongation factor GreA |
| B624_0583 | 748250 | 749191 | − | hemolysin |
| B624_0584 | 749316 | 750086 | + | hypothetical protein |
| B624_0585 | 750252 | 751736 | + | histidine kinase-like protein |
| B624_0586 | 751815 | 752090 | − | hypothetical protein |
| B624_0587 | 752207 | 754030 | − | FtsK cell division protein |
| B624_0588 | 754203 | 755633 | − | Cell envelope-related function transcriptional attenuator common domain protein |
| B624_0589 | 755815 | 756180 | + | whiB1 |
| B624_0590 | 756227 | 759319 | + | membrane protein |
| B624_0591 | 759319 | 760857 | + | Large exoproteins involved in heme utilization or adhesion |
| B624_0592 | 760966 | 761391 | − | hypothetical protein |
| B624_0593 | 761480 | 762283 | + | Hypothetical protein |
| B624_0594 | 762332 | 763015 | + | Phosphoribosyl transferase domain protein |
| B624_0595 | 762937 | 763320 | − | hypothetical protein |
| B624_0596 | 763391 | 764464 | − | sensory box histidine kinase |
| B624_0597 | 764464 | 765183 | − | DNA-binding response regulator MtrA |
| B624_0598 | 765222 | 767471 | − | 1,4-alpha-glucan branching enzyme |
| B624_0599 | 767649 | 768239 | + | possible transcriptional regulator |
| B624_0600 | 768351 | 768872 | + | 2C-methyl-D-erythritol 2,4-cyclodiphosphatesynthase |
| B624_0601 | 768930 | 769760 | + | zinc ABC transporter, permease protein |
| B624_0602 | 769830 | 770717 | − | ABC transporter, ATP-binding protein |
| B624_0603 | 770893 | 772086 | − | possible solute binding protein of ABCtransporter system |
| B624_0604 | 772190 | 773062 | + | methylenetetrahydrofolate dehydrogenase/cyclohydrolase |
| B624_0605 | 773185 | 774657 | + | 30S ribosomal protein S1 |
| B624_0606 | 774834 | 775448 | + | dephospho-CoA kinase |
| B624_0607 | 775463 | 777571 | + | excinuclease ABC, B subunit |
| B624_0608 | 777743 | 778726 | + | TerC family protein |
| B624_0609 | 778897 | 780336 | + | pyruvate kinase |
| B624_0610 | 780490 | 781086 | − | possible NTP pyrophosphatase in MutT family |
| B624_0611 | 781432 | 782214 | + | response regulator |
| B624_0612 | 782278 | 785127 | + | DNA polymerase I |
| B624_0613 | 785300 | 786217 | + | hypothetical protein |
| B624_0614 | 786266 | 786937 | + | MutT/nudix family protein |
| B624_0615 | 786994 | 789132 | + | glycogen operon protein GlgX |
| B624_0616 | 789186 | 789413 | + | hypothetical protein |
| B624_0617 | 789420 | 790067 | + | hypothetical protein |
| B624_0618 | 790243 | 790794 | − | DNA-3-methyladenine glycosylase I |
| B624_0619 | 791884 | 792942 | − | hypothetical protein |
| B624_0620 | 793226 | 793780 | + | hypothetical protein |
| B624_0624 | 794937 | 795989 | − | integrase/recombinase XerC, probable [imported] |
| B624_0625 | 795989 | 796951 | − | probable integrase/recombinase |
| B624_0626 | 796951 | 798273 | − | integrase/recombinase |
| B624_0627 | 798284 | 799564 | − | IS3-Spn1, transposase |
| B624_0628 | 799635 | 800477 | − | Transposase subunit |
| B624_0629 | 800762 | 802579 | − | hypothetical Protein |
| B624_0630 | 803748 | 804065 | − | hypothetical protein |
| B624_0631 | 804667 | 808221 | + | DNA polymerase III, alpha chain |
| B624_0632 | 808297 | 808743 | + | hypothetical protein |
| B624_0633 | 808952 | 810826 | + | antigen, 67 kDa |
| B624_0634 | 810916 | 811413 | + | NH2-acetyltransferase |
| B624_0635 | 817553 | 818377 | − | 2,5-diketo-D-gluconic acid reductase A |
| B624_0636 | 818484 | 819956 | + | sugar kinase, FGGY family |
| B624_0637 | 819972 | 820262 | + | Acylphosphatase |
| B624_0638 | 820367 | 821761 | + | histidinol dehydrogenase |
| B624_0639 | 821761 | 822918 | + | histidinol-phosphate aminotransferase |
| B624_0640 | 823007 | 823603 | + | imidazoleglycerol-phosphate dehydratase |
| B624_0641 | 823606 | 824397 | + | hypothetical protein |
| B624_0642 | 824435 | 825079 | + | imidazole glycerol phosphate synthase, glutamineamidotransferase subunit |
| B624_0643 | 825152 | 825874 | + | HisA/TrpF protein |
| B624_0644 | 826039 | 827415 | − | hypothetical protein |
| B624_0645 | 827564 | 828898 | + | Glutamine synthetase, catalytic domain |
| B624_0646 | 829137 | 829604 | + | possible arabinose efflux permease |
| B624_0647 | 829657 | 830625 | − | hypothetical protein |
| B624_0648 | 830625 | 834758 | − | ATP-dependent helicase HrpA |
| B624_0649 | 834751 | 835404 | − | hypothetical protein |
| B624_0650 | 835563 | 837065 | + | GTP-binding protein |
| B624_0651 | 837249 | 838208 | + | L-lactate dehydrogenase |
| B624_0652 | 838356 | 839291 | − | cation efflux system protein |
| B624_0653 | 839460 | 840182 | − | LexA repressor |

TABLE 1-continued

Open reading frames of the genome of 35624.

| Gene ID | Start | End | Strand | Predicted Function |
|---|---|---|---|---|
| B624_0654 | 840333 | 840680 | + | LysM domain protein |
| B624_0655 | 840736 | 841173 | + | transcriptional regulator NrdR |
| B624_0656 | 841314 | 842510 | − | D-3-phosphoglycerate dehydrogenase |
| B624_0657 | 842524 | 844800 | − | Superfamily I DNA and RNA helicases |
| B624_0658 | 845133 | 845651 | + | hypothetical protein |
| B624_0659 | 845654 | 846730 | + | S-adenosyl-methyltransferase MraW |
| B624_0660 | 846740 | 847186 | + | hypothetical protein |
| B624_0661 | 847186 | 848985 | + | penicillin-binding protein |
| B624_0662 | 849015 | 849884 | + | hypothetical protein |
| B624_0663 | 849936 | 851384 | + | UDP-N-acetylmuramoylalanyl-D-glutamyl-2,6-diaminopimelate--D-alanyl-D-alanylligase |
| B624_0664 | 851432 | 852535 | + | rfe1 |
| B624_0665 | 852593 | 854035 | + | UDP-N-acetylmuramoylalanine--D-glutamate ligase |
| B624_0666 | 854025 | 855239 | + | cell division protein, FtsW/RodA/SpoVE family |
| B624_0667 | 855258 | 856436 | + | UDP-N-acetylglucosamine--N-acetylmuramyl-(pentapeptide)pyrophosphoryl-undecaprenol N-acetylglucosaminetransferase |
| B624_0668 | 856540 | 858075 | + | UDP-N-acetylmuramate--alanine ligase |
| B624_0669 | 858078 | 859139 | + | Cell division septal protein |
| B624_0670 | 859883 | 860983 | + | hypothetical protein |
| B624_0671 | 861130 | 861813 | + | von Willebrand factor |
| B624_0672 | 861906 | 862391 | + | D-tyrosyl-tRNA(Tyr) deacylase |
| B624_0673 | 862494 | 863735 | − | glucose/galactose transporter |
| B624_0674 | 863844 | 864230 | − | Lactoylglutathione lyase and related lyases |
| B624_0675 | 864308 | 865201 | − | fructokinase |
| B624_0676 | 865277 | 866488 | − | transcription regulator ROK family |
| B624_0677 | 866715 | 867626 | + | glucokinase |
| B624_0678 | 867792 | 868913 | − | NagC/XylR-type transcriptional regulator |
| B624_0679 | 869251 | 870060 | + | glucosamine-6-phosphate isomerase |
| B624_0680 | 870119 | 871393 | + | N-acetylglucosamine-6-phosphate deacetylase |
| B624_0681 | 871676 | 873307 | + | dipeptide ABC transporter, dipeptide-bindingprotein |
| B624_0682 | 873480 | 874568 | + | oligopeptide ABC transporter, permease protein |
| B624_0683 | 874573 | 875739 | + | dipeptide ABC transporter, permease protein |
| B624_0684 | 875746 | 877452 | + | ATP binding protein of ABC transporter |
| B624_0685 | 877508 | 878026 | − | MutT/nudix family protein |
| B624_0686 | 878078 | 879670 | − | Xaa-Pro aminopeptidase I |
| B624_0687 | 879977 | 880954 | − | hypothetical protein |
| B624_0689 | 882044 | 883672 | + | folC |
| B624_0690 | 883736 | 887410 | + | SMC family, C-terminal domain family |
| B624_0691 | 887535 | 888527 | − | hypothetical protein |
| B624_0692 | 888652 | 890202 | − | mure1 |
| B624_0693 | 890341 | 891126 | + | RNA polymerase sigma-70 factor, ECF subfamily |
| B624_0694 | 891129 | 891446 | + | hypothetical protein |
| B624_0695 | 891719 | 892660 | − | Aldose 1-epimerase superfamily |
| B624_0696 | 892788 | 893741 | − | Aldose 1-epimerase superfamily |
| B624_0697 | 894032 | 895021 | + | hydroxymethylbutenyl pyrophosphate reductase |
| B624_0698 | 895067 | 895573 | − | transcriptional regulator |
| B624_0699 | 895670 | 896725 | − | glyceraldehyde-3-phosphate dehydrogenase, typeI |
| B624_0700 | 896968 | 897690 | − | Thiamin pyrophosphokinase, catalytic domainfamily |
| B624_0702 | 899298 | 899930 | + | Translation initiation factor IF-3, C-terminaldomain |
| B624_0703 | 899923 | 900105 | + | ribosomal protein L35 |
| B624_0704 | 900161 | 900541 | + | ribosomal protein L20 |
| B624_0705 | 900614 | 901537 | + | Integrase |
| B624_0706 | 901668 | 904511 | + | ABC transporter, ATP-binding protein |
| B624_0707 | 904776 | 905612 | + | Soj family protein |
| B624_0708 | 905634 | 906545 | + | chromosome segregation and condensation protein ScpA |
| B624_0709 | 906561 | 907274 | + | Transcriptional regulator |
| B624_0710 | 907409 | 908233 | + | MutT/nudix family protein |
| B624_0711 | 908296 | 909573 | + | quinolinate synthetase complex, A subunit |
| B624_0712 | 909668 | 911296 | + | L-aspartate oxidase |
| B624_0713 | 911303 | 912193 | + | nicotinate-nucleotide pyrophosphorylase |
| B624_0714 | 912199 | 913443 | + | possible pyridoxal-phosphate-dependentaminotransferase |
| B624_0715 | 913478 | 914824 | + | major facilitator family transporter |
| B624_0716 | 915142 | 917070 | + | GTP-binding elongation factor TypA/BipA |
| B624_0717 | 917173 | 917616 | + | Alcohol dehydrogenase, class IV |
| B624_0718 | 917699 | 918673 | + | prephenate dehydratase |
| B624_0719 | 918670 | 919734 | + | prephenate dehydrogenase |
| B624_0720 | 919947 | 920201 | + | hypothetical protein |
| B624_0721 | 920239 | 921303 | + | phage integrase family protein |
| B624_0722 | 921559 | 923196 | + | DppA2 |
| B624_0723 | 923500 | 924423 | + | ABC-type dipeptide/oligopeptide/nickel transport systems, permease components |
| B624_0724 | 924445 | 925446 | + | dppC |
| B624_0725 | 925472 | 927478 | + | ABC-type transporter, duplicated ATPasecomponent |
| B624_0726 | 927793 | 928650 | − | exodeoxyribonuclease III |
| B624_0727 | 928775 | 929626 | + | hypothetical protein |

TABLE 1-continued

Open reading frames of the genome of 35624.

| Gene ID | Start | End | Strand | Predicted Function |
|---|---|---|---|---|
| B624_0728 | 929645 | 930400 | + | ABC-type Mn2+/Zn2+ transport systems, permease components |
| B624_0729 | 930390 | 931658 | + | RNA methyltransferase, TrmA family |
| B624_0730 | 931673 | 932365 | + | lipoprotein |
| B624_0731 | 932483 | 935032 | + | ATPase, P-type (transporting), HAD superfamily, subfamily IC |
| B624_0732 | 935156 | 937852 | + | aconitate hydratase 1 |
| B624_0733 | 938001 | 938360 | + | DNA-damage-inducible protein J |
| B624_0734 | 938363 | 938851 | + | hypothetical protein |
| B624_0735 | 938917 | 941019 | − | Uncharacterized protein |
| B624_0736 | 941112 | 941750 | − | hypothetical protein |
| B624_0737 | 941793 | 942548 | − | DNA-binding response regulator |
| B624_0738 | 942553 | 943812 | − | histidine kinase sensor |
| B624_0739 | 944117 | 944959 | + | hypothetical protein |
| B624_0740 | 945143 | 946039 | + | membrane protein |
| B624_0741 | 946182 | 947195 | + | integral membrane protein with duf6 |
| B624_0742 | 947234 | 947962 | − | GTP pyrophosphokinase |
| B624_0743 | 948103 | 949554 | + | tRNA-i(6)A37 thiotransferase enzyme MiaB |
| B624_0744 | 949568 | 950551 | + | tRNA delta(2)-isopentenylpyrophosphatetransferase |
| B624_0745 | 950591 | 951337 | − | Fic protein family family |
| B624_0746 | 951549 | 954437 | + | cell division protein FtsK |
| B624_0747 | 954620 | 955267 | + | CDP-diacylglycerol--glycerol-3-phosphate3-phosphatidyltransferase |
| B624_0748 | 955282 | 955812 | + | competence/damage-inducible protein CinA domainprotein |
| B624_0749 | 955875 | 956387 | + | Transcriptional regulators |
| B624_0750 | 956502 | 956732 | + | hypothetical protein |
| B624_0751 | 957036 | 958226 | + | recA protein |
| B624_0752 | 958232 | 958822 | + | regulatory protein RecX |
| B624_0753 | 959005 | 959544 | + | hypothetical protein |
| B624_0754 | 959702 | 960361 | + | S30AE family protein |
| B624_0755 | 960526 | 963417 | + | preprotein translocase, SecA subunit |
| B624_0758 | 964674 | 965717 | + | anthranilate phosphoribosyltransferase |
| B624_0759 | 965964 | 966656 | − | hypothetical protein |
| B624_0760 | 966717 | 967418 | + | phospholipid/glycerol acyltransferase |
| B624_0761 | 967476 | 969746 | − | serine/threonine protein kinase |
| B624_0762 | 969893 | 970972 | − | probable bifunctional short chain isoprenyl diphosphate synthase |
| B624_0763 | 971179 | 971838 | + | hypothetical protein |
| B624_0764 | 972044 | 973465 | + | RNA polymerase principal sigma factor; sigma 70 |
| B624_0765 | 973526 | 975799 | + | DNA gyrase, subunit B |
| B624_0766 | 975969 | 977192 | + | MFS family major facilitator transporter |
| B624_0767 | 977239 | 978228 | + | ribokinase |
| B624_0768 | 978247 | 982977 | + | DEAD/DEAH box helicase domain protein |
| B624_0769 | 982994 | 983779 | − | hypothetical protein |
| B624_0770 | 983927 | 986653 | − | DNA gyrase A subunit |
| B624_0771 | 986904 | 988169 | + | hypothetical protein |
| B624_0772 | 988185 | 989273 | − | hypothetical protein |
| B624_0773 | 989432 | 989722 | + | hypothetical protein |
| B624_0774 | 989725 | 990198 | + | deoxyuridine 5triphosphate nucleotidohydrolase |
| B624_0775 | 990335 | 992656 | + | GTP pyrophosphokinase |
| B624_0777 | 993226 | 994425 | + | Site-specific recombinase XerD |
| B624_0778 | 994425 | 995387 | + | probable integrase/recombinase |
| B624_0779 | 995387 | 996439 | + | integrase/recombinase XerC, probable |
| B624_0780 | 996532 | 997095 | − | integrase catalytic subunit |
| B624_0781 | 997107 | 997619 | − | hypothetical protein |
| B624_0782 | 997719 | 998255 | − | peptidyl-prolyl cis-trans isomerase |
| B624_0783 | 998331 | 999296 | − | Uncharacterized protein |
| B624_0784 | 999519 | 999623 | − | hypothetical protein |
| B624_0785 | 999683 | 1000615 | − | membrane protein |
| B624_0786 | 1000894 | 1001295 | + | Hypothetical protein |
| B624_0787 | 1001329 | 1002621 | − | SAM-dependent methyltransferases |
| B624_0788 | 1002690 | 1003532 | + | possible phosphoglycerate mutase |
| B624_0789 | 1003650 | 1004597 | + | magnesium transporter, CorA family |
| B624_0790 | 1004615 | 1005538 | + | solute binding protein of ABC transporter system |
| B624_0791 | 1005584 | 1008544 | + | leucyl-tRNA synthetase |
| B624_0792 | 1008708 | 1009484 | + | competence protein ComEA helix-hairpin-helixrepeat region domain protein |
| B624_0793 | 1009484 | 1011235 | + | membrane protein |
| B624_0794 | 1011378 | 1012721 | + | prolidase (X-Pro dipeptidase) or chlorohydrolase |
| B624_0795 | 1012791 | 1013759 | + | DNA polymerase III, delta subunit |
| B624_0796 | 1013783 | 1014346 | + | Hypothetical protein |
| B624_0797 | 1014411 | 1015289 | + | Metal-dependent proteases, molecular chaperone |
| B624_0798 | 1015308 | 1015859 | + | ribosomal-protein-alanine acetyltransferase |
| B624_0799 | 1015859 | 1016899 | + | O-sialoglycoprotein endopeptidase |
| B624_0800 | 1017569 | 1018501 | + | probable integrase/recombinse |

TABLE 1-continued

Open reading frames of the genome of 35624.

| Gene ID | Start | End | Strand | Predicted Function |
|---|---|---|---|---|
| B624_0801 | 1018564 | 1018887 | − | hypothetical protein |
| B624_0802 | 1018909 | 1019862 | − | hypothetical protein |
| B624_0803 | 1019849 | 1020439 | − | hypothetical protein |
| B624_0804 | 1020474 | 1021376 | − | Fic protein family family |
| B624_0805 | 1021357 | 1021929 | − | hypothetical protein |
| B624_0806 | 1021949 | 1023763 | − | hypothetical protein |
| B624_0807 | 1023782 | 1024864 | − | hypothetical protein |
| B624_0808 | 1024893 | 1025600 | − | hypothetical protein |
| B624_0809 | 1025761 | 1026843 | − | TraG-related protein |
| B624_0810 | 1026843 | 1027799 | − | hypothetical protein |
| B624_0811 | 1027799 | 1028257 | − | hypothetical protein |
| B624_0812 | 1028379 | 1028669 | + | hypothetical protein |
| B624_0813 | 1028786 | 1030942 | + | Topoisomerase IA |
| B624_0814 | 1031020 | 1031448 | + | hypothetical protein |
| B624_0815 | 1031753 | 1032193 | + | Bacterial mobilisation protein (MobC) |
| B624_0817 | 1032621 | 1033400 | − | Fic protein family family |
| B624_0818 | 1033518 | 1034822 | + | relaxase/mobilization nuclease family protein |
| B624_0819 | 1034848 | 1036128 | − | hipA transcription regulator protein |
| B624_0820 | 1036128 | 1036439 | − | hypothetical protein |
| B624_0821 | 1036545 | 1037675 | − | hypothetical protein |
| B624_0822 | 1038015 | 1038551 | − | hypothetical protein |
| B624_0823 | 1038618 | 1040423 | − | conjugative transfer gene complex protein |
| B624_0824 | 1040507 | 1041145 | − | hypothetical protein |
| B624_0825 | 1041250 | 1042281 | − | hypothetical protein |
| B624_0826 | 1042389 | 1042865 | − | hypothetical protein |
| B624_0827 | 1043244 | 1044839 | − | ATP binding protein-like protein |
| B624_0828 | 1044857 | 1046341 | − | hypothetical protein |
| B624_0829 | 1046369 | 1048357 | − | hypothetical protein |
| B624_0830 | 1048370 | 1048669 | − | hypothetical protein |
| B624_0831 | 1048710 | 1049189 | − | hypothetical protein |
| B624_0832 | 1049206 | 1050405 | − | hypothetical protein |
| B624_0833 | 1050435 | 1051070 | − | hypothetical protein |
| B624_0834 | 1051396 | 1056213 | − | hypothetical protein |
| B624_0835 | 1056508 | 1057458 | − | hypothetical protein |
| B624_0836 | 1057844 | 1058440 | − | ATPases involved inchromosome partitioning |
| B624_0837 | 1058539 | 1059152 | − | hypothetical protein |
| B624_0838 | 1059167 | 1059448 | − | ATPases involved inchromosome partitioning |
| B624_0839 | 1059569 | 1060042 | − | possible WhiB-like transcription factor |
| B624_0840 | 1060036 | 1061400 | − | hypothetical protein |
| B624_0841 | 1061400 | 1061597 | − | hypothetical protein |
| B624_0842 | 1061748 | 1061894 | − | hypothetical protein |
| B624_0843 | 1061958 | 1062263 | − | hypothetical protein |
| B624_0844 | 1062260 | 1062601 | − | hypothetical protein |
| B624_0845 | 1062779 | 1062997 | − | hypothetical protein |
| B624_0846 | 1063127 | 1063546 | + | hypothetical protein |
| B624_0847 | 1064092 | 1064778 | + | peptidase M23B |
| B624_0848 | 1064862 | 1066490 | − | hypothetical protein |
| B624_0849 | 1066742 | 1067959 | − | isocitrate dehydrogenase, NADP-dependent |
| B624_0850 | 1068087 | 1069208 | + | IMP dehydrogenase family protein |
| B624_0851 | 1069373 | 1069861 | + | hypothetical protein |
| B624_0852 | 1069955 | 1072039 | + | long-chain-fatty-acid--CoA ligase |
| B624_0853 | 1072049 | 1072534 | + | polypeptide deformylase |
| B624_0854 | 1072894 | 1073736 | + | ribosomal protein S2 |
| B624_0855 | 1073818 | 1074666 | + | translation elongation factor Ts |
| B624_0856 | 1074843 | 1075580 | + | uridylate kinase |
| B624_0857 | 1075660 | 1076208 | + | ribosome recycling factor |
| B624_0858 | 1076234 | 1077217 | + | phosphatidate cytidylyltransferase |
| B624_0859 | 1077431 | 1078597 | + | 23S rRNA m(2)A-2503 methyltransferase |
| B624_0860 | 1078604 | 1079149 | − | thiJ |
| B624_0861 | 1079324 | 1080091 | + | Imidazole glycerol phosphate synthase subunit hisF |
| B624_0862 | 1080228 | 1080620 | + | phosphoribosyl-AMP cyclohydrolase |
| B624_0863 | 1080704 | 1082257 | + | anthranilate synthase component I |
| B624_0864 | 1082328 | 1082564 | − | hypothetical protein |
| B624_0865 | 1082576 | 1084174 | + | ATP binding protein of ABC transporter |
| B624_0866 | 1084221 | 1084925 | + | oxidoreductase, short-chainhydrogenase/reductase family |
| B624_0867 | 1084999 | 1085364 | + | protein with unknownfunction |
| B624_0868 | 1085423 | 1086091 | − | hypothetical protein |
| B624_0869 | 1086091 | 1087701 | + | ATP binding protein of ABC transporter |
| B624_0870 | 1087704 | 1088402 | + | cobalt ABC transporter permease |
| B624_0871 | 1088405 | 1089049 | − | Permeases of the major facilitator superfamily |
| B624_0872 | 1089249 | 1090877 | + | hypothetical protein |
| B624_0873 | 1090877 | 1091548 | + | hypothetical protein |
| B624_0874 | 1091548 | 1095093 | + | hypothetical protein |
| B624_0875 | 1095161 | 1096351 | + | hypothetical protein |
| B624_0876 | 1096521 | 1097084 | + | hypothetical protein |

TABLE 1-continued

Open reading frames of the genome of 35624.

| Gene ID | Start | End | Strand | Predicted Function |
|---|---|---|---|---|
| B624_0877 | 1097352 | 1100384 | + | excinuclease ABC, A subunit |
| B624_0878 | 1100532 | 1102895 | + | excinuclease ABC, C subunit |
| B624_0879 | 1103007 | 1103975 | + | aroE |
| B624_0880 | 1103978 | 1104961 | + | P-loop-containing kinase |
| B624_0881 | 1105163 | 1106110 | + | Uncharacterized protein |
| B624_0882 | 1106282 | 1107484 | + | phosphoglycerate kinase |
| B624_0883 | 1107546 | 1108346 | + | triosephosphate isomerase |
| B624_0884 | 1108413 | 1108658 | + | preprotein translocase, SecG subunit |
| B624_0885 | 1108763 | 1109710 | + | L-2-hydroxyisocaproate/malate/lactate dehydrogenase-like protein |
| B624_0886 | 1109710 | 1110558 | + | hypothetical protein |
| B624_0887 | 1110672 | 1112225 | + | aminotransferase, class I |
| B624_0888 | 1112360 | 1113466 | − | hypothetical protein |
| B624_0889 | 1113642 | 1114976 | − | branched-chain amino acid transport system II carrier protein |
| B624_0890 | 1115108 | 1116208 | − | transaldolase |
| B624_0891 | 1116332 | 1118437 | − | transketolase |
| B624_0892 | 1118812 | 1119927 | + | heat-inducible transcription repressor HrcA |
| B624_0893 | 1119986 | 1121128 | + | dnaJ protein |
| B624_0894 | 1121180 | 1121968 | − | fructosamine kinase |
| B624_0895 | 1122113 | 1122994 | + | Undecaprenyl-diphosphatase |
| B624_0896 | 1123157 | 1123987 | − | hypothetical protein |
| B624_0897 | 1124807 | 1126837 | + | threonyl-tRNA synthetase |
| B624_0898 | 1126980 | 1127561 | + | Diadenosine tetraphosphate (Ap4A) hydrolase and other HIT family hydrolase |
| B624_0899 | 1127703 | 1128455 | + | hypothetical protein |
| B624_0900 | 1128464 | 1129045 | + | crossover junction endodeoxyribonuclease RuvC |
| B624_0901 | 1129106 | 1129729 | + | Holliday junction DNA helicase RuvA |
| B624_0902 | 1129732 | 1130793 | + | Holliday junction DNA helicase RuvB |
| B624_0903 | 1130861 | 1131292 | + | preprotein translocase, YajC subunit |
| B624_0904 | 1131359 | 1131937 | + | adenine phosphoribosyltransferase |
| B624_0905 | 1132037 | 1133236 | + | succinyl-CoA synthetase, beta subunit |
| B624_0906 | 1133239 | 1134147 | + | succinyl-CoA synthase, alpha subunit |
| B624_0907 | 1134170 | 1135546 | + | membrane protein |
| B624_0908 | 1135581 | 1137131 | + | purine biosynthesis protein purH (Includes: Phosphoribosylaminoimidazolecarboxamide formyltransferase and IMP cyclohydrolase) |
| B624_0909 | 1137484 | 1138449 | − | Glycerol uptake facilitator and related permeases |
| B624_0910 | 1138645 | 1139412 | + | ribosomal large subunit pseudouridine synthase B |
| B624_0911 | 1139412 | 1141538 | + | cytidylate kinase/GTP-binding protein |
| B624_0912 | 1141896 | 1143422 | + | UDP-glucose pyrophosphorylase |
| B624_0913 | 1143565 | 1145475 | + | Hypothetical protein |
| B624_0914 | 1145489 | 1145803 | + | hypothetical protein |
| B624_0915 | 1145819 | 1148407 | + | Superfamily II RNA helicase |
| B624_0916 | 1148524 | 1148868 | + | hypothetical protein |
| B624_0917 | 1149001 | 1149717 | + | haloacid dehalogenase domain-containing protein hydrolase |
| B624_0918 | 1149744 | 1149995 | + | hypothetical protein |
| B624_0919 | 1150135 | 1150539 | − | hypothetical protein |
| B624_0920 | 1150673 | 1151302 | − | MerR type transcriptional regulator |
| B624_0921 | 1151406 | 1151846 | − | possible signal transduction protein |
| B624_0922 | 1151856 | 1152674 | − | hypothetical protein |
| B624_0923 | 1152693 | 1153022 | − | small basic protein |
| B624_0924 | 1153025 | 1153999 | − | hypothetical protein |
| B624_0925 | 1153992 | 1154606 | − | CDP-diacylglycerol--glycerol-3-phosphate 3-phosphatidyltransferase |
| B624_0926 | 1154623 | 1155471 | − | ATP phosphoribosyltransferase |
| B624_0927 | 1155486 | 1155746 | − | phosphoribosyl-ATP pyrophosphohydrolase |
| B624_0928 | 1155812 | 1156477 | − | ribulose-phosphate 3-epimerase |
| B624_0929 | 1156556 | 1157500 | − | prolipoprotein diacylglyceryl transferase |
| B624_0930 | 1157614 | 1158486 | − | tryptophan synthase, alpha subunit |
| B624_0931 | 1158507 | 1160591 | − | tryptophan synthase, beta subunit |
| B624_0932 | 1161120 | 1161968 | − | nfo |
| B624_0933 | 1163206 | 1164216 | − | hypothetical protein |
| B624_0934 | 1164570 | 1164860 | − | hypothetical protein |
| B624_0935 | 1165260 | 1165715 | − | hypothetical protein |
| B624_0936 | 1165903 | 1166406 | + | acetyltransferase |
| B624_0937 | 1166567 | 1166746 | + | hypothetical protein |
| B624_0938 | 1166793 | 1167323 | + | hypothetical protein |
| B624_0939 | 1167392 | 1167961 | − | acetyltransferase, GNAT family |
| B624_0940 | 1168315 | 1169001 | − | hypothetical protein |
| B624_0941 | 1169017 | 1169823 | − | hypothetical protein |
| B624_0942 | 1169832 | 1170527 | − | ABC transporter related protein |
| B624_0943 | 1170676 | 1171263 | + | Respose regulator |
| B624_0946 | 1172956 | 1173576 | − | hypothetical protein |
| B624_0947 | 1173576 | 1174301 | − | hypothetical protein |

TABLE 1-continued

Open reading frames of the genome of 35624.

| Gene ID | Start | End | Strand | Predicted Function |
|---|---|---|---|---|
| B624_0948 | 1174309 | 1174962 | − | ABC transporter related protein |
| B624_0949 | 1175271 | 1176518 | + | transposase |
| B624_0950 | 1176714 | 1177379 | − | two component transcriptional regulator, LuxR family |
| B624_0951 | 1177379 | 1178596 | − | histidine protein kinase |
| B624_0952 | 1178638 | 1179060 | − | hypothetical protein |
| B624_0953 | 1179039 | 1180061 | − | hypothetical protein |
| B624_0954 | 1180057 | 1180815 | − | macrolide export ATP-binding/permease protein MacB |
| B624_0955 | 1181154 | 1181684 | − | hypothetical protein |
| B624_0956 | 1182016 | 1182315 | + | hypothetical protein |
| B624_0957 | 1182321 | 1182662 | + | hypothetical protein |
| B624_0958 | 1182847 | 1183050 | − | hypothetical protein |
| B624_0962 | 1184840 | 1185853 | − | hypothetical protein |
| B624_0963 | 1186097 | 1186555 | − | hypothetical protein |
| B624_0964 | 1187212 | 1188783 | + | APC family amino acid-polyamine-organocation transporter |
| B624_0965 | 1188993 | 1189640 | − | signal peptidase I-2 |
| B624_0966 | 1189721 | 1190146 | − | hypothetical protein |
| B624_0967 | 1190467 | 1191420 | + | hypothetical protein |
| B624_0968 | 1191479 | 1191801 | + | hypothetical protein |
| B624_0969 | 1192540 | 1193727 | + | Aspartate transaminase |
| B624_0970 | 1193770 | 1195530 | + | YjeF family protein |
| B624_0971 | 1195635 | 1196261 | + | Hydrolase (HAD superfamily) |
| B624_0972 | 1196366 | 1197286 | + | transcriptional regulator, LysR family |
| B624_0973 | 1197447 | 1198565 | − | Hydrolases or acyltransferases (alpha/beta hydrolase superfamily) |
| B624_0974 | 1198783 | 1198932 | − | hypothetical protein |
| B624_0975 | 1199044 | 1199736 | − | orotate phosphoribosyltransferase |
| B624_0976 | 1199748 | 1200716 | − | dihydroorotate dehydrogenase |
| B624_0977 | 1200722 | 1201543 | − | dihydroorotate dehydrogenase, electron transfer subunit |
| B624_0978 | 1201682 | 1202632 | − | orotidine 5'-phosphate decarboxylase |
| B624_0979 | 1202653 | 1204146 | − | dihydroorotase |
| B624_0980 | 1204146 | 1204562 | − | Aspartate carbamoyltransferase regulatory chain |
| B624_0981 | 1204565 | 1205524 | − | aspartate carbamoyltransferase |
| B624_0982 | 1205669 | 1208896 | − | glutamate-ammonia ligase adenylyltransferasefamily |
| B624_0983 | 1208955 | 1209905 | − | Penicillin V acylase and related amidases |
| B624_0984 | 1210042 | 1210893 | − | 5,10-methylenetetrahydrofolate reductase |
| B624_0985 | 1210955 | 1213255 | − | 5-methyltetrahydropteroyltriglutamate--homocysteineS-methyltransferase |
| B624_0986 | 1213369 | 1213923 | − | phosphohistidine phosphatase SixA |
| B624_0987 | 1214024 | 1215091 | − | protein-L-isoaspartate methyltransferase |
| B624_0988 | 1215168 | 1215803 | + | phospholipase/carboxylesterase |
| B624_0989 | 1215850 | 1216806 | − | oxidoreductase, aldo/keto reductase 2 family |
| B624_0990 | 1217063 | 1217995 | + | esterase/lipase |
| B624_0991 | 1218234 | 1219178 | + | Alcohol dehydrogenase, zinc-binding dehydrogenase family |
| B624_0993 | 1220459 | 1221484 | + | transposase |
| B624_0994 | 1221484 | 1221948 | + | hypothetical protein |
| B624_0995 | 1221948 | 1222706 | + | hypothetical protein |
| B624_0996 | 1222896 | 1223972 | + | hypothetical protein |
| B624_0997 | 1224236 | 1224811 | + | hypothetical protein |
| B624_0999 | 1225221 | 1226144 | − | hypothetical protein |
| B624_1000 | 1226238 | 1227140 | − | hypothetical protein |
| B624_1001 | 1227158 | 1228765 | − | hypothetical protein |
| B624_1002 | 1229279 | 1230097 | − | ADP-ribosylglycohydrolase |
| B624_1003 | 1230187 | 1230412 | + | hypothetical protein |
| B624_1005 | 1232085 | 1232906 | + | hypothetical protein |
| B624_1006 | 1233000 | 1233548 | − | alkyl hydroperoxide reductase/Thiol specific antioxidant/Mal allergen |
| B624_1007 | 1233681 | 1234511 | − | carbon-nitrogen hydrolase |
| B624_1008 | 1234511 | 1235365 | − | hydrolase, haloacid dehalogenase-like family |
| B624_1009 | 1235520 | 1236365 | − | modF |
| B624_1010 | 1236462 | 1237709 | − | rfag1 |
| B624_1011 | 1237841 | 1238302 | − | hypothetical protein |
| B624_1012 | 1238382 | 1239917 | − | gltD |
| B624_1013 | 1239922 | 1244490 | − | glutamate synthase, large subunit |
| B624_1014 | 1244835 | 1245116 | + | hypothetical protein |
| B624_1015 | 1245175 | 1246197 | − | dihydrodipicolinate reductase-like protein |
| B624_1016 | 1246656 | 1246979 | + | hypothetical protein |
| B624_1017 | 1247042 | 1247227 | − | hypothetical protein |
| B624_1018 | 1247493 | 1248536 | − | ChaR3 protein |
| B624_1019 | 1249123 | 1250073 | + | hypothetical protein |
| B624_1020 | 1250541 | 1250888 | − | hypothetical protein |
| B624_1021 | 1251177 | 1252538 | + | norm1 |
| B624_1022 | 1252915 | 1254216 | + | integrase |
| B624_1023 | 1254323 | 1255450 | − | glycerate kinase |
| B624_1024 | 1255637 | 1256734 | + | transcriptional regulator, LacI family |

TABLE 1-continued

Open reading frames of the genome of 35624.

| Gene ID | Start | End | Strand | Predicted Function |
|---|---|---|---|---|
| B624_1025 | 1256820 | 1258226 | − | oxygen-independent coproporphyrinogen III oxidase |
| B624_1026 | 1258229 | 1260106 | − | GTP-binding protein LepA |
| B624_1027 | 1260253 | 1260510 | + | Ribosomal protein S20 |
| B624_1028 | 1260768 | 1261556 | − | hypothetical protein |
| B624_1029 | 1261807 | 1262703 | − | MazG family protein |
| B624_1030 | 1262903 | 1264027 | − | branched-chain amino acid aminotransferase |
| B624_1031 | 1264254 | 1264871 | − | ribosomal 5S rRNA E-loop binding proteinCtc/L25/TL5 |
| B624_1032 | 1265298 | 1266332 | + | hypothetical protein |
| B624_1033 | 1266474 | 1267895 | − | NAD(P) transhydrogenase subunit beta |
| B624_1034 | 1267898 | 1268200 | − | NAD/NADP transhydrogenase alpha subunit-like protein |
| B624_1035 | 1268219 | 1269379 | − | NAD(P) transhydrogenase subunit alpha part 1 |
| B624_1036 | 1269798 | 1271828 | + | long-chain-fatty-acid--CoA ligase |
| B624_1037 | 1271887 | 1272948 | − | GTP-binding protein Era |
| B624_1038 | 1272953 | 1274383 | − | CBS domain protein |
| B624_1039 | 1274462 | 1275007 | − | metal-dependent hydrolase |
| B624_1040 | 1275000 | 1276172 | − | PhoH family protein |
| B624_1041 | 1276194 | 1276529 | − | Hit family protein |
| B624_1042 | 1276581 | 1277375 | − | Uncharacterized protein in bacteria |
| B624_1043 | 1277619 | 1278494 | + | rRNA methylases |
| B624_1044 | 1278698 | 1279939 | + | glucose-1-phosphate adenylyltransferase |
| B624_1045 | 1280035 | 1280625 | − | mrp protein |
| B624_1046 | 1280635 | 1281186 | − | SUF system FeS assembly protein, NifU family |
| B624_1047 | 1281201 | 1282472 | − | aminotransferase, class-V |
| B624_1048 | 1282614 | 1283390 | − | FeS assembly ATPase SufC |
| B624_1049 | 1283419 | 1284651 | − | FeS assembly protein SufD |
| B624_1050 | 1284660 | 1286156 | − | FeS assembly protein SufB |
| B624_1051 | 1286383 | 1287975 | − | hypothetical protein |
| B624_1052 | 1288225 | 1289883 | − | CTP synthase |
| B624_1053 | 1290032 | 1291585 | − | dipeptidase |
| B624_1054 | 1291684 | 1292127 | − | 3-dehydroquinate dehydratase, type II |
| B624_1055 | 1292294 | 1293913 | − | shikimate kinase/3-dehydroquinate synthase |
| B624_1056 | 1293999 | 1295183 | − | chorismate synthase |
| B624_1057 | 1295247 | 1295717 | + | TadV, prepilin type IV peptidase |
| B624_1058 | 1295891 | 1297069 | − | Periplasmic solute-binding protein |
| B624_1059 | 1297083 | 1297538 | − | YqgF family crossover junction endodeoxyribonuclease, YrrK |
| B624_1060 | 1297550 | 1300228 | − | alanyl-tRNA synthetase |
| B624_1061 | 1300359 | 1300592 | − | hypothetical protein |
| B624_1062 | 1300595 | 1300990 | − | Hypothetical protein |
| B624_1063 | 1301196 | 1301867 | − | phosphoglycerate mutase |
| B624_1064 | 1302020 | 1304008 | + | Acyltransferase family domain protein |
| B624_1065 | 1304105 | 1304728 | − | Ribosomal protein S4 and related proteins |
| B624_1066 | 1304930 | 1305895 | − | ABC transporter, ATP-binding protein |
| B624_1067 | 1305900 | 1307114 | − | ABC superfamily ATP binding cassette transporter, membrane protein |
| B624_1068 | 1307208 | 1307603 | − | hypothetical protein |
| B624_1069 | 1307751 | 1310480 | − | hypothetical protein |
| B624_1070 | 1310567 | 1311145 | + | xanthine phosphoribosyltransferase |
| B624_1071 | 1311199 | 1312560 | + | xanthine/uracil permease family protein |
| B624_1072 | 1312696 | 1312902 | − | transcription regulator |
| B624_1073 | 1312912 | 1313169 | − | hypothetical protein |
| B624_1074 | 1313326 | 1314144 | − | hydrolase, alpha/beta fold family |
| B624_1075 | 1314432 | 1315367 | + | hypothetical protein |
| B624_1076 | 1315462 | 1315860 | − | glyoxalase family protein |
| B624_1077 | 1316019 | 1316630 | + | Pyrazinamidase/nicotinamidase |
| B624_1078 | 1316885 | 1318360 | + | Transcriptional regulator containing an HTH domain and an uncharacterized domain shared with the mammalian protein Schlafen |
| B624_1079 | 1318371 | 1319780 | − | ABC-type multidrug transport system permease component |
| B624_1080 | 1319770 | 1321005 | − | ABC-type multidrug transport system permease component |
| B624_1081 | 1321109 | 1322089 | − | ABC-type multidrug transport system, ATPase component |
| B624_1082 | 1322475 | 1323824 | + | Signal transduction histidine kinase |
| B624_1083 | 1323827 | 1324477 | + | response regulator of two-component system |
| B624_1084 | 1324667 | 1325287 | − | Phosphate transport regulator |
| B624_1085 | 1325308 | 1326357 | − | phosphate transporter family protein |
| B624_1086 | 1326480 | 1326674 | − | Uncharacterized small protein |
| B624_1087 | 1326735 | 1329131 | − | carbon starvation protein A |
| B624_1088 | 1329376 | 1330668 | + | alpha amylase |
| B624_1089 | 1330703 | 1331314 | − | hypothetical protein |
| B624_1090 | 1331486 | 1333669 | − | possible ATP-dependent RNA helicase |
| B624_1091 | 1334052 | 1335338 | − | uracil-xanthine permease |
| B624_1092 | 1335446 | 1336273 | − | Fructose-2,6-bisphosphatase |
| B624_1093 | 1336327 | 1336905 | − | hypothetical protein |
| B624_1094 | 1337061 | 1337612 | + | transcriptional regulator |

TABLE 1-continued

Open reading frames of the genome of 35624.

| Gene ID | Start | End | Strand | Predicted Function |
|---|---|---|---|---|
| B624_1095 | 1337738 | 1338898 | − | virion core protein |
| B624_1096 | 1339275 | 1340816 | − | hypothetical protein |
| B624_1097 | 1341250 | 1341687 | + | hypothetical protein |
| B624_1098 | 1341752 | 1343449 | + | serine/threonine protein kinase |
| B624_1099 | 1343493 | 1344980 | − | efflux transporter protein |
| B624_1100 | 1345295 | 1347343 | − | hypothetical protein |
| B624_1101 | 1347576 | 1347758 | − | hypothetical protein |
| B624_1102 | 1347947 | 1348309 | + | hypothetical protein |
| B624_1103 | 1348405 | 1349910 | − | hypothetical protein |
| B624_1104 | 1349906 | 1351072 | − | hypothetical protein |
| B624_1105 | 1351310 | 1351477 | + | hypothetical protein |
| B624_1106 | 1351660 | 1352478 | + | phosphoesterase or phosphohydrolase |
| B624_1107 | 1352565 | 1354004 | + | hypothetical protein |
| B624_1108 | 1354223 | 1354612 | + | hypothetical protein |
| B624_1109 | 1354729 | 1355193 | + | hypothetical protein |
| B624_1110 | 1355496 | 1356380 | − | hypothetical protein |
| B624_1111 | 1356380 | 1357450 | − | Site-specific recombinase XerD |
| B624_1112 | 1357650 | 1358675 | + | transposase |
| B624_1113 | 1358675 | 1359139 | + | hypothetical protein |
| B624_1114 | 1359139 | 1359897 | + | hypothetical protein |
| B624_1115 | 1360305 | 1361396 | − | GTP-binding protein YchF |
| B624_1116 | 1361533 | 1362351 | − | pyrroline-5-carboxylate reductase |
| B624_1117 | 1362416 | 1363891 | − | proline iminopeptidase |
| B624_1118 | 1363977 | 1366433 | + | histidine kinase sensor of two-component system |
| B624_1119 | 1366458 | 1367345 | + | response regulator |
| B624_1120 | 1367384 | 1370233 | − | transport protein |
| B624_1121 | 1370265 | 1371176 | − | ABC-type antimicrobial peptide transport system, ATPase component |
| B624_1122 | 1371528 | 1372841 | − | O-acetylhomoserine sulfhydrylase |
| B624_1123 | 1373315 | 1374184 | + | pyridoxal kinase |
| B624_1124 | 1374553 | 1374924 | + | endonuclease |
| B624_1125 | 1374983 | 1376515 | + | Mg chelatase-related protein |
| B624_1126 | 1376515 | 1378212 | + | DNA processing protein DprA |
| B624_1127 | 1378272 | 1380134 | + | sdhA |
| B624_1128 | 1380233 | 1381195 | + | Succinate dehydrogenase iron-sulfur protein |
| B624_1129 | 1381292 | 1381954 | + | O-methyltransferase |
| B624_1130 | 1382006 | 1382944 | − | Rossmann fold nucleotide-binding protein |
| B624_1131 | 1383180 | 1384595 | − | clpx |
| B624_1132 | 1385070 | 1386485 | − | ATP-dependent Clp protease, ATP-binding subunitClpX |
| B624_1133 | 1386610 | 1387308 | − | ATP-dependent Clp protease, proteolytic subunit 2 |
| B624_1134 | 1387317 | 1387937 | − | ATP-dependent Clp protease, proteolytic subunit 1 |
| B624_1135 | 1388046 | 1388423 | − | hypothetical protein |
| B624_1136 | 1388538 | 1390001 | − | voltage-gated chloride channel family protein |
| B624_1137 | 1390189 | 1391565 | − | trigger factor |
| B624_1138 | 1391623 | 1392921 | − | 3-5 exonuclease domain protein |
| B624_1139 | 1392921 | 1393556 | − | Permeases of the majorfacilitator superfamily |
| B624_1140 | 1393622 | 1394500 | − | pyruvate formate-lyase 1 activating enzyme |
| B624_1141 | 1394613 | 1396985 | − | formate acetyltransferase |
| B624_1142 | 1397254 | 1397520 | − | hypothetical protein |
| B624_1143 | 1397531 | 1399225 | − | NH(3)-dependent NAD synthetase |
| B624_1144 | 1399577 | 1400725 | − | Peptidase, M20/M25/M40 family |
| B624_1145 | 1400817 | 1401500 | − | permease protein of ABC transporter system |
| B624_1146 | 1401500 | 1402702 | − | ABC transporter, ATP-binding protein |
| B624_1147 | 1402839 | 1403816 | − | ABC-type transport system protein |
| B624_1148 | 1404020 | 1404847 | + | hydrolase, haloacid dehalogenase-like family |
| B624_1149 | 1404975 | 1407449 | − | D-xylulose 5-phosphate/D-fructose 6-phosphatephosphoketolase |
| B624_1150 | 1407895 | 1409454 | + | GMP synthase |
| B624_1151 | 1409930 | 1410304 | + | arsb1 |
| B624_1152 | 1410328 | 1410720 | + | arsenical resistance protein/arsenate reductase |
| B624_1154 | 1412111 | 1413136 | + | transposase |
| B624_1155 | 1413136 | 1413600 | + | possible Transposase |
| B624_1156 | 1413600 | 1414358 | + | hypothetical protein |
| B624_1159 | 1416510 | 1417160 | + | hypothetical protein |
| B624_1160 | 1417164 | 1418444 | + | hypothetical protein |
| B624_1161 | 1418440 | 1418820 | + | hypothetical protein |
| B624_1162 | 1419070 | 1420548 | + | ATP-dependent Zn protease |
| B624_1163 | 1420727 | 1422598 | + | lipopolysaccharide modification acyltransferase |
| B624_1164 | 1422690 | 1423706 | + | prsA |
| B624_1165 | 1423991 | 1425370 | + | nucleotidyl transferase |
| B624_1166 | 1425377 | 1425787 | + | iojap-related protein |
| B624_1167 | 1425942 | 1426637 | + | phosphoglycerate mutase |
| B624_1168 | 1427294 | 1428961 | + | phosphate acetyltransferase |
| B624_1169 | 1429099 | 1429695 | + | acetate kinase |
| B624_1170 | 1429718 | 1430326 | + | Acetate kinase |
| B624_1171 | 1430503 | 1431837 | − | 3-phosphoshikimate 1-carboxyvinyltransferase |

TABLE 1-continued

Open reading frames of the genome of 35624.

| Gene ID | Start | End | Strand | Predicted Function |
|---|---|---|---|---|
| B624_1172 | 1431867 | 1433036 | − | membrane protein |
| B624_1173 | 1433357 | 1433766 | + | hypothetical protein |
| B624_1175 | 1434688 | 1436172 | − | galactoside symporter |
| B624_1176 | 1436515 | 1439583 | + | beta-galactosidase |
| B624_1178 | 1441301 | 1442047 | − | hypothetical protein |
| B624_1179 | 1442167 | 1442559 | − | hypothetical protein |
| B624_1180 | 1442574 | 1442990 | − | hypothetical protein |
| B624_1183 | 1445667 | 1445948 | + | hypothetical protein |
| B624_1184 | 1446119 | 1446796 | + | hypothetical protein |
| B624_1185 | 1447254 | 1448801 | + | DNA-cytosine methyltransferase |
| B624_1189 | 1452909 | 1453127 | + | IS861, transposase OrfB |
| B624_1191 | 1453837 | 1455122 | − | hypothetical protein |
| B624_1192 | 1455179 | 1455604 | − | cell division protein FtsZ |
| B624_1193 | 1455752 | 1459864 | − | DNA helicase/exodeoxyribonuclease V, subunit A |
| B624_1194 | 1459861 | 1463163 | − | ATP-dependent nuclease, subunit B |
| B624_1195 | 1463295 | 1465928 | − | DNA polymerase III, alpha subunit |
| B624_1196 | 1466012 | 1467055 | + | hypothetical protein |
| B624_1197 | 1467089 | 1467952 | − | ribonuclease BN |
| B624_1199 | 1468949 | 1469908 | − | pseudouridylate synthase |
| B624_1200 | 1469911 | 1470456 | − | lipoprotein signal peptidase |
| B624_1201 | 1470481 | 1471857 | − | hypothetical protein |
| B624_1202 | 1472000 | 1472299 | − | integral membrane protein |
| B624_1203 | 1472424 | 1472900 | − | hypothetical protein |
| B624_1204 | 1472916 | 1474124 | − | Tubulin/FtsZ family, C-terminal domain |
| B624_1205 | 1474239 | 1475480 | − | tRNA-dihydrouridine synthase |
| B624_1206 | 1475628 | 1477097 | − | glycyl-tRNA synthetase |
| B624_1207 | 1477533 | 1478474 | + | hydroxyethylthiazole kinase |
| B624_1208 | 1478560 | 1481310 | + | thiamine biosynthesis protein ThiE/ThiC |
| B624_1209 | 1481353 | 1481679 | − | hypothetical protein |
| B624_1210 | 1481820 | 1482626 | + | phosphomethylpyrimidine kinase |
| B624_1211 | 1482680 | 1483054 | + | Uncharacterized protein |
| B624_1212 | 1483563 | 1484939 | + | permease protein |
| B624_1213 | 1485207 | 1485515 | + | hypothetical protein |
| B624_1214 | 1485571 | 1485978 | + | hypothetical protein |
| B624_1215 | 1486039 | 1487433 | + | Serpin (serine protease inhibitor) superfamily |
| B624_1216 | 1487480 | 1488517 | + | transcriptional regulator, LacI family |
| B624_1217 | 1488734 | 1490068 | + | oligosaccharide:H+ symporter |
| B624_1218 | 1490082 | 1491635 | + | sucrose-6-phosphate hydrolase |
| B624_1219 | 1491833 | 1492612 | + | ABC transporter, permease protein, cysTW family |
| B624_1220 | 1492876 | 1493943 | + | pyrimidine precursor biosynthesis enzyme |
| B624_1221 | 1494070 | 1495254 | + | inosine-uridine preferring nucleoside hydrolase |
| B624_1222 | 1495416 | 1496201 | − | undecaprenyl diphosphate synthase |
| B624_1223 | 1496207 | 1496923 | − | DNA repair protein RecO |
| B624_1224 | 1496975 | 1498684 | − | Hydrolases of the alpha/beta superfamily |
| B624_1225 | 1498808 | 1500025 | − | 1-hydroxy-2-methyl-2-(E)-butenyl 4-diphosphatesynthase |
| B624_1226 | 1500028 | 1501215 | − | 1-deoxy-D-xylulose 5-phosphate reductoisomerase |
| B624_1227 | 1501215 | 1502915 | − | Pyridoxine biosynthesis enzyme |
| B624_1228 | 1503387 | 1503800 | − | hypothetical protein |
| B624_1229 | 1503919 | 1504797 | − | PDZ domain family protein |
| B624_1230 | 1505018 | 1506760 | + | hypothetical protein |
| B624_1231 | 1506836 | 1508407 | − | ATP-dependent DNA helicase PcrA |
| B624_1232 | 1508553 | 1510205 | + | aminoglycoside phosphotransferase |
| B624_1233 | 1510357 | 1510578 | + | ATP-binding protein |
| B624_1234 | 1510645 | 1511535 | − | PHP domain N-terminal region family |
| B624_1235 | 1511673 | 1512407 | + | membrane protein |
| B624_1236 | 1512419 | 1513309 | − | diaminopimelate epimerase |
| B624_1237 | 1513417 | 1514208 | + | glutamate racemase |
| B624_1238 | 1514340 | 1515182 | + | esterase-like protein |
| B624_1239 | 1515255 | 1516151 | − | Membrane protease subunits, stomatin/prohibitin |
| B624_1242 | 1517316 | 1517573 | + | transcriptional regulator |
| B624_1243 | 1517692 | 1517940 | − | Glutaredoxin and related proteins |
| B624_1244 | 1518187 | 1519422 | − | cystathionine beta-lyase |
| B624_1245 | 1519661 | 1520560 | − | glutamine ABC transporter, periplasmicglutamine-binding protein (glnH) |
| B624_1246 | 1520629 | 1521417 | − | amino acid ABC transporter, ATP-binding protein |
| B624_1247 | 1521413 | 1522084 | − | amino acid ABC transporter, permease protein |
| B624_1248 | 1522074 | 1522730 | − | amino acid ABC transporter, permease protein |
| B624_1249 | 1522958 | 1523605 | + | Phospholipase/Carboxylesterase |
| B624_1250 | 1523620 | 1525872 | − | Translation elongation factor |
| B624_1251 | 1526019 | 1526723 | + | DNA polymerase III alpha subunit |
| B624_1252 | 1526731 | 1527318 | − | guanylate kinase |
| B624_1253 | 1527501 | 1528418 | − | orotidine 5'-phosphate decarboxylase |
| B624_1254 | 1528421 | 1531801 | − | carbamoyl-phosphate synthase, large subunit |
| B624_1255 | 1531806 | 1533029 | − | carbamoyl-phosphate synthase, small subunit |
| B624_1256 | 1533219 | 1533788 | − | transcription antitermination factor NusB |
| B624_1257 | 1533846 | 1534409 | − | Elongation factor P (EF-P) |

TABLE 1-continued

Open reading frames of the genome of 35624.

| Gene ID | Start | End | Strand | Predicted Function |
|---|---|---|---|---|
| B624_1258 | 1534514 | 1535248 | + | ATP-binding protein of ABC transporter system |
| B624_1259 | 1535248 | 1536033 | + | ABC type permease |
| B624_1260 | 1536066 | 1536770 | − | ErfK/YbiS/YcfS/YnhG family protein |
| B624_1261 | 1536878 | 1539331 | − | hypothetical protein |
| B624_1262 | 1539444 | 1540754 | − | hypothetical protein |
| B624_1263 | 1541413 | 1543257 | + | glycosyltransferase |
| B624_1264 | 1543710 | 1544741 | − | 3-hydroxybutyryl-CoA dehydrogenase |
| B624_1265 | 1544959 | 1546782 | − | alpha-glucosidase |
| B624_1267 | 1547359 | 1549491 | − | 20 family glycoside hydrolase |
| B624_1268 | 1549605 | 1550417 | − | ABC transporter, permease protein, MalFG family |
| B624_1270 | 1551035 | 1551862 | + | hypothetical protein |
| B624_1271 | 1552142 | 1553254 | − | mrp |
| B624_1272 | 1553434 | 1556193 | − | DNA ligase, NAD-dependent |
| B624_1273 | 1556261 | 1559881 | − | hypothetical protein |
| B624_1274 | 1559979 | 1562237 | + | pmt family glycosyltransferase |
| B624_1275 | 1562375 | 1564141 | + | hypothetical protein |
| B624_1276 | 1564204 | 1564986 | − | ABC transporter, ATP-binding protein |
| B624_1277 | 1565037 | 1566299 | − | aminotransferase, class I |
| B624_1278 | 1566573 | 1567337 | − | ROK family protein |
| B624_1279 | 1567559 | 1568365 | + | Nitroreductase family protein |
| B624_1280 | 1568413 | 1569423 | − | glycosyltransferase |
| B624_1281 | 1569675 | 1570325 | + | hypothetical protein |
| B624_1282 | 1570459 | 1572888 | + | ABC transporter, ATP-binding protein |
| B624_1283 | 1572963 | 1573265 | + | RNA-binding protein |
| B624_1284 | 1573370 | 1573732 | − | hypothetical protein |
| B624_1285 | 1573842 | 1574456 | + | hypothetical protein |
| B624_1286 | 1574885 | 1575301 | + | hypothetical protein |
| B624_1287 | 1575432 | 1576415 | − | D-isomer specific 2-hydroxyacid dehydrogenase family protein |
| B624_1288 | 1576714 | 1578168 | + | drug resistance transporter, EmrB/QacA family |
| B624_1289 | 1578399 | 1579418 | − | sugar ABC transporter permease |
| B624_1290 | 1579418 | 1580485 | − | ribose ABC transporter, permease protein |
| B624_1291 | 1580490 | 1582028 | − | ATP binding protein of ABC transporter |
| B624_1292 | 1582172 | 1583152 | − | ribose ABC transporter, periplasmicD-ribose-binding protein |
| B624_1293 | 1583472 | 1585199 | − | Lipoprotein lpqB |
| B624_1294 | 1585199 | 1586893 | − | sensor histidine kinase MtrB |
| B624_1295 | 1586893 | 1587612 | − | hypothetical protein |
| B624_1296 | 1587674 | 1589050 | − | recombination factor protein RarA |
| B624_1297 | 1589136 | 1591700 | − | DEAD box family helicase |
| B624_1298 | 1591837 | 1592907 | − | hypothetical protein |
| B624_1299 | 1592976 | 1593215 | − | hypothetical protein |
| B624_1300 | 1593208 | 1593801 | − | 5'-nucleotidase/2',3'-cyclic phosphodiesterase and relatedesterases |
| B624_1301 | 1593841 | 1595379 | − | hypothetical protein |
| B624_1302 | 1595471 | 1596568 | − | glutamine ABC transporter, glutamine-bindingprotein/permease protein |
| B624_1303 | 1596577 | 1597251 | − | glutamine ABC transporter, permease protein |
| B624_1304 | 1597254 | 1598090 | − | amino acid ABC transporter, amino acid-bindingprotein |
| B624_1305 | 1598125 | 1598964 | − | amino acid ABC transporter, ATP-binding protein |
| B624_1306 | 1599518 | 1600468 | + | hypothetical protein |
| B624_1307 | 1600932 | 1602728 | − | aspartyl-tRNA synthetase |
| B624_1308 | 1602767 | 1604164 | − | histidyl-tRNA synthetase |
| B624_1309 | 1604264 | 1605721 | + | hypothetical protein |
| B624_1310 | 1605933 | 1607723 | − | 5'-nucleotidase family protein |
| B624_1311 | 1607898 | 1608653 | − | Amidase-like protein |
| B624_1312 | 1608742 | 1610115 | − | proline/betaine transporter |
| B624_1313 | 1610308 | 1611807 | − | Purine catabolism regulatory protein-like family |
| B624_1314 | 1611950 | 1613266 | + | cytosine deaminase-like protein |
| B624_1315 | 1613452 | 1616058 | − | ATP-dependent Clp protease, ATP-binding subunitClpC |
| B624_1316 | 1616208 | 1617170 | + | Universal stress protein UspA and related nucleotide-binding proteins |
| B624_1317 | 1617288 | 1618472 | − | hypothetical protein |
| B624_1318 | 1618484 | 1618870 | − | cspB |
| B624_1319 | 1618943 | 1620790 | − | baes1 |
| B624_1320 | 1620965 | 1621693 | − | winged helix family two component transcriptional regulator |
| B624_1321 | 1621689 | 1622492 | − | hypothetical protein |
| B624_1322 | 1622567 | 1622854 | + | hypothetical protein |
| B624_1323 | 1622957 | 1624579 | − | chaperone |
| B624_1324 | 1624820 | 1625056 | − | cold-shock domain family protein |
| B624_1325 | 1625289 | 1625969 | − | hypothetical protein |
| B624_1326 | 1626085 | 1626771 | + | uracil-DNA glycosylase |
| B624_1327 | 1626814 | 1627890 | + | ATPase, MoxR family |
| B624_1328 | 1627890 | 1628837 | + | Protein of unknown function family |
| B624_1329 | 1628840 | 1629388 | + | hypothetical protein |

TABLE 1-continued

Open reading frames of the genome of 35624.

| Gene ID | Start | End | Strand | Predicted Function |
|---|---|---|---|---|
| B624_1330 | 1629388 | 1630443 | + | Uncharacterized protein containing a von Willebrand factor type A (vWA) domain |
| B624_1331 | 1630443 | 1631471 | + | hypothetical protein |
| B624_1332 | 1631471 | 1632070 | + | cell surface elastin binding protein EbpS |
| B624_1333 | 1632316 | 1632660 | + | hypothetical protein |
| B624_1334 | 1632660 | 1634261 | + | hypothetical protein |
| B624_1335 | 1634531 | 1634893 | + | hypothetical protein |
| B624_1336 | 1635034 | 1635672 | − | hypothetical protein |
| B624_1337 | 1635805 | 1637238 | + | adenylosuccinate lyase |
| B624_1338 | 1637373 | 1639931 | + | hypothetical protein |
| B624_1339 | 1640080 | 1640358 | + | DNA-binding protein HU |
| B624_1340 | 1640480 | 1641937 | − | Pup-ligase protein |
| B624_1341 | 1641940 | 1642203 | − | hypothetical protein |
| B624_1342 | 1642234 | 1643133 | − | possible inositol monophosphatase |
| B624_1343 | 1643139 | 1644803 | − | Proteasome component |
| B624_1344 | 1644828 | 1646390 | − | rpt1 |
| B624_1345 | 1646454 | 1647170 | − | hypothetical protein |
| B624_1346 | 1647200 | 1647919 | + | phosphoserine phosphatase SerB |
| B624_1347 | 1647962 | 1650271 | + | primosomal protein N |
| B624_1348 | 1650333 | 1651034 | + | alpha beta hydrolase |
| B624_1349 | 1651061 | 1652044 | + | methionyl-tRNA formyltransferase |
| B624_1350 | 1652142 | 1653992 | − | dihydroxy-acid dehydratase |
| B624_1351 | 1654203 | 1654484 | + | DNA-directed RNA polymerase, omega subunit |
| B624_1352 | 1654765 | 1655982 | + | S-adenosylmethionine synthetase |
| B624_1353 | 1667321 | 1667608 | − | CRISPR-associated protein Cas2 |
| B624_1354 | 1667697 | 1668725 | − | CRISPR-associated protein Cas1 |
| B624_1355 | 1668725 | 1669423 | − | CRISPR-associated protein Cas4 |
| B624_1356 | 1669465 | 1670313 | − | CRISPR-associated protein, Csh2 family protein |
| B624_1357 | 1670320 | 1672275 | − | CRISPR-associated RAMP Csd1 family protein |
| B624_1358 | 1672281 | 1672982 | − | CRISPR-associated protein, CT1134 family |
| B624_1359 | 1672992 | 1675427 | − | CRISPR-associated helicase Cas3 |
| B624_1361 | 1677053 | 1680361 | − | isoleucyl-tRNA synthetase |
| B624_1362 | 1680955 | 1682163 | + | maly2 |
| B624_1363 | 1682280 | 1683785 | − | melb1 |
| B624_1364 | 1684111 | 1687299 | + | lacz1 |
| B624_1365 | 1687365 | 1688372 | − | lacr-type transcription regulator |
| B624_1366 | 1688522 | 1689964 | − | major facilitator superfamily mfs_1 |
| B624_1367 | 1690007 | 1690906 | − | Ribokinase |
| B624_1368 | 1690909 | 1692111 | − | alcohol dehydrogenase, iron-containing |
| B624_1369 | 1692111 | 1692794 | − | Phosphoglycolate phosphatase |
| B624_1370 | 1692921 | 1693901 | − | inosine-uridine preferring nucleoside hydrolase |
| B624_1371 | 1693960 | 1694913 | − | Fructokinase |
| B624_1372 | 1694909 | 1695553 | − | N-(5'phosphoribosyl)anthranilateisomerase |
| B624_1373 | 1695603 | 1696415 | − | ABC transporter, ATP-binding protein |
| B624_1374 | 1696415 | 1697242 | − | hypothetical protein |
| B624_1375 | 1697246 | 1698055 | − | Cobalt transport protein |
| B624_1376 | 1698062 | 1698712 | − | hypothetical protein |
| B624_1377 | 1698969 | 1700846 | + | hypothetical protein |
| B624_1378 | 1700977 | 1702989 | − | ABC transporter, ATP-binding/permease protein |
| B624_1379 | 1702989 | 1704944 | − | ABC transporter, ATP-binding protein |
| B624_1380 | 1704944 | 1705474 | − | transcriptional regulator, MarR family |
| B624_1382 | 1707015 | 1708349 | − | bglc |
| B624_1383 | 1708509 | 1710902 | − | bglx2 |
| B624_1385 | 1711383 | 1712657 | − | glutamate--cysteine ligase |
| B624_1386 | 1713223 | 1718037 | + | domain protein |
| B624_1387 | 1718044 | 1718883 | + | hypothetical protein |
| B624_1388 | 1719052 | 1724187 | − | Activator of 2-hydroxyglutaryl-CoA dehydratase |
| B624_1389 | 1724418 | 1725143 | − | anaerobic ribonucleoside-triphosphate reductaseactivating protein |
| B624_1390 | 1725294 | 1727699 | − | anaerobic ribonucleoside-triphosphate reductase |
| B624_1391 | 1728167 | 1729534 | + | exodeoxyribonuclease VII, large subunit |
| B624_1392 | 1729587 | 1729886 | + | exodeoxyribonuclease VII, small subunit |
| B624_1393 | 1730013 | 1730534 | + | NADP(H) oxidoreductase |
| B624_1394 | 1730676 | 1732538 | − | long-chain-fatty-acid--CoA ligase |
| B624_1395 | 1732765 | 1733166 | − | Large-conductance mechanosensitivechannel, MscL |
| B624_1396 | 1733337 | 1733762 | − | Nucleoside deoxyribosyltransferase |
| B624_1397 | 1733887 | 1734102 | − | Histone acetyltransferaseHPA2 and related acetyltransferases |
| B624_1398 | 1734587 | 1735696 | + | hypothetical protein |
| B624_1399 | 1735718 | 1736683 | − | exopolyphosphatase |
| B624_1400 | 1736864 | 1738084 | − | probable aspartate aminotransferase |
| B624_1401 | 1738178 | 1739230 | + | oxidoreductase, Gfo/Idh/MocA family |
| B624_1402 | 1739267 | 1739779 | − | patch repair protein |
| B624_1403 | 1739862 | 1740377 | + | acetyltransferase, GNAT family |
| B624_1404 | 1740356 | 1740841 | − | hypothetical protein |
| B624_1405 | 1741026 | 1745207 | − | helicase, Snf2 family |

TABLE 1-continued

Open reading frames of the genome of 35624.

| Gene ID | Start | End | Strand | Predicted Function |
|---|---|---|---|---|
| B624_1406 | 1745285 | 1746367 | + | DeoR-type transcriptional regulator |
| B624_1407 | 1746604 | 1747620 | + | tetrahydrodipicolinate N-succinyltransferase(dapD) |
| B624_1408 | 1747840 | 1749129 | − | citrate synthase I |
| B624_1409 | 1749406 | 1750185 | − | methionine aminopeptidase, type I |
| B624_1410 | 1750378 | 1751355 | − | membrane protein |
| B624_1411 | 1751532 | 1753703 | + | Peptidase M13, neprilysin |
| B624_1412 | 1753792 | 1754526 | − | single-stranded DNA-binding protein (ssb)subfamily |
| B624_1413 | 1754805 | 1756646 | − | prolyl-tRNA synthetase |
| B624_1415 | 1757392 | 1758561 | − | pflA |
| B624_1416 | 1758551 | 1760338 | − | Protein of unknown function family |
| B624_1417 | 1760391 | 1761806 | − | TPR domain protein |
| B624_1418 | 1761858 | 1762505 | − | oligoribonuclease |
| B624_1419 | 1762676 | 1764226 | − | inosine-5'-monophosphate dehydrogenase |
| B624_1420 | 1764282 | 1765562 | − | Phospho-N-acetylmuramoyl-pentapeptide-transferase |
| B624_1421 | 1765562 | 1766233 | − | Sua5/YciO/YrdC/YwlC family protein |
| B624_1422 | 1766408 | 1767082 | + | Acetyltransferase |
| B624_1423 | 1767220 | 1767921 | − | branched-chain amino acid ABC transporter, ATP-binding protein |
| B624_1424 | 1767924 | 1768781 | − | branched chain amino acid ABC transporter, ATP-binding protein |
| B624_1425 | 1768781 | 1769866 | − | branched-chain amino acid ABC transporter, permease protein |
| B624_1426 | 1769874 | 1770797 | − | branched-chain amino acid ABC transporter, permease protein |
| B624_1427 | 1771042 | 1772226 | − | branched-chain amino acid ABC transporter, aminoacid-binding protein |
| B624_1428 | 1772502 | 1773407 | − | HemK family modification methylase |
| B624_1429 | 1773473 | 1774558 | − | peptide chain release factor 1 |
| B624_1430 | 1774715 | 1774924 | − | ribosomal protein L31 |
| B624_1431 | 1775256 | 1776482 | − | transcription regulator ROK family |
| B624_1432 | 1776702 | 1778219 | + | xylulokinase |
| B624_1433 | 1778416 | 1778760 | + | hypothetical protein |
| B624_1434 | 1778773 | 1779114 | + | hypothetical protein |
| B624_1436 | 1779656 | 1780930 | − | transposase, Mutator family |
| B624_1437 | 1781199 | 1782545 | − | xylose isomerase |
| B624_1440 | 1783425 | 1784222 | − | hypothetical protein |
| B624_1441 | 1785149 | 1785565 | − | polypeptide deformylase |
| B624_1442 | 1785576 | 1786421 | − | 2,5-diketo-D-gluconic acid reductase |
| B624_1444 | 1787291 | 1787791 | − | MarR-type transcriptional regulator |
| B624_1445 | 1787998 | 1788333 | − | hypothetical protein |
| B624_1446 | 1788358 | 1789572 | − | ABC-type xylose transport system, permease component |
| B624_1447 | 1789575 | 1791125 | − | ABC-type xylose transport system ATPase component |
| B624_1448 | 1791229 | 1792383 | − | ABC-type xylose transport system periplasmic component |
| B624_1449 | 1792635 | 1793801 | + | ROK family protein |
| B624_1450 | 1793842 | 1794705 | + | sugar ABC transporter, ATP-binding protein |
| B624_1451 | 1794736 | 1795683 | − | glucokinase |
| B624_1452 | 1796516 | 1798192 | + | ATP binding protein of ABC transporter |
| B624_1453 | 1798507 | 1799409 | + | acyl-CoA thioesterase II |
| B624_1454 | 1799511 | 1800035 | − | hypothetical protein |
| B624_1455 | 1800213 | 1801622 | − | dihydroneopterin aldolase |
| B624_1456 | 1801736 | 1802608 | − | dihydropteroate synthase |
| B624_1457 | 1802699 | 1803295 | − | GTP cyclohydrolase I |
| B624_1458 | 1803391 | 1805478 | − | cell division protein FtsH |
| B624_1459 | 1805478 | 1806038 | − | hypoxanthine phosphoribosyltransferase |
| B624_1460 | 1806028 | 1807191 | − | ATPase |
| B624_1461 | 1807285 | 1808772 | − | D-alanyl-D-alanine carboxypeptidase/D-alanyl-D-alanine-endopeptidase |
| B624_1462 | 1808798 | 1810468 | − | hypothetical protein |
| B624_1463 | 1810468 | 1811421 | − | ATP-binding protein of ABC transporter system |
| B624_1464 | 1811519 | 1812739 | − | glycosyl transferase domain protein |
| B624_1465 | 1812742 | 1814253 | − | hypothetical protein |
| B624_1466 | 1814329 | 1815252 | + | glycosyltransferase for cell wall membrane |
| B624_1467 | 1815481 | 1816629 | − | Lactaldehyde reductase |
| B624_1468 | 1817069 | 1818370 | + | cyclopropane-fatty-acyl-phospholipid synthase |
| B624_1469 | 1818482 | 1819687 | + | Permeases of the majorfacilitator superfamily |
| B624_1470 | 1820205 | 1821215 | − | UDP-glucose 4-epimerase |
| B624_1471 | 1821543 | 1822400 | + | methyltransferase |
| B624_1472 | 1822698 | 1823195 | − | hypothetical protein |
| B624_1473 | 1823244 | 1823708 | − | hypothetical protein |
| B624_1474 | 1823795 | 1824079 | + | hypothetical protein |
| B624_1475 | 1825086 | 1826453 | − | hypothetical protein |
| B624_1476 | 1827699 | 1828901 | − | Phage integrase family |
| B624_1477 | 1829429 | 1830229 | + | azlC protein |
| B624_1478 | 1830229 | 1830558 | + | branched-chain amino acid permease |
| B624_1479 | 1830743 | 1831258 | − | phosphotyrosine protein phosphatase |
| B624_1480 | 1831385 | 1832044 | − | dihydrofolate reductase |

TABLE 1-continued

Open reading frames of the genome of 35624.

| Gene ID | Start | End | Strand | Predicted Function |
|---|---|---|---|---|
| B624_1481 | 1832157 | 1833026 | − | thymidylate synthase |
| B624_1482 | 1833154 | 1833564 | + | hypothetical protein |
| B624_1483 | 1833629 | 1834663 | − | Universal stress protein UspA and related nucleotide-binding proteins |
| B624_1484 | 1834835 | 1835572 | − | P60 extracellular protein, invasion associatedprotein lap |
| B624_1485 | 1835733 | 1836476 | − | NLP/P60 family domain protein |
| B624_1486 | 1836692 | 1837645 | − | Surface antigen |
| B624_1487 | 1838039 | 1839178 | + | phosphoserine aminotransferase |
| B624_1488 | 1839305 | 1839562 | + | hypothetical protein |
| B624_1489 | 1839693 | 1840883 | − | sensor histidine kinase |
| B624_1490 | 1841074 | 1841745 | + | phosphate transport system regulatory proteinPhoU |
| B624_1491 | 1842110 | 1842847 | − | phosphoglycerate mutase |
| B624_1492 | 1842910 | 1843872 | − | 1,4-dihydroxy-2-naphthoateoctaprenyltransferase |
| B624_1493 | 1843937 | 1845616 | − | lysyl-tRNA synthetase |
| B624_1494 | 1846117 | 1847304 | + | AraJ-like protein probably involvedin transport of arabinose polymers |
| B624_1495 | 1847394 | 1849754 | + | TPR Domain domain protein |
| B624_1496 | 1849833 | 1850462 | + | hypothetical protein |
| B624_1497 | 1850618 | 1852216 | − | hypothetical protein |
| B624_1498 | 1852325 | 1853062 | − | hypothetical protein |
| B624_1499 | 1853062 | 1854780 | − | Hypothetical protein |
| B624_1500 | 1854894 | 1856174 | + | histidine protein kinase |
| B624_1501 | 1856174 | 1856866 | + | transcription regulator, LuxR family |
| B624_1502 | 1856920 | 1857939 | − | UDP-glucose 4-epimerase |
| B624_1503 | 1858012 | 1859556 | − | galactose-1-phosphate uridylyltransferase |
| B624_1504 | 1859606 | 1860682 | − | aminoglycoside phosphotransferase |
| B624_1505 | 1860713 | 1862965 | − | lacto-n-biose phosphorylase |
| B624_1506 | 1863426 | 1864382 | − | sugar ABC transporter, permease protein |
| B624_1507 | 1864382 | 1865350 | − | MalF-type ABC sugar transport systems permease component |
| B624_1508 | 1865546 | 1866859 | − | solute binding protein of ABC transporter forsugars |
| B624_1509 | 1867217 | 1867369 | − | hypothetical protein |
| B624_1510 | 1867867 | 1869150 | − | seryl-tRNA synthetase |
| B624_1511 | 1869384 | 1870562 | + | Diacylglycerol kinase catalytic domain (presumed) protein |
| B624_1512 | 1870573 | 1871409 | − | transcription antiterminator, BglG family |
| B624_1513 | 1871430 | 1873829 | − | PTS system component |
| B624_1514 | 1874293 | 1875843 | + | major facilitator family transporter |
| B624_1515 | 1875934 | 1877607 | + | phosphoglucomutase, alpha-D-glucosephosphate-specific |
| B624_1516 | 1878343 | 1879437 | − | hypothetical protein |
| B624_1517 | 1879668 | 1880087 | + | BadM/Rrf2 family transcriptional regulator |
| B624_1518 | 1880224 | 1881837 | + | Pyridine nucleotide-disulphide oxidoreductase family protein |
| B624_1519 | 1882380 | 1883360 | + | RNase H |
| B624_1520 | 1883494 | 1884189 | + | ribose 5-phosphate isomerase |
| B624_1521 | 1884629 | 1885258 | − | hypothetical protein |
| B624_1522 | 1885386 | 1886921 | + | DNA repair protein RadA |
| B624_1523 | 1886942 | 1888063 | − | riboflavin biosynthesis protein RibF |
| B624_1524 | 1888164 | 1889324 | − | tRNA pseudouridine synthase B |
| B624_1525 | 1889329 | 1889799 | − | ribosome-binding factor A |
| B624_1526 | 1889953 | 1892877 | − | translation initiation factor IF-2 |
| B624_1527 | 1893150 | 1894214 | − | transcription elongation factor |
| B624_1528 | 1894356 | 1895147 | + | lipoprotein |
| B624_1529 | 1895194 | 1896234 | − | LacI-type transcriptional regulator |
| B624_1530 | 1896770 | 1897951 | − | Alpha-L-arabinofuranosidase |
| B624_1531 | 1897936 | 1898334 | − | Alpha-L-arabinofuranosidase |
| B624_1532 | 1899147 | 1899944 | − | Transglutaminase-like superfamily domain protein |
| B624_1533 | 1900154 | 1902331 | − | Domain of unknown function (DUF404) family |
| B624_1534 | 1902601 | 1903515 | + | tRNA pseudouridine synthase I |
| B624_1535 | 1903603 | 1904142 | − | ribosomal protein L17 |
| B624_1536 | 1904245 | 1905237 | − | RNA polymerases L/13 to 16 kDa subunit |
| B624_1537 | 1905321 | 1905716 | − | ribosomal protein S11 |
| B624_1538 | 1905807 | 1906181 | − | ribosomal protein S13p/S18e |
| B624_1539 | 1906333 | 1906443 | − | ribosomal protein L36 |
| B624_1540 | 1906470 | 1906685 | − | translation initiation factor IF-1 |
| B624_1541 | 1906865 | 1907422 | − | adenylate kinase |
| B624_1542 | 1907595 | 1908929 | − | preprotein translocase, SecY subunit |
| B624_1543 | 1909207 | 1909656 | − | ribosomal protein L15 |
| B624_1544 | 1909662 | 1909844 | − | ribosomal protein L30 |
| B624_1545 | 1909853 | 1910551 | − | ribosomal protein S5 |
| B624_1546 | 1910581 | 1910949 | − | ribosomal protein L18 |
| B624_1547 | 1910954 | 1911490 | − | ribosomal protein L6 |
| B624_1548 | 1911511 | 1911906 | − | ribosomal protein S8 |
| B624_1549 | 1911999 | 1912181 | − | ribosomal protein S14p/S29e |
| B624_1550 | 1912186 | 1912755 | − | ribosomal protein L5 |
| B624_1551 | 1912755 | 1913087 | − | ribosomal protein L24 |
| B624_1552 | 1913092 | 1913457 | − | ribosomal protein L14 |

TABLE 1-continued

Open reading frames of the genome of 35624.

| Gene ID | Start | End | Strand | Predicted Function |
|---|---|---|---|---|
| B624_1553 | 1913555 | 1913812 | − | ribosomal protein S17 |
| B624_1554 | 1913818 | 1914066 | − | ribosomal protein L29 |
| B624_1555 | 1914069 | 1914485 | − | ribosomal protein L16 |
| B624_1556 | 1914495 | 1915295 | − | ribosomal protein S3 |
| B624_1557 | 1915301 | 1915657 | − | ribosomal protein L22 |
| B624_1558 | 1915677 | 1915952 | − | ribosomal protein S19 |
| B624_1559 | 1915971 | 1916798 | − | ribosomal protein L2 |
| B624_1560 | 1916838 | 1917131 | − | ribosomal protein L23 |
| B624_1561 | 1917140 | 1917793 | − | ribosomal protein L4/L1 family |
| B624_1562 | 1917803 | 1918441 | − | ribosomal protein L3 |
| B624_1563 | 1918461 | 1918766 | − | ribosomal protein S10 |
| B624_1564 | 1918999 | 1920027 | + | hypothetical protein |
| B624_1565 | 1920366 | 1923092 | − | PutA2 |
| B624_1566 | 1923607 | 1924797 | + | probable repressor in the Rok (NagC/XylR)family |
| B624_1567 | 1924797 | 1927334 | + | glycogen operon protein GlgX |
| B624_1568 | 1927431 | 1927919 | − | ribosomal protein S9 |
| B624_1569 | 1927945 | 1928391 | − | ribosomal protein L13 |
| B624_1570 | 1928792 | 1930954 | − | 4-alpha-glucanotransferase |
| B624_1571 | 1931125 | 1931865 | − | Leucine rich repeat variant |
| B624_1572 | 1931876 | 1932514 | − | hypothetical protein |
| B624_1573 | 1932579 | 1933592 | − | possible 2-hydroxyacid dehydrogenase |
| B624_1574 | 1933669 | 1935009 | − | capA protein |
| B624_1575 | 1935547 | 1936491 | − | Permease protein |
| B624_1576 | 1936720 | 1937991 | + | DNA-damage-inducible protein P |
| B624_1577 | 1938024 | 1939256 | − | aminotransferase |
| B624_1578 | 1939374 | 1939691 | − | fdxC |
| B624_1579 | 1939755 | 1941278 | − | possible cationic amino acid transporter |
| B624_1580 | 1941433 | 1942653 | − | UDP-N-acetylenolpyruvoylglucosamine reductase |
| B624_1581 | 1942930 | 1943094 | − | ribosomal protein L33 |
| B624_1582 | 1943529 | 1944245 | + | cystathionine gamma lyase |
| B624_1583 | 1944924 | 1945214 | − | chaperonin, 10 kDa |
| B624_1584 | 1945390 | 1946811 | − | hypothetical protein |
| B624_1585 | 1946895 | 1947557 | − | possible acetytransferase |
| B624_1586 | 1947644 | 1948360 | + | 5-formyltetrahydrofolate cyclo-ligase-relatedprotein |
| B624_1587 | 1948527 | 1948709 | + | hypothetical protein |
| B624_1588 | 1948950 | 1949516 | + | cation transport ATPase |
| B624_1589 | 1949617 | 1949814 | − | hypothetical protein |
| B624_1590 | 1949820 | 1953440 | − | hypothetical protein |
| B624_1591 | 1953452 | 1954999 | − | hypothetical protein |
| B624_1592 | 1955200 | 1955577 | − | ribosomal protein L7/L12 |
| B624_1593 | 1955689 | 1956207 | − | ribosomal protein L10 |
| B624_1594 | 1956479 | 1957306 | − | hypothetical protein |
| B624_1595 | 1957561 | 1958952 | + | Permease protein |
| B624_1596 | 1959385 | 1962123 | − | polyribonucleotide nucleotidyltransferase |
| B624_1597 | 1962444 | 1962710 | − | ribosomal protein S15 |
| B624_1598 | 1962882 | 1963562 | − | hypothetical protein |
| B624_1599 | 1964088 | 1966964 | − | possible extracellular exo-xylanase |
| B624_1600 | 1967190 | 1969712 | − | endo-1,4-beta-xylanase D |
| B624_1601 | 1970329 | 1971432 | + | IS30 family, transposase [imported] |
| B624_1602 | 1971591 | 1972274 | − | Membrane protein involved in the export of O-antigen and teichoic acid |
| B624_1603 | 1972411 | 1973088 | − | hypothetical protein |
| B624_1604 | 1973553 | 1974794 | − | Large exoproteins involved in heme utilization or adhesion |
| B624_1605 | 1974994 | 1977441 | − | von Willebrand factor type A domain protein |
| B624_1606 | 1978150 | 1978326 | − | hypothetical protein |
| B624_1607 | 1978353 | 1978898 | − | phosphopantethiene protein transferase |
| B624_1608 | 1979459 | 1988974 | − | Fatty acid synthase |
| B624_1609 | 1989016 | 1990635 | − | propionyl-CoA carboxylase, beta chain |
| B624_1610 | 1990631 | 1992592 | − | Acetyl-/propionyl-CoA carboxylase alpha chain |
| B624_1611 | 1993105 | 1993701 | + | B624_oY protein |
| B624_1612 | 1993739 | 1994710 | − | B624_otin--acetyl-CoA-carboxylase ligase |
| B624_1613 | 1994874 | 1996895 | + | hypothetical protein |
| B624_1614 | 1996904 | 1997731 | + | hypothetical protein |
| B624_1615 | 1997829 | 1998578 | − | transcriptional regulator |
| B624_1616 | 1998629 | 1999459 | − | transcriptional regulator, IclRfamily |
| B624_1617 | 2011797 | 2012486 | − | ribosomal protein L1 |
| B624_1618 | 2012505 | 2012933 | − | ribosomal protein L11 |
| B624_1619 | 2013199 | 2014089 | − | transcription termination/antitermination factorNusG |
| B624_1620 | 2014122 | 2014346 | − | preprotein translocase SecE subunit |
| B624_1621 | 2014593 | 2015795 | − | aspartate aminotransferase [imported] |
| B624_1622 | 2015889 | 2017019 | − | spo0B-associated GTP-binding protein |
| B624_1623 | 2017023 | 2018711 | − | GTP-binding protein |
| B624_1624 | 2018783 | 2019028 | − | ribosomal protein L27 |
| B624_1625 | 2019054 | 2019359 | − | ribosomal protein L21 |
| B624_1626 | 2019502 | 2022534 | − | ribonuclease, Rne/Rng family |

TABLE 1-continued

Open reading frames of the genome of 35624.

| Gene ID | Start | End | Strand | Predicted Function |
|---|---|---|---|---|
| B624_1627 | 2022850 | 2024052 | − | succinyl-diaminopimelate desuccinylase |
| B624_1628 | 2024159 | 2025100 | + | auxin efflux carrier |
| B624_1629 | 2025282 | 2026727 | − | permease protein |
| B624_1630 | 2026727 | 2027818 | − | ABC transporter, ATP-binding protein |
| B624_1631 | 2027996 | 2029441 | − | Maf-like protein |
| B624_1632 | 2029581 | 2030690 | − | homoserine kinase |
| B624_1633 | 2030800 | 2032113 | − | homoserine dehydrogenase |
| B624_1634 | 2032276 | 2033865 | − | diaminopimelate decarboxylase |
| B624_1635 | 2033871 | 2035730 | − | arginyl-tRNA synthetase |
| B624_1636 | 2035944 | 2036606 | + | AcrR-type transcriptional regulator |
| B624_1637 | 2036606 | 2037880 | + | permease |
| B624_1638 | 2037970 | 2038899 | + | LysR-type transcriptional regulator |
| B624_1639 | 2038996 | 2040246 | + | probable aminotransferase |
| B624_1640 | 2040298 | 2041620 | − | UDP-N-acetylglucosamine1-carboxyvinyltransferase |
| B624_1641 | 2041869 | 2043212 | + | NADH oxidase |
| B624_1642 | 2043424 | 2044548 | − | dihydroorotate dehydrogenase family protein |
| B624_1643 | 2044591 | 2046273 | − | CAAX amino terminal protease family proteinfamily |
| B624_1644 | 2046594 | 2047283 | − | 3-isopropylmalate dehydratase small subunit |
| B624_1645 | 2047369 | 2048769 | − | 3-isopropylmalate dehydratase, large subunit |
| B624_1646 | 2049063 | 2049860 | + | transcriptional regulator, IclR family |
| B624_1647 | 2050021 | 2051391 | − | Phosphohydrolases |
| B624_1648 | 2051896 | 2054130 | + | polyphosphate kinase |
| B624_1649 | 2054291 | 2055487 | + | Phosphohistidine phosphatase SixA |
| B624_1650 | 2055627 | 2056298 | + | hypothetical protein |
| B624_1651 | 2056564 | 2057871 | − | hypothetical protein |
| B624_1652 | 2058175 | 2058813 | + | uracil phosphoribosyltransferase |
| B624_1653 | 2058864 | 2059340 | + | hypothetical protein |
| B624_1654 | 2059542 | 2060648 | − | Glycerophosphoryl diester phosphodiesterase |
| B624_1655 | 2060677 | 2061747 | − | Glutamyl-tRNA synthetase 1 |
| B624_1656 | 2061933 | 2064599 | − | ATP-dependent Clp protease, ATP-binding subunitClpB |
| B624_1657 | 2064821 | 2066377 | − | histidine ammonia-lyase |
| B624_1658 | 2066617 | 2067489 | + | transcriptional regulator, IclR family |
| B624_1659 | 2067489 | 2067662 | + | hypothetical protein |
| B624_1660 | 2067741 | 2068559 | − | Fumarylacetoacetate hydrolase family protein |
| B624_1661 | 2068665 | 2069906 | − | hypothetical protein |
| B624_1662 | 2070097 | 2071272 | − | UDP-galactopyranose mutase |
| B624_1663 | 2071555 | 2072670 | + | dTDP-glucose 4,6-dehydratase |
| B624_1664 | 2072827 | 2074311 | + | hypothetical protein |
| B624_1665 | 2074307 | 2075068 | + | hypothetical protein |
| B624_1667 | 2075763 | 2076530 | − | IS1533, OrfB |
| B624_1668 | 2076530 | 2077987 | − | Transposase and inactivated derivatives |
| B624_1669 | 2078280 | 2079218 | − | glycosyltransferase |
| B624_1670 | 2079313 | 2079666 | − | sialic acid-specific9-O-acetylesterase |
| B624_1671 | 2080049 | 2081173 | + | Acyltransferase family |
| B624_1672 | 2081181 | 2082893 | − | hypothetical protein |
| B624_1673 | 2082902 | 2085928 | − | Glycosyltransferase family A |
| B624_1674 | 2085935 | 2087170 | − | glycosyl transferase, group 2family protein |
| B624_1675 | 2087259 | 2088509 | − | polysaccharide ABC transporter, ATP-binding protein |
| B624_1676 | 2088515 | 2089351 | − | polysaccharide ABC transporter, permease protein |
| B624_1677 | 2089580 | 2091367 | + | Glycosyl transferase family 8 |
| B624_1678 | 2091457 | 2092698 | − | UDP-glucose 6-dehydrogenase |
| B624_1679 | 2092974 | 2093636 | + | dTDP-glucose 4,6-dehydratase |
| B624_1680 | 2093654 | 2094844 | − | o-acetyltransferase |
| B624_1681 | 2094847 | 2097099 | − | hypothetical protein |
| B624_1682 | 2097441 | 2098844 | + | antimicrobial peptide ABC superfamily ATP binding cassette transporter, permease protein |
| B624_1683 | 2098844 | 2099962 | + | salx-type abc antimicrobial peptide transport system atpase component |
| B624_1684 | 2100089 | 2100790 | + | HD superfamily hydrolase |
| B624_1685 | 2100871 | 2101728 | + | hypothetical protein |
| B624_1686 | 2101825 | 2104335 | − | kup3 |
| B624_1687 | 2104481 | 2105437 | − | hydrolase, TatD family |
| B624_1688 | 2105717 | 2106784 | + | Fic protein family family |
| B624_1689 | 2106816 | 2108621 | − | ABC transporter, ATP-binding/permease protein |
| B624_1690 | 2108635 | 2110542 | − | ABC transporter, ATP-binding/permease protein |
| B624_1691 | 2111297 | 2112703 | − | alpha-galactosidase |
| B624_1692 | 2113077 | 2114231 | + | transcriptional regulator, LacI family |
| B624_1693 | 2114409 | 2115356 | − | probable AraC/XylS-type transcriptionalregulator |
| B624_1694 | 2115401 | 2117626 | − | Hypothetical protein |
| B624_1695 | 2117851 | 2119374 | + | aminopeptidase C |
| B624_1696 | 2119555 | 2120628 | + | hypothetical protein |
| B624_1697 | 2120701 | 2121335 | + | hypothetical protein |
| B624_1698 | 2121673 | 2123535 | − | methionyl-tRNA synthetase |
| B624_1699 | 2123873 | 2124496 | + | hypothetical protein |
| B624_1700 | 2124496 | 2124864 | + | hypothetical protein |
| B624_1701 | 2124897 | 2125904 | − | hypothetical protein |

TABLE 1-continued

Open reading frames of the genome of 35624.

| Gene ID | Start | End | Strand | Predicted Function |
|---|---|---|---|---|
| B624_1702 | 2126487 | 2127902 | − | possible symporter |
| B624_1703 | 2127984 | 2129027 | + | thiamine biosynthesis lipoprotein ApbE |
| B624_1704 | 2129186 | 2131012 | − | ABC transporter, ATP-binding/permease protein |
| B624_1705 | 2131231 | 2133099 | − | ABC transporter, ATP-binding/permease protein |
| B624_1706 | 2133289 | 2133807 | − | transcriptional regulator, MarR family |
| B624_1708 | 2135008 | 2138841 | − | Glycosyl hydrolases family |
| B624_1709 | 2139209 | 2143594 | − | hypothetical protein |
| B624_1710 | 2143901 | 2145394 | − | ATP-dependent DNA helicase recG |
| B624_1711 | 2145737 | 2147257 | − | amino acid permease |
| B624_1712 | 2147448 | 2151185 | − | permease protein |
| B624_1713 | 2151199 | 2151897 | − | ABC transporter, ATP-binding protein |
| B624_1714 | 2152041 | 2152607 | + | probable TetR-like transcriptional regulator |
| B624_1715 | 2152832 | 2154310 | + | aromatic amino acid transport protein AroP |
| B624_1716 | 2154575 | 2155774 | + | transposase IS116/IS110/IS902 family protein |
| B624_1717 | 2155961 | 2160952 | − | Glycosyl hydrolases family 43 |
| B624_1718 | 2161359 | 2164649 | − | Glycosyl hydrolases family 43 |
| B624_1719 | 2164997 | 2168191 | − | possible arabinosidase |
| B624_1720 | 2168529 | 2169131 | − | hypothetical protein |
| B624_1721 | 2169340 | 2170179 | − | sugar ABC transporter, permease protein |
| B624_1722 | 2170182 | 2171033 | − | sugar ABC transporter, permease protein |
| B624_1723 | 2171416 | 2172429 | + | transcription regulator, LacI family |
| B624_1724 | 2172690 | 2174015 | − | possible solute binding protein of ABCtransporter |
| B624_1725 | 2174424 | 2175134 | − | phosphoglycerate mutase |
| B624_1726 | 2175226 | 2175600 | + | hypothetical protein |
| B624_1727 | 2175786 | 2176550 | + | nitroreductase family protein |
| B624_1728 | 2176846 | 2179572 | + | hypothetical protein |
| B624_1729 | 2179572 | 2181908 | + | hypothetical protein |
| B624_1730 | 2182027 | 2182278 | − | hypothetical protein |
| B624_1731 | 2188511 | 2189263 | + | regulatory protein, SIR2 family |
| B624_1732 | 2189415 | 2190677 | − | threonine dehydratase |
| B624_1733 | 2190928 | 2192745 | − | alpha-glucosidase |
| B624_1734 | 2192872 | 2194731 | − | alpha-galactosidase |
| B624_1735 | 2194766 | 2196433 | − | Glucosidase |
| B624_1736 | 2196537 | 2197364 | − | ABC transporter permease protein |
| B624_1737 | 2197364 | 2198320 | − | MalF-type ABC sugar transport systems permease component |
| B624_1738 | 2198408 | 2199730 | − | MalE-type ABC sugar transport system periplasmic component |
| B624_1739 | 2199980 | 2201095 | − | hypothetical protein |
| B624_1740 | 2201159 | 2202484 | − | sugar ABC superfamily ATP binding cassette transporter, substrate binding protein |
| B624_1741 | 2202692 | 2203717 | + | LacI-type transcription regulator |
| B624_1742 | 2203838 | 2204854 | + | LacI-type transcriptional regulator |
| B624_1743 | 2204919 | 2205782 | − | sugar ABC transporter, permease protein |
| B624_1744 | 2205804 | 2206730 | − | sugar ABC transporter, permease protein |
| B624_1745 | 2206755 | 2208041 | − | sugar ABC transporter, sugar-binding protein |
| B624_1746 | 2208215 | 2209420 | + | NagC/XylR-type transcriptional regulator |
| B624_1747 | 2209591 | 2211894 | − | alpha-galactosidase |
| B624_1748 | 2212017 | 2212463 | − | cytidine and deoxycytidylate deaminase |
| B624_1749 | 2212589 | 2214658 | + | Na/H antiporter |
| B624_1750 | 2214858 | 2215613 | − | Esterase protein |
| B624_1751 | 2215735 | 2216592 | − | hypothetical protein |
| B624_1752 | 2216949 | 2217527 | + | deoxycytidine triphosphate deaminase |
| B624_1753 | 2217593 | 2219320 | + | hypothetical protein |
| B624_1754 | 2219543 | 2222527 | − | calcium-transporting ATPase |
| B624_1755 | 2222713 | 2223582 | − | protein probably involved in xylan degradation, possible xylan esterase |
| B624_1756 | 2223622 | 2224932 | − | hypermease of the major facilitator superfamily protein |
| B624_1757 | 2225005 | 2225994 | + | RNA methyltransferase, TrmH family, group 3 |
| B624_1758 | 2226107 | 2227501 | − | lipopolysaccharide kinase |
| B624_1759 | 2227740 | 2228864 | − | ATP binding protein of ABC transporter for sugars |
| B624_1760 | 2229226 | 2230419 | − | glycosyl transferase domain protein |
| B624_1761 | 2230486 | 2231475 | − | Ribonucleotide reductase, beta subunit |
| B624_1762 | 2231704 | 2233896 | − | ribonucleoside-diphosphate reductase, alphasubunit |
| B624_1763 | 2234015 | 2234470 | − | nrdI protein |
| B624_1764 | 2234470 | 2234733 | − | Glutaredoxin |
| B624_1765 | 2235324 | 2235971 | − | Transcriptional regulators |
| B624_1766 | 2235958 | 2236635 | − | Ribosomal protein L1 |
| B624_1767 | 2236828 | 2237592 | + | ion transporter |
| B624_1768 | 2237788 | 2238891 | + | hypothetical protein |
| B624_1769 | 2239035 | 2239400 | − | Beta-glucosidase-related glycosidases |
| B624_1770 | 2239837 | 2241951 | + | Serine/threonine protein kinase |
| B624_1771 | 2242132 | 2243106 | + | hypothetical protein |
| B624_1772 | 2243633 | 2245111 | + | G5 domain protein |
| B624_1773 | 2245147 | 2246067 | + | dimethyladenosine transferase |
| B624_1774 | 2246067 | 2247014 | + | kinase, GHMP family, group 2 |

TABLE 1-continued

Open reading frames of the genome of 35624.

| Gene ID | Start | End | Strand | Predicted Function |
|---|---|---|---|---|
| B624_1775 | 2247064 | 2247690 | + | hypothetical protein |
| B624_1776 | 2247781 | 2249193 | – | pcnA |
| B624_1777 | 2249280 | 2250569 | + | NUDIX domain protein |
| B624_1778 | 2250569 | 2252836 | + | hypothetical protein |
| B624_1779 | 2252836 | 2254560 | + | Hypothetical protein |
| B624_1780 | 2254646 | 2256706 | + | hypothetical protein |
| B624_1781 | 2256829 | 2257845 | + | thioredoxin reductase |
| B624_1782 | 2258158 | 2259516 | – | chromosome partitioning protein ParB |
| B624_1783 | 2259519 | 2260487 | – | Soj family protein |
| B624_1784 | 2260741 | 2261403 | – | methyltransferase GidB |
| B624_1785 | 2261558 | 2262088 | – | R3H domain protein |
| B624_1786 | 2262215 | 2263219 | – | inner membrane insertion protein |
| B624_1787 | 2263219 | 2263533 | – | hypothetical protein |
| B624_1788 | 2263533 | 2263889 | – | ribonuclease P protein component |
| B624_1789 | 2263925 | 2264056 | – | ribosomal protein L34 |

The Open reading frames (ORF) listed in Table 1 are defined by their position in the genomic sequence of SEQ ID No. 1. For example B624_0001 is defined by the nucleotide sequence of base numbers 1 and 1500 (inclusive) of SEQ ID No. 1.

EXAMPLES

The following examples further describe and demonstrate embodiments within the scope of the invention. The examples are given solely for the purpose of illustration and are not to be construed as limitations of the present invention, as many variations thereof are possible without departing from the spirit and scope of the invention.

Example 1—Isolation of Bifidobacterium longum 35624

Appendices and sections of the large and small intestine of the human G.I.T., obtained during reconstructive surgery, were screened for probiotic bacterial strains. All samples were stored immediately after surgery at −80° C. in sterile containers. Frozen tissues were thawed, weighed and placed in cysteinated (0.05%) one quarter strength Ringers' solution. Each sample was gently shaken to remove loosely adhering microorganisms. Following transfer to a second volume of Ringers' solution, the sample was vortexed for 7 min to remove tightly adhering bacteria. In order to isolate tissue embedded bacteria, samples were also homogenised in a Braun blender. The solutions were serially diluted and spread-plated (100 µl) on to the following agar media: RCM (reinforced clostridial media) and RCM adjusted to pH 5.5 using acetic acid; TPY (trypticase, peptone and yeast extract), Chevalier, P. et al. (1990). MRS (deMann, Rogosa and Sharpe); ROG (acetate medium (SL) of Rogosa); LLA (Liver-lactose agar of Lapiere); BHI (brain heart infusion agar); LBS (Lactobacillus selective agar) and TSAYE (tryptone soya agar supplemented with 0.6% yeast extract). All agar media was supplied by Oxoid Chemicals with the exception of TPY agar. Plates were incubated in anaerobic jars (BBL, Oxoid) using $CO_2$ generating kits (Anaerocult A, Merck) for 2-5 days at 37° C.

Gram positive, catalase negative rod-shaped or bifurcated/pleomorphic bacteria isolates were streaked for purity on to complex non-selective media (TPY). Isolates were routinely cultivated in TPY medium unless otherwise stated at 37° C. under anaerobic conditions. Presumptive Bifidobacteria species were stocked in 40% glycerol and stored at −20° and −80° C.

Approximately fifteen hundred catalase negative bacterial isolates from different samples were chosen and characterised in terms of their Gram reaction, cell size and morphology, growth at 15° C. and 45° C. and fermentation end-products from glucose. Greater than sixty percent of the isolates tested were Gram positive, homofermentative cocci arranged either in tetrads, chains or bunches. Eighteen percent of the isolates were Gram negative rods and heterofermentative coccobacilli.

The remaining isolates (twenty-two percent) were predominantly homofermentative coccobacilli. Thirty eight strains were characterised in more detail. All thirty eight isolates tested negative both for nitrate reduction and production of indole from tryptophan.

Bifidobacterium longum 35624 was chosen for full genome sequencing from this group of strains due to its proven anti-inflammatory activity in murine models of colitis (McCarthy et. al., 2004) and its immunomodulatory effects following oral consumption by Irritable Bowel Syndrome (IBS) patients (O'Mahony et al., 2005).

Example 2—Sequencing the Genome of Bifidobacterium longum 35624

Chromosomal DNA from bifidobacteria was isolated as previously described (O'Riordan and Fitzgerald, 1998). The genome sequence of 35624 was sequenced using a Roche 454 FLX Titanium instrument by the commercial sequencing service providers Agencourt Bioscience (Beverly, Mass.) and Eurofins MWG Operon (Germany) and then assembled, after which remaining gaps were closed using Sanger Sequencing of PCR products. Sequence reads were initially assembled using Phred (Ewing and Green, 1998; Ewing et al., 1998), Phrap (P. Green, University of Washington), RepeatMasker (AFA. Smit, R. Hubley, & P. Green) and the Staden software package (Staden et al., 2000). Final assembly of 35624 was verified using Newbler v 2.3. The accession number for the 35624 genome sequence is CP013673.

Example 3—Analysing the Genome of Bifidobacterium longum 35624

Prediction of putative open reading frames (ORFs) was performed using PRODIGAL prediction software and supported by BLASTX [58] alignments. Results of Prodigal/BLASTX were combined manually and a preliminary identification of ORFs was performed on the basis of BLASTP analysis against a non-redundant protein database provided by the National Centre for Biotechnology. Using the ORF finding outputs and associated BLASTP results, Artemis (Rutherford et al., 2000) was employed for visualisation and manual editing in order to verify, and if necessary, redefine the start of every predicted coding region, or to remove or add coding regions. The assignment of protein function to predicted coding regions was performed manually. In addition, the individual members of the revised gene/protein data set were searched against the protein family (Pfam) (Punta et al., 2012) and COG (Tatusov et al., 2000)COG databases. Ribosomal RNA (rRNA) and transfer RNA (tRNA) genes were detected using RNAMMER and tRNA-scanSE, respectively.

Example 4—Identifying Unique Genes in the Genome of Bifidobacterium longum 35624

We identified a region from base numbers 448412 to 474640 (inclusive) of SEQ ID No. 1 that we designated exopolysaccharide (EPS) region 1 (SEQ ID No. 2). The EPS region 1 encodes a cluster of genes B624_0342 to B624_0366 (Table 2).

Reversible protein phosphorylation is a major mechanism in the regulation of fundamental signalling events in all living organisms. Tyrosine phosphorylation is today recognized as a key regulatory device of bacterial physiology, linked to exopolysaccharide production, virulence, stress response and DNA metabolism (Grangeasse et al., 2012). Tyrosine phosphatase together with tyrosine kinase are responsible for controlling polysaccharide biosynthesis and export, but the underlying mechanism remains unclear (Grangeasse et al., 2012).

TABLE 2

ID and functions of $eps_{624}$ cluster genes.

| Gene ID | Start | Stop | Strand | Predicted Function |
|---|---|---|---|---|
| B624_0342 | 448412 | 450007 | + | priming glycosyltransferase |
| B624_0343 | 450098 | 452029 | + | hypothetical protein |
| B624_0344 | 452091 | 453566 | + | tyrosine kinase |
| B624_0345 | 453574 | 454725 | + | glycosyltransferase |
| B624_0346 | 454725 | 456065 | + | glycosyltransferase |
| B624_0347 | 456065 | 457126 | + | UDP-glucuronate 5' epimerase |
| B624_0348 | 457201 | 458448 | + | UDP-glucose 6-dehydrogenase |
| B624_0349 | 458489 | 459550 | + | glycosyltransferase |
| B624_0350 | 459581 | 460408 | + | NAD dependent epimerase/dehydratase |
| B624_0351 | 460446 | 460952 | + | acyltransferase |
| B624_0352 | 460985 | 461998 | + | glycosyltransferase |
| B624_0353 | 462020 | 463360 | + | polymerase |
| B624_0354 | 463363 | 464292 | + | glycosyl transferase |
| B624_0355 | 464311 | 465753 | + | flippase |
| B624_0356 | 465774 | 466280 | + | acyltransferase |
| B624_0357 | 466366 | 467514 | − | NAD dependent epimerase/dehydratase |
| B624_0358 | 467785 | 468615 | − | integrase |
| B624_0359 | 468615 | 468770 | − | transposase |
| B624_0360 | 469189 | 470208 | + | rhamnose biosynthesis |
| B624_0361 | 470218 | 471303 | + | rhamnose biosynthesis |
| B624_0362 | 471349 | 472245 | + | rhamnose biosynthesis |
| B624_0363 | 472438 | 472654 | + | Pseudogene; transposase |
| B624_0364 | 472715 | 472858 | + | hypothetical protein |
| B624_0365 | 473371 | 473802 | − | hypothetical protein |
| B624_0366 | 474083 | 474640 | − | protein-tyrosine-phosphatase |

Example 5—Isolation and Screening of EPS-Producing Bifidobacterial Strain from Fecal Samples Fecal Sample Preparation Fecal samples were collected by the subjects using a Kendall precision commode specimen collection system. The collected samples were stored chilled in a cold pack prior to sample processing. Only samples that are less than twenty four hours old were used in the evaluations.

A 10.0 g sample of mixed fecal material was placed into a plastic stomaching bag containing 90 ml of saline. The suspension was stomached for 2 minutes. The suspension was filtered through a gauze pad contained within a disposable funnel. Following the filtration, 45 ml of the filtered fecal homogenate was transferred to a 50 ml disposable centrifuge tube. This fecal suspension was further used for DNA extraction or for bacterial isolation.

Screening Fecal Samples Using Three TaqMan Real-Time PCR Assays.

Fecal Sample DNA Preparation. A 2.0 ml aliquot of the fecal homogenate was pelleted using a microcentrifuge. The pellets were resuspended in 20 mg/ml lysozyme, for 2 hours at 37° C. DNA was extracted using a QIAamp DNA Stool Mini Kit (Qiagen). The DNA concentration was measured by Pico Green assay (Molecular Probes). Once the DNA concentration was measured, the DNA was stored at 4° C.

TaqMan Real-Time PCR Reactions. The test samples were diluted to a concentration of DNA of 2 ng/ul so that 5 µl contained a total of 10 ng DNA. Samples were assayed by a total of three separate assays.

The following reaction mix was made:

| | | |
|---|---|---|
| Water | 15.75 µl | |
| 10 µM forward primer | 1.5 µl | (300 nM final concentration) |
| 10 µM reverse primer | 1.5 µl | (300 nM final concentration) |
| 10 µM TaqMan probe | 1 µl | (200 nM final concentration) |
| BSA (20 mg/ml) | 0.25 µl | (0.1 ug/ml final concentration) |
| TaqMan Universal Master Mix | 25 µl | |

A bulk mix was made for the number of samples to be assayed. A 45 µl aliquot was dispensed into each well of a 96 well microtitre plate, then 5 µl DNA was added to each well. The plate was spun briefly, and placed into the thermocycler (ABI 7900 HT). The standard TaqMan thermocycling protocol was used.

TanMan RT-PCR Program. The standard TaqMan quantitative PCR thermocycling protocol is as follows:

Step 1: 95° C. for 10 minutes (to activate the AmpliTaq Gold polymerase)

Step 2: 95° C. for 15 seconds (the denaturation step)

Step 3: 60° C. for 60 seconds (the priming/polymerization step)

Steps 2 and 3 are repeated 40 times. Fluorescent data is collected at step 3.

Primers and Probes for Three TaqMan RT-PCR assays. The fecal sample DNAs were screened using a EPS gene-specific assay and two B. longum 35624 gene-specific assays (UNK1 and UNK2). The specific genes used and their TaqMan primer sets are shown in Table 3 below.

TABLE 3

35624 Primer set for TaqMan PCR

| Target Gene | Name | Sequence 5'-3' | Genome start | Genome end | TaqMan Probe label |
|---|---|---|---|---|---|
| BI01615 (UNK-1) | UNK1-F1 | CCATGAGCGGTTTCACGAA (SEQ ID No. 4) | 1451446 | 1451428 | 5' 6-FAM 3' |
|  | UNK1-R1 | TTGGACGGTGCCTGTGATTA (SEQ ID No. 5) | 1451393 | 1451412 | NFQ-MG |
|  | UNK1-MGB1 | CGGGCAATCAAC (SEQ ID No. 6) | 1451426 | 1451415 |  |
| BI02420t (UNK-2) | UNK2-F1 | ACTTGACGTACCGTTTTGAGATTTC (SEQ ID No. 7) | 1656479 | 1656503 | 5' 6-FAM 3' |
|  | UNK2-R1 | CTAAGCATGGCAAGGCTGATAGT (SEQ ID No. 8) | 1656562 | 1656540 | NFQ-MGB |
|  | UNK2-MGB1 | TGCGACCAACACGC (SEQ ID No. 9) | 1656525 | 1656538 |  |
| BI00783 (EPS) | EPS-F1 | GGGTCCAATAAGAAGGTTCCATATT (SEQ ID No. 10) | 456491 | 456515 | 5'6-FAM 3' |
|  | EPS-R1 | GCATGTGCCAACAGCTCATC (SEQ ID No. 11) | 456591 | 456572 | TAMR |
|  | EPS-TAMRA | CGGATGACAAGGTAGATAATCCAGTGAGCCTATAC (SEQ ID No. 12) | 456519 | 456553 |  |

The fecal samples which showed high DNA concentration by the B. longum 35624 EPS gene-specific assay, but negative reactions by using B. longum 35624 gene-specific assays, were further used for the isolation of potential EPS-producing bacteria.

Example 6—Isolation and Characterization of Strain B. longum AH0097 and Strain B. longum AH1172 from Fecal Samples One milliliter of bacterial suspension (see Example 5 above) was transferred to 9.0 ml of sterile phosphate-buffered saline which constituted the $10^{-1}$ dilution. One milliliter of this $10^{-1}$ dilution was transferred to 9.0 ml of sterile phosphate-buffered saline which was the $10^{-2}$ dilution. This process was continued until the $10^{-10}$ dilution was prepared. Then, 0.1 ml of each dilution was plated onto the surfaces of Reinforced Clostridial Agar (RCA) plates (BD or equivalent) and Lactobacillus Man-Rogosa Sharpe agar (MRSA) plates (BD or equivalent). The plates were incubated under anaerobic condition (COY anaerobic Chamber) at 33° C.±2° C. for 48-72 hours.

Following incubation, single colonies (a total of approximately 100 colonies) were picked from RCA and MRSA plates and further streaked on new plates for isolate purification. The plates with the streaked colonies were incubated under anaerobic conditions (COY anaerobic Chamber) at 33° C.±2° C. for 48 to 72 hours. After incubation, the pure colonies observed on plates were then submitted for DNA extraction.

Screening Fecal Isolates Using Three TaqMan Real-Time PCR Assays

The bacterial DNA was extracted using the Preman™ Ultra Sample Preparation Reagent and Protocol (Applied Biosystems). The DNA was further analyzed using three TaqMan RT-PCR assays (EPS gene-specific assay [EPS-1] and two B. longum 35624 gene-specific assays [UNK1 and UNK2] as described above in Example 5. Two isolates showed positive results for the B. longum 35624 EPS gene-specific assay, and negative results for the B. longum 35624 gene-specific assays. Both isolates were therefore further identified using 16S rDNA sequencing Identification of potential EPS-producing strain by 16S rDNA sequencing. The 16S rRNA gene fragment was amplified and sequenced using ABI Full Gene PCR kit (Applied Biosystems, Foster City, Calif.).

(1). 16S rRNA Gene Amplification:

PCR amplification was carried out on a GeneAmp PCR System 9700 thermal cycler with the following program:
Initial Hold: 95° C. for 10 minutes
30 Cycles: 95° C. for 30 seconds (Denaturing)
60° C. for 30 seconds (Annealing)
72° C. for 45 seconds (Extension)
Final Extension: 72° C. for 10 minutes (2). 16S rRNA Gene Sequencing:

Sequencing was further performed on the thermal cycler using the following program:
Cycles: 96° C. for 10 seconds (Denaturing)
50° C. for 5 seconds (Annealing)
60° C. for 4 minutes (Extension)
Final step Hold at 4° C.

The sequencing PCR product was further purified using DyeEX™ 2.0 spin kit and sequenced using 3130 xl Genetic Analyzer (Applied Biosystems, Foster City, Calif.).

(3) Sequence Data Analysis:

Comparison of the consensus sequences with GenBank sequences was done by using Basic Local Alignment Search Tool (BLAST). The GenBank search indicated that the B. longum 35624 EPS gene-specific positive, but B. longum 35624 gene-specific negative isolates were both Bifidobacterium longum. These strains were designated names by Alimentary Health, AH0097 and AH1172.

Example 7—Isolation and Screening of EPS-Expressing Bifidobacterial longum strains Isolation of Bacterial Strains Bacteria were isolated from bowel tissue and/or fecal samples using the methodology described in Example 1 above. In particular, Bifidobacterium longum AH0097 and Bifidobacterium longum strain AH1172 were isolated from faecal samples from healthy adult human subjects.

EPS Gene Cluster Screen

Bacterial strains were screened for the presence of genes from EPS cluster 1 (Table 2 above) using the primers listed in Tables 4 below. Briefly, the following methodology was used for the PCR EPS cluster gene screen:

10 μl Modified Rogosa broth media (+0.05% cysteine) was inoculated aseptically with a freshly grown colony of the bacterial strain and incubatd anaerobically at 37° C. until turbid (about 16 to about 24 hours). The broth cultures were centrifuged and DNA was isolated from the resultant pellet using a Sigma™ extraction procedure. A nanodrop was used to ascertain the concentration of DNA in the sample and samples were diluted using DEPC water to a final concentration of 50 ng/μl DNA per sample. The template DNA samples were used in individual PCR reactions with the primer sets listed in Tables 4 below under the following conditions:

| Step | Temp (° C.) | Time (sec) | |
|---|---|---|---|
| 1 | 95 | 240 | |
| 2 | 95 | 45 | |
| 3 | 60 | 45 | |
| 4 | 72 | 45 | repeat steps 2 to 4, 25 times |
| 5 | 4 | hold | |

The primers were specifically designed to amplify a PCR product of approximately 500 base pair for the 25 genes of EPS clusters 1. PCR products were visualised following agarose gel electrophoresis with an appropriate DNA ladder for reference sizing. The presence (YES) or absence (NO) of a 500 bp PCR product is indicated in Table 5 below.

TABLE 4

Primers for screening bacterial strains for the presence of genes from EPS cluster 1

| Gene ID | Primer name | L R F R | Sequence | SEQ ID NO. |
|---|---|---|---|---|
| B624_0342 | 1.01 | L | tat gtt gcc ggc aft tat ca | SEQ ID No. 12 |
| B624_0342 | 1.01 | R | tgc gcg ttc atg tca ata at | SEQ ID No. 13 |
| B624_0343 | 1.02 | L | ggc gta gca agt tca agg ag | SEQ ID No. 14 |
| B624_0343 | 1.02 | R | aat aac cgc tgc agg aac ac | SEQ ID No. 15 |
| B624_0344 | 1.03 | L | gtg cag gac ggt aat gga gt | SEQ ID No. 16 |
| B624_0344 | 1.03 | R | gct tcg ggt ctg gat cat ta | SEQ ID No. 17 |
| B624_0345 | 1.04 | L | tgc tga caa gtg gag tct gg | SEQ ID No. 18 |
| B624_0345 | 1.04 | R | cca cgt cta cga gca act ca | SEQ ID No. 19 |
| B624_0346 | 1.05 | L | gaa agc gaa gag tgg tct gg | SEQ ID No. 20 |
| B624_0346 | 1.05 | R | ccg gct gat ttg atg aga tt | SEQ ID No. 21 |
| B624_0347 | 1.06 | L | tgc cgc tgt act ggt cac | SEQ ID No. 22 |
| B624_0347 | 1.06 | R | gca tgt gcc aac agc tca | SEQ ID No. 23 |
| B624_0348 | 1.07 | L | cca aca cgt atc tgg cac tg | SEQ ID No. 24 |
| B624_0348 | 1.07 | R | tcg gag cca aag aag gta ga | SEQ ID No. 25 |
| B624_0349 | 1.08 | L | ata ccg cgt atg ctt tgg ac | SEQ ID No. 26 |
| B624_0349 | 1.08 | R | aaa cgg taa cca ctc gct tg | SEQ ID No. 27 |
| B624_0350 | 1.09 | L | atg gga tcg atg cat gaa at | SEQ ID No. 28 |
| B624_0350 | 1.09 | R | ttc tcg gca ata aac cgt tc | SEQ ID No. 29 |
| B624_0351 | 1.10 | L | cca gcg gtt aft tcg ttg tt | SEQ ID No. 30 |
| B624_0351 | 1.10 | R | ggt ggc atg atc ctt atg ct | SEQ ID No. 31 |
| B624_0352 | 1.11 | L | gct atc ttc acc gca ttg gt | SEQ ID No. 32 |
| B624_0352 | 1.11 | R | cca gtc agg gaa ggt cac at | SEQ ID No. 33 |
| B624_0353 | 1.12 | L | tga aat aca cgc aac ccg ta | SEQ ID No. 34 |
| B624_0353 | 1.12 | R | aatgcgtcaaaaccgatacc | SEQ ID No. 35 |
| B624_0354 | 1.13 | L | gga aag caa tga gga agc tg | SEQ ID No. 36 |
| B624_0354 | 1.13 | R | gat ttg atg caa agc aag ca | SEQ ID No. 37 |

TABLE 4 -continued

Primers for screening bacterial strains for the presence of genes from EPS cluster 1

| Gene ID | Primer name | L R F R | Sequence | SEQ ID NO. |
|---|---|---|---|---|
| B624_0355 | 1.14 | L | gtg agt acc gtt tcc gca at | SEQ ID No. 38 |
| B624_0355 | 1.14 | R | ttc ctt ggt tcc cgt gat ag | SEQ ID No. 39 |
| B624_0356 | 1.15 | L | gct ggg att ttg gaa gtg aa | SEQ ID No. 40 |
| B624_0356 | 1.15 | R | tgt tac ccc cgg cat aat aa | SEQ ID No. 41 |
| B624_0357 | 1.16 | L | acc ggt aac gtt cag aft gc | SEQ ID No. 42 |
| B624_0357 | 1.16 | R | gca ata ccg cct tga cct ta | SEQ ID No. 43 |
| B624_0358 | 1.17 | L | ttg tac cac cac acg tac cg | SEQ ID No. 44 |
| B624_0358 | 1.17 | R | cgc gag ttc aat ggc tat g | SEQ ID No. 45 |
| B624_0359 | 1.18 | L | aca tcg acc tcc atc tcc ag | SEQ ID No. 46 |
| B624_0359 | 1.18 | R | ata cgt aac agc ggc tcc ac | SEQ ID No. 47 |
| B624_0360 | 1.19 | L | aag tac gat gtg cgc tac ca | SEQ ID No. 48 |
| B624_0360 | 1.19 | R | cat cac ggt cag gat gtc ac | SEQ ID No. 49 |
| B624_0361 | 1.20 | L | cga ata cac gga cat caa cg | SEQ ID No. 50 |
| B624_0361 | 1.20 | R | gag aat cga gca gct gga ac | SEQ ID No. 51 |
| B624_0362 | 1.21 | L | tgg gag agg agt tca tcg ac | SEQ ID No. 52 |
| B624_0362 | 1.21 | R | gta tcc agc cat gcg taa cc | SEQ ID No. 53 |
| B624_0363 | 1.22 | L | taatgggcgg acggaaagtt | SEQ ID No. 54 |
| B624_0363 | 1.22 | R | tgccctccgt gaaatacagg | SEQ ID No. 55 |
| B624_0364 | 1.23 | L | caacgatgtc catatcgcct | SEQ ID No. 56 |
| B624_0364 | 1.23 | R | gcgccctgtt gttgatgatg | SEQ ID No. 57 |
| B624_0365 | 1.24 | L | ccgattccgc cattcgtttc | SEQ ID No. 58 |
| B624_0365 | 1.24 | R | ggccacatcg aaaatcacgg | SEQ ID No. 59 |
| B624_0366 | 1.25 | L | gaattggctt gcagagcggc | SEQ ID No. 60 |
| B624_0366 | 1.25 | R | acagaatcag gtcggcttgc | SEQ ID No. 61 |

TABLE 5

Results of EPS cluster 1 gene screen
In which YES indicates the presence and NO indiates the absence of a 500 bp PCR product.

| Gene ID | Primer set | B. longum 35624 | B. longum AH1172 | B. longum AH0097 |
|---|---|---|---|---|
| B624_0342 | 1.01 | YES | YES | YES |
| B624_0343 | 1.02 | YES | YES | YES |
| B624_0344 | 1.03 | YES | YES | YES |
| B624_0345 | 1.04 | YES | YES | YES |
| B624_0346 | 1.05 | YES | YES | YES |
| B624_0347 | 1.06 | YES | YES | YES |
| B624_0348 | 1.07 | YES | YES | YES |
| B624_0349 | 1.08 | YES | YES | YES |
| B624_0350 | 1.09 | YES | YES | YES |
| B624_0351 | 1.10 | YES | YES | YES |
| B624_0352 | 1.11 | YES | NO | YES |
| B624_0353 | 1.12 | YES | YES | YES |
| B624_0354 | 1.13 | YES | YES | YES |
| B624_0355 | 1.14 | YES | YES | YES |
| B624_0356 | 1.15 | YES | YES | YES |
| B624_0357 | 1.16 | YES | YES | YES |
| B624_0358 | 1.17 | YES | YES | NO |
| B624_0359 | 1.18 | YES | YES | YES |
| B624_0360 | 1.19 | YES | YES | YES |
| B624_0361 | 1.20 | YES | YES | NO |
| B624_0362 | 1.21 | YES | YES | YES |

Predicted Role of eps$_{624}$ Genes to eps$_{624}$ Structure.

The eps$_{624}$ cluster encodes a number of key enzymes that are predicted to be required for EPS production, by means of the so-called Wzx/Wzy-dependent pathway, which typically employs a priming glycosyltransferase (pGT), one or more glycosyl transferases (GHs), a flippase, and a polymerase to produce an extracellular heteropolysaccharide (Schmid et al., 2015). The first gene (corresponding to locus tag BL_0342 and designated here as pgt624) of the $eps_{624}$ gene cluster is predicted to encode the pGT, which adds the first monosaccharide to a cytoplasmic, membrane-bound carrier molecule undecaprenyl as part of the oligosaccharidic subunit biosynthesis (Salazar et al., 2009). The $eps_{624}$ cluster encodes five additional GTs (corresponding to locus tags BL_0345, BL_0346, BL_0349 and BL_0352;), which are predicted to each add one monosaccharide to the carrier molecule so as to complete the oligosaccharidic subunit, prior to its export to the external side of the membrane by a flippase (predicted to be encoded by a gene corresponding to locus tag BL_0355) and its subsequent use by a polymerase (putatively specified by locus tag BL_0353) to produce the EPS polymer. Interestingly, two adjacent genes of the $eps_{624}$ cluster, corresponding to B624_0347 and 118 B624_0348, are predicted to encode a UDP-glucuronate 5'-epimerase and a UDP-glucose 6-dehydrogenase, suggesting that one of the incorporated monosaccharides of the EPS is an epimer of glucuronic acid, e.g. galacturonic acid or mannuronic acid. Three genes located within the $eps_{624}$ cluster, corresponding to locus tags B624_0360 through to B624_0362), encode enzymes known to be involved in the biosynthesis of dTDP-L-rhamnose (Marumo et al., 1992), while the deduced protein products of B624_0350 and B624_0357 are predicted to encode NAD-dependent reductase/epimerase enzymes. Such enzymes have been shown to be involved in the rerouting of the dTDP-L-rhamnose biosynthesis pathway towards the production of dTDP-D-fucose or dTDP-6-deoxy-L-talose (Gaugler and Gabriel, 1973; Nakano et al., 2000; Yoshida et al., 1999). The $eps_{624}$ cluster also encodes two predicted acetyl transferases, similar to enzymes that have previously been shown to perform O-acetylation reactions on particular sugar components (such as 6-deoxy-L-talose) in polysaccharides (Knirel et al., 2002). Furthermore, the genes with locus tags B624_0344 and B624_0366 represent putative tyrosine kinase and phosphotyrosine protein phosphatase activities, respectively, which have been associated with controlling EPS export and polymerisation (Grangeasse et al., 2012). Therefore, based on the gene content of the $eps_{624}$ cluster, we predict that the EPS produced by 35624 is composed of a repeating subunit that consists of six monosaccharides, of which one is an epimer of glucuronic acid, one or two others are either D-fucose or 6-deoxy-talose, and some of which may be O-acetylated.

The genes located within the $eps_{624}$ cluster, corresponding to locus tags B624_0342 through to B624_0366, are required for the production of the *B. longum* 35624 subsp. *longum* specific EPS. The production of an EPS by a bacterium minimally requires a priming glycosyltransferase (pGT), one or more glycosyl transferases (GHs), a flippase, and a polymerase to produce an extracellular heteropolysaccharide. The number of glycosyl transferases may vary thereby affecting the length of oligosaccharidic subunit. Additionally, the presence of acetyl transferases may result in the O-acetylation of some of the monosaccharides.

Protein-Tyrosine-Phosphatase

Reversible protein phosphorylation is a major mechanism in the regulation of fundamental signalling events in all living organisms. Tyrosine phosphorylation is today recognized as a key regulatory device of bacterial physiology, linked to exopolysaccharide production, virulence, stress response and DNA metabolism (Grangeasse et al., 2012). Tyrosine phosphatase together with tyrosine kinase are responsible for controlling polysaccharide biosynthesis and export, but the underlying mechanism remains unclear (Grangeasse et al., 2012). In the *B. longum* subsp. *longum* 35624 genome B624_0344 encodes tyrosine kinase while B624_0366 encodes tyrosine phosphatase. B624_0366 was not previously identified as being part of the $eps_{624}$ cluster in patent application PCT/IE2009/000079 published as WO2010/055499A.

Congo Red Agar Screen

A Congo red agar screen was used to phenotypically screen for EPS expressing bacterial strains. Briefly, 10 ml Modified Rogosa broth media (+0.05% cysteine) was inoculated aseptically with a freshly grown colony of the bacterial strain and incubated anaerobically at 37° C. until turbid (about 16 to about 24 hours). The broth cultures were aseptically streaked onto Congo Red Agar plates and incubated anaerobically at 37° C. for 48 hours. It is believed that EPS produced as a by-product of the growth and/or metabolism of certain strains prevents the uptake of the Congo red stain resulting in a cream/white colony morphology. Stains that produce less EPS take up the Congo red stain easily, resulting in a pink/red colony morphology. Strains that do not produce an EPS stain red and look almost transparent in the red agar background.

Figure 2:
FIG. 2 is a photograph of *B. longum* NCIMB 41714 (AH1172) grown on a Congo Red Agar plate.
Figure 3:
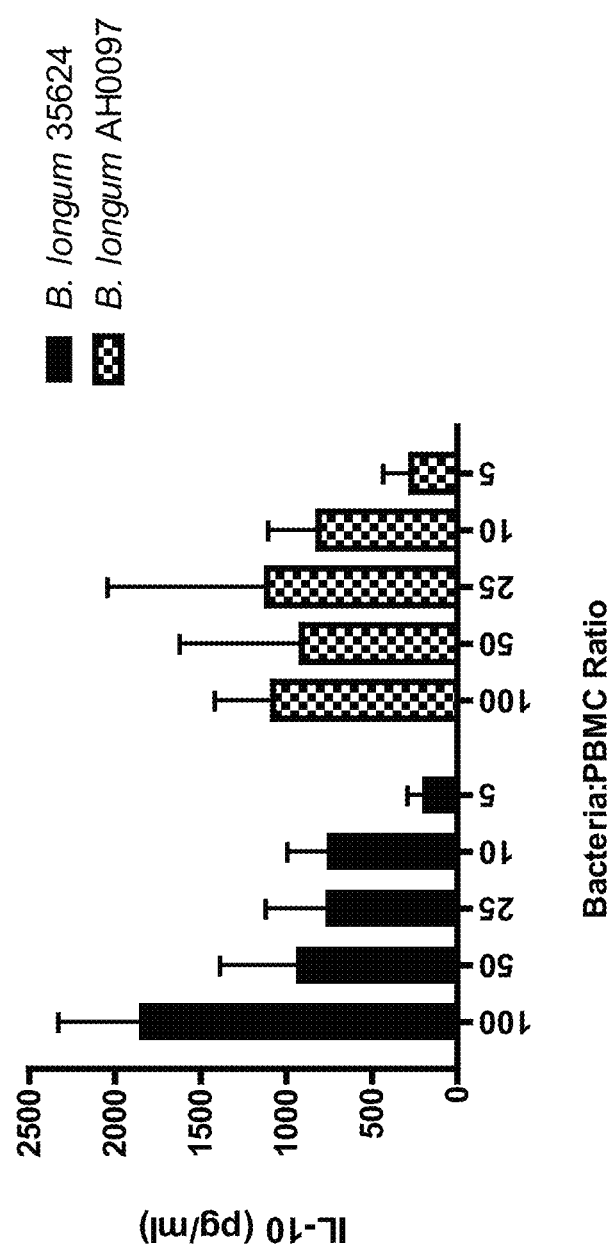
FIG. 3. is a graph of IL-10 secretion by PBMC stimulated with *B. longum* AH0097 or *B. longum* 35624 for 48 h (n=5)
Figure 4:
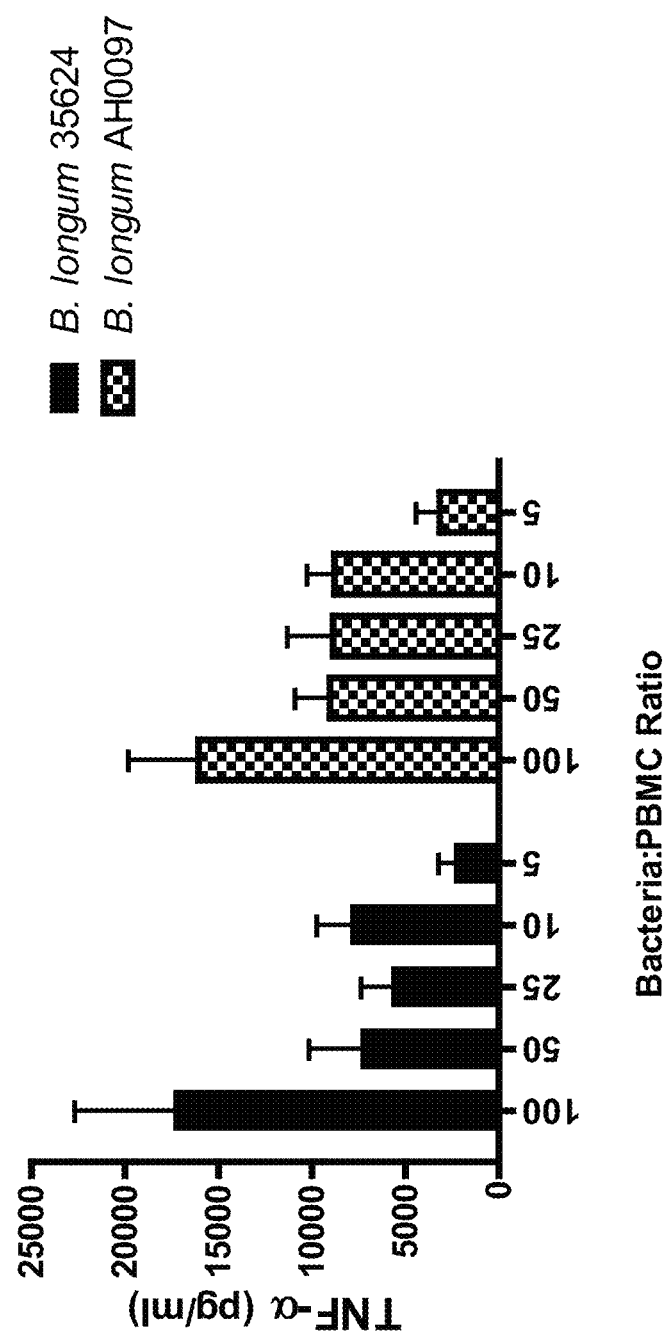
FIG. 4: is a graph of TNF-α secretion by PBMC stimulated with *B. longum* AH0097 or *B. longum* 35624 for 48 h (n=5)
Figure 5:
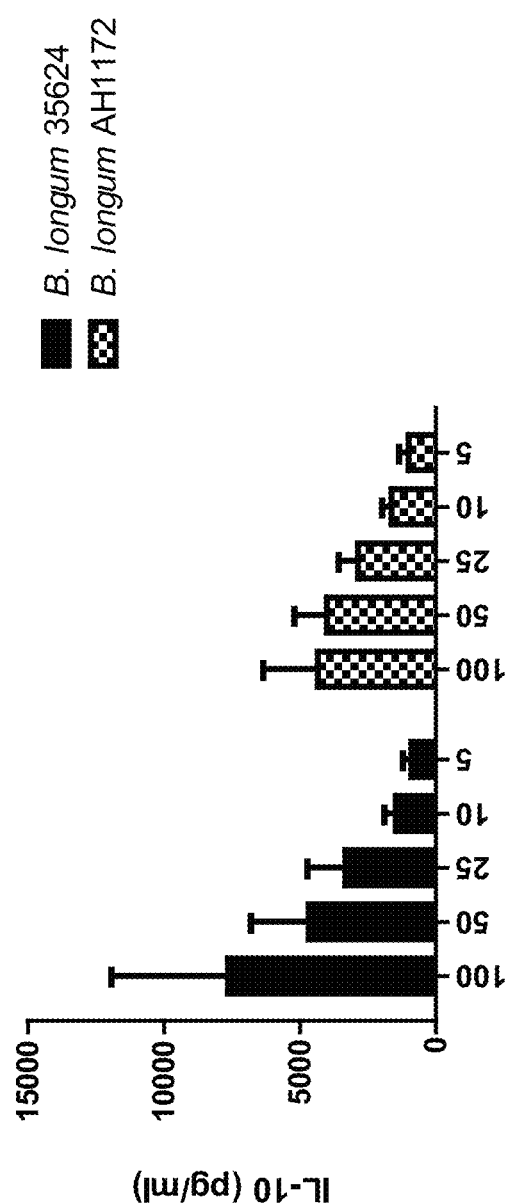
FIG. 5: is a graph of IL-10 secretion by PBMC stimulated with *B. longum* AH1172 or *B. longum* 35624 for 48 h (n=3)
Figure 6:
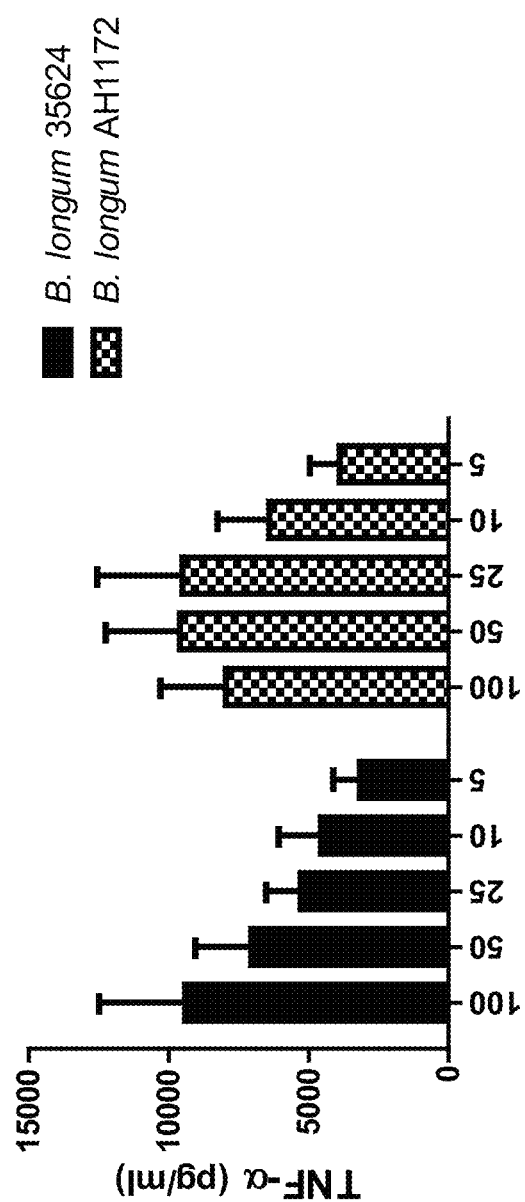
FIG. 6: TNF-α secretion by PBMC stimulated with *B. longum* AH1172 or *B. longum* 35624 for 48 h (n=4)

Referring to FIGS. 1 and 2, the following colony morphologies were observed:

TABLE 6

Colony morphologies from Congo red agar screen

| Bacterial Strain | Colony morphology |
| --- | --- |
| *B. longum* 35624 | Convex, mucoid, bright white colonies |
| *B. longum* AH0097 (FIG. 1) | Convex, mucoid, bright white colonies |
| *B. logum* AH0172 (FIG. 2) | Convex, mucoid, bright white colonies |

The control of inflammatory diseases is exerted at a number of levels. The controlling factors include hormones, prostaglandins, reactive oxygen and nitrogen intermediates, leukotrienes and cytokines. Cytokines are low molecular weight biologically active proteins that are involved in the generation and control of immunological and inflammatory responses. A number of cell types produce these cytokines, with neutrophils, monocytes and lymphocytes being the major sources during inflammatory reactions due to their large numbers at the injured site.

Multiple mechanisms exist by which cytokines generated at inflammatory sites influence the inflammatory response. Chemotaxis stimulates homing of inflammatory cells to the injured site, whilst certain cytokines promote infiltration of cells into tissue. Cytokines released within the injured tissue result in activation of the inflammatory infiltrate. Most cytokines are pleiotropic and express multiple biologically overlapping activities. As uncontrolled inflammatory responses can result in diseases such as IBD, it is reasonable to expect that cytokine production has gone astray in individuals affected with these diseases.

*B. longum* 35624, *B. longum* AH0097 and *B. longum* AH1172 Induce Nearly Identical Cytokine Profiles in PBMCs.

Peripheral blood mononuclear cells (PBMCs) were isolated from fresh human peripheral blood using BD Vacutainer CPT tubes (BD catalog 362761), as per the manufacturer's instructions. PBMCs were washed and resuspended in Dulbecco's MEM (Gibco catalog 10569-010) plus 25 mM HEPES, 10% fetal bovine serum (Sigma catalog F4135), and 1% penicillin/streptomycin (Sigma catalog P0781). $2 \times 10^5$ PBMCs (in 200 µl of DMEM) were plated into each well of a 96-well culture plate.

Bacteria were grown in Difco MRS media and harvested just after entering into stationary phase. All cells were grown under anaerobic conditions at 37° C. Growth curves (OD vs # of live cells) were constructed for each growth condition, and washed cells were normalized by cell number before addition to the PBMCs.

Bacteria (20 µl in phosphate buffered saline (PBS)) were added to each well of PBMCs to give the total number of bacteria as indicated for each experiment. Five different amounts of bacteria were tested: 2E07, 1E07, 5E6, 2E6 and 1E6 were added to separate wells of PBMCs. A no-bacteria control also was run. All assays were done in triplicate. After a 2-day incubation at 37° C., the plates were spun at 300×g, and the supernatants were removed and stored frozen at −80° C. until analysis.

Cytokines in the culture supernatants were assayed using a 96-well assay kit from Meso Scale Discovery (Gaithersburg, Md.; catalog K15008B-1). Human Interleukin 10 (Il-10), and Tumor Necrosis Factor alpha (TNFa) were quantitated and reported as picograms per milliliter. Each sample was assayed in duplicate.

FIGS. 3 to 6 show the results of a representative experiment. For each cytokine shown, *B. longum* 35624, *B. longum* AH0097 and *B. longum* AH1172 induce nearly identical levels of cytokines. These levels are very different than the levels induced by other Bifidobacterial strains that they were compared to.

The control of inflammatory diseases is exerted at a number of levels. The controlling factors include hormones, prostaglandins, reactive oxygen and nitrogen intermediates, leukotrienes and cytokines. Cytokines are low molecular weight biologically active proteins that are involved in the generation and control of immunological and inflammatory responses, while also regulating development, tissue repair and haematopoiesis. A number of cell types produce these cytokines, with neutrophils, monocytes and lymphocytes being the major sources during inflammatory reactions due to their large numbers at the injured site. They provide a means of communication between leukocytes themselves and also with other cell types. Most cytokines are pleiotrophic and express multiple biologically overlapping activities. Cytokine cascades and networks control the inflammatory response rather than the action of a particular cytokine on a particular cell type (Arai K I, et al., 1990). Waning of the inflammatory response results in lower concentrations of the appropriate activating signals and other inflammatory mediators leading to the cessation of the inflammatory response. As uncontrolled inflammatory responses can result in diseases such as IBD, it is reasonable to expect that cytokine production has gone astray in individuals affected with these diseases.

Interleukin-10 (IL-10) is an anti-inflammatory cytokine which is produced by many cell types including monocytes, macrophages, dendritic cells, mast cells and lymphocytes (in particular T regulatory cells). IL-10 down-regulates the expression of pro-inflammatory Th1 cytokines, MHC class II antigens, and co-stimulatory molecules on antigen presenting cells. It also enhances B cell survival, proliferation, and antibody production. This cytokine can block NF-κB activity, and is involved in the regulation of the JAK-STAT signaling pathway. Murine knock-out studies have demonstrated the essential role for IL-10 in immunoregulation as IL-10KO mice develop severe colitis. In addition, bacteria which are potent inducers of IL-10 have been shown to promote T regulatory cell differentiation in vivo thus contributing to immunological homeostasis (O'Mahony et al., AJP 2006; O'Mahony et al., PLoS Pathogens 2008).

Tumor necrosis factor alpha (TNFα) is a pivotal proinflammatory cytokine as it initiates a cascade of cytokines and biological effects resulting in the inflammatory state. Therefore, agents which inhibit TNFα are currently being used for the treatment of inflammatory diseases, e.g. infliximab.

Compositions and Methods for Formulating EPS Producing Strains

Compositions

The following table demonstrates compositions incorporating the freeze dried bacteria expressing the EPS.

| | Weight (%) | | | | |
|---|---|---|---|---|---|
| Material | A | B | C | D | E |
| Freeze-dried bacteria | 5.3 | 6.0 | 5.0 | 10 | 5.0 |
| Microcrystalline cellulose | 93.7 | | 72.0 | | |
| Maltodextrin | | 93.5 | | | |
| Fumed silica | | | 2.0 | | |
| Ascorbic acid | | | 10.0 | | |
| Tricalcium citrate | | | 10.0 | | |
| Potato starch | | | | 89.0 | |
| Psyllium husk | | | | | 94.0 |
| Magnesium stearate | 1.0 | 0.5 | 1.0 | 1.0 | 1.0 |
| Total | 100 | 100 | 100 | 100 | 100 |

To ensure adequate shelf life of the composition the following dry handling procedures can used. The mixing and filling operations can be performed in a humidity-controlled environment where the RH can be maintained below 50%, alternatively below 40%. The freeze-dried bacteria can be pre-concentrated to the desired CFU/g to achieve the desired total amount in each dosage unit based on the fraction of freeze-dried bacteria and total amount of mixed powder to be dosed. The freeze-dried bacterial can be added to the mixing cavity of, for example, a Pharmatech mixer along with the appropriate amount of stabilizing excipient such as microcrystalline cellulose, potato starch or the like. The stabilizing excipients can be pre-dried to have low water contents, for example, less than 10%, alternatively less than 6% water content. The head space within the mixing cavity can be flushed with a dry gas, such as nitrogen, so that the relative humidity is maintained at a low level. The powders can then be mixed for 20 minutes at a mixing speed of 60 rpm to ensure good mixing. Once mixing is completed, the powder can be handled and stored in a low Rh environment, for example, below 50% RH, or below 40% RH.

The appropriate amount of the resulting dry-blended powder to achieve the desired CFU per dosage unit can then be filled into appropriately sized capsules, for example, a gelatin or hydroxypropyl methyl cellulose (HPMC) capsule under a dry environment. Alternatively, an appropriate amount of the resulting powder can be filled into a sachet and sealed under a dry environment. The resulting capsules or sachets can be stored at room temperature (20-30° C.) or alternatively at reduced temperature (4° C.) to extend shelf life.

| Powder | Freeze-dried Bacteria (CFU) | Unit | Powder Quantity (g) | CFU/Unit |
|---|---|---|---|---|
| A | $1 \times 10^{10}$ | Gelatin capsule | 0.2 | $1.1 \times 10^8$ |
| B | $1 \times 10^{11}$ | HPMC capsule | 0.25 | $1.5 \times 10^9$ |
| C | $1 \times 10^{12}$ | Gelatin capsule | 0.18 | $9.0 \times 10^9$ |
| D | $1 \times 10^9$ | Sachet | 1.0 | $1.0 \times 10^8$ |
| E | $1 \times 10^{11}$ | Sachet | 2.0 | $1.0 \times 10^{10}$ |

Alternatively, the freeze-dried bacteria can be incorporated into a dairy product such as yogurt or into a chewable dosage form using standard techniques.

| Material | Weight (%) | |
|---|---|---|
| | Yogurt | Chewable Dose Form |
| Freeze-dried bacteria | 8 | 3 |
| Milk | 70 | |
| Sugar | 20 | |
| Starch | 2 | |
| Microcrystalline cellulose | | 15 |
| Compressible sugar | | 40 |
| Fructose | | 40 |
| Citric acid | | 0.5 |
| Magnesium stearate | | 1 |
| Flavor | | 0.5 |
| Total | 100 | 100 |

Methods of Use

The compositions described herein are intended to be used as prophylactic, therapeutic or non-therapeutic treatments to alleviate diseases and conditions that affect animals, preferably mammals and humans. The compositions may be administered to subjects as a pharmaceutical, OTC or supplement, for example DSHEA, product. Non-limiting examples of prophylactic, therapeutic or non-therapeutic treatments can be for inflammatory diseases or conditions, or modulation of the immune system. The diseases and conditions can include inflammatory bowel disease, irritable bowel syndrome, diarrhea due to a range of causes such as travel or antibiotic treatment, allergy, asthma, fever control, nutritional disorders, maintaining or improving the condition of the gastrointestinal tract or skin, and respiratory disorders or infections. In particular, these compositions can be used to treat or prevent adverse conditions of the gastrointestinal tract.

Typically, the compositions are given to a subject as part of a dose regimen. The dose regimen can be varied depending on the specific state that is being treated or prevented and the unit dose format. For example, the total amount of bacteria administered per dose can range from $1 \times 10^6$ to $1 \times 10^{12}$ CFU per dose, preferably from $ax10^8$-$1 \times 10^{10}$ CFU per dose. The unit dose, when provided as a capsule can be swallowed directly with or without fluid. The powder contained in a sachet can be ingested directly or mixed with a liquid like milk or juice or mixed with a food such as yogurt. If already incorporated into a food supplement such as yogurt or into a chewable form the dose can be taken by eating. The dose regimen can proscribe administration at least once per month, at least once per week, at least once per day or more than once per day.

The dimensions and values disclosed herein are not to be understood as being strictly limited to the exact numerical values recited. Instead, unless otherwise specified, each such dimension is intended to mean both the recited value and a functionally equivalent range surrounding that value. For example, a value disclosed as "40" is intended to mean "about 40".

All documents cited in the Detailed Description of the Invention are, in relevant part, incorporated herein by reference; the citation of any document is not to be construed as an admission that it is prior art with respect to the present invention. To the extent that any meaning or definition of a term in this document conflicts with any meaning or definition of the same term in a document incorporated by reference, the meaning or definition assigned to that term in this document shall govern.

While particular embodiments of the present invention have been illustrated and described, it would be obvious to those skilled in the art that various other changes and modifications can be made without departing from the spirit and scope of the invention. It is therefore intended to cover in the appended claims all such changes and modifications that are within the scope of this invention.

REFERENCES

Altschul, S. F., Madden, T. L., Schaffer, A. A., Zhang, J., Zhang, Z., Miller, W., and Lipman, D. J. (1997). Gapped BLAST and PSI-BLAST: a new generation of protein database search programs. Nucleic Acids Res 25, 3389-3402.

Altschul S. F., Gish W., Miller W., Myers E. W. and Lipman D. J. (1990) Basic local alignment search tool. J Mol Biol. 215: 403-410.

Bateman, A., Birney, E., Cerruti, L., Durbin, R., Etwiller, L., Eddy, S. R., Griffiths-Jones, S., Howe, K. L., Marshall, M., and Sonnhammer, E. L. (2002). The Pfam protein families database. Nucleic Acids Res 30, 276-280.

Bendtsen J. D., Nielsen H., von Heijne G. and Brunak S. (2004) Improved prediction of signal peptides: SignalP 3.0. J Mol Biol. 340: 783-795.

Bouhnik Y Survival And Effects Of Bacteria Ingested In Fermented Milk In Man Lait 73 (2): 241-247 1993

Busch W, Saier M H The Transporter Classification (TC) system, 2002 Critical Reviews In Biochemistry And Molecular Biology 37 (5): 287-337 2002

Chevalier, P. et al. (1990) *J. Appl. Bacteriol* 68, 619-624)

Coutinho & Henrissat, 1999

Delcher A L, Harmon D, Kasif S, White O, Salzberg S L Improved microbial gene identification with GLIMMER Nucleic Acids Research 27 (23): 4636-4641 Dec. 1, 1999

Eddy, S. R. The HMMER software tools.

Eddy S R A memory-efficient dynamic programming algorithm for optimal alignment of a sequence to an RNA secondary structure BMC BIOINFORMATICS 3: Art. No. 18 2002

Green, P. The Phred/Phrap/Consed system home page.

Griffiths-Jones S, Moxon S, Marshall M, Khanna A, Eddy S R, Bateman A Rfam: annotating non-coding RNAs in complete genomes Nucleic Acids Research 33: D121-D124 Sp. Iss. SI Jan. 1, 2005

Krogh A, Larsson B, von Heijne G, Sonnhammer E L L., Predicting transmembrane protein topology with a hidden Markov model: Application to complete genomes Journal Of Molecular Biology 305 (3): 567-580 Jan. 19, 2001

Kurtz S, Schleiermacher C REPuter: fast computation of maximal repeats in complete genomes Bioinformatics 15 (5): 426-427 May 1999

Lowe T M, Eddy S R tRNAscan-S E: A program for improved detection of transfer RNA genes in genomic sequence Nucleic Acids Research 25 (5): 955-964 Mar. 1, 1997

Liu M, van Enckevort F H, Siezen R J, Genome update: lactic acid bacteria genome sequencing is booming Microbiology 2005, vol 151 pp 3811-3814

McCarthy et al., 2004

O'Mahony L, McCarthy J, Kelly P, Hurley G, Luo F, Chen K, O'Sullivan G C, Kiely B, Collins J K, Shanahan F, Quigley E M.: *Lactobacillus* and *bifidobacterium* in irritable bowel syndrome: symptom responses and relationship to cytokine profiles. Gastroenterology. 2005 March; 128(3):541-51.

O'Mahony et al., AJP 2006

O'Mahony et al., PLoS Pathogens 2008

Riley, 1993

Riley, 1998a

Rutherford, K., Parkhill, J., Crook, J., Horsnell, T., Rice, P., Rajandream, M. A., and Barrell, B. (2000). Artemis: sequence visualization and annotation. Bioinformatics 16, 944-945.

Salzberg S, Delcher A L, Fasman K H, Henderson J. A decision tree system for finding genes in DNA Journal Of Computational Biology 5 (4): 667-680 WIN 1998

Suzek, B. E., Ermolaeva, M. D., Schreiber, M., and Salzberg, S. L. (2001). A probabilistic method for identifying start codons in bacterial genomes. Bioinformatics 17, 1123-1130.

Tatusov, R. L., The XUGNITOR software.

Volfovsky et al., 2001

Wheeler et al., 2005

SEQUENCE LISTING (111 sequences)

SEQ ID NO: 1 - DNA, 2264056 bp, Bifidobacterium longum
atggttaacgcttccggcgaccccgtaatcgaggccgcccacatctggtcagacacgctgacggtgctcaaacacagcgcttcgctcagcccacgagaaaaaggctggttggaaggcgttgttcctgaaggcgtcttcggttcgaccatcgtgctgtgtgtggacaacaacgacacgcttcaagccattcagggtgatttgaacgattccctgcttcaggcattgcgtacggtaaccggcgaaaatatgtttcccgcgttcaaggtcgtgccgaaaaccgagcccgaaccgctttcggaggcaaagccggcgcagccatatccttcggaaatttctccgactgtcgccgaattcggtaaagaatcctatggtgcaaagccggcagccgcaccgcgggaaccgatgcccgccaccgagccgcagttcccggtcggtcagcagaagatgaatcgcgatcccgagactcatctcaataagaacttcacgtttgattccttcgtgcccggcgattccaaccgttttgcccgtacggtcgcactggccgtggccgaaggttccgggcaggatttcaacccgttgtgtatctatggcggatcgggcctgggcaaaacccacttgctgaacgccatcggcaactatgcactggtcaaggatcccgggctgaaggttcgatacgtcacgtctgaggaattcacgaacgaattcattgacgcgctgcaaaacccgaaccaaagccaggggcagattgctgaattcaaccgtcgataccgacaggttgatgtgttgcttattgacgatatccagttcctcggcggcaaggaagccaccttggatcagttcttccatacgttcaatgcactgcatcaggcaaataagcgtattgtcattgcttccgatgtagcgcccaagaatttgaagggtttcgaggctcgactcatctcgcgcttcgaatccggcctgaccgtagacgtcaagccgccggatctggagacccgaatcgccattcttcgcatgatcgcctcgatgaacggctcgaaaatccccagcgatgtgttggacctcatcgccgaacgcttcaccgagaacattcgtgaactcgaaggcgcgctaacccgtgttacggccgtggcctcgctgagtaatcagccggtgacccgcgccttggccgagcagacgttgcaggacttcttcaccaccgatgtggaaatcaagcccacggacatcatcagtcaggtggcgaagtacttccacctgacgtttgaggatcttgtcggtaaatcacgaaccaaaaacgtggctgttcctcgtcagatcgccatgtatctggctcgcgaaatgaccagtatgagcctgatggatattggccaggtctttggcggacgcgatcacaccacagtaatgcatgcctgcactcgaatcagtgaccgaatgcagcaaaaacaggagatctataactacgttatggagctcacggttcgcctcaagcaaagcaacaccaactgacacaacgcttctgagagacgaaaaacggcactttttggactgactttccgaaaagtgccgtttttggttgctcaggcggattctggtggatacgtcgaggcaacggattcgagacattagattcctcatggctcccctttgtgaggggatctgtcggcgcagacgactgaggggagtttcgaaggggaacacgcaaaaaaaccatgaaacgagagaatcgattctgaggaccgattttgcgggtttgggcgagcgagacggaaaaagtgccgaaaacggtctccagaatcgattctcctcgacgaaaaacagtcttcaacacgccgtgcgaaagtgcgaaaaccaaaaaagttatccacatagttgtgcacagatgtgggtaaactcggcggataactcgtggattacccactgttttgttgtggaaaactcgtgcataaccgcgacctcgatgtggaaaactcaaattcgacgaactggctgtggaaaactcgcccacttatccacaagccatgcagaatttgtccacaattttcagggacttatgaaccgttgcagttgtagggctcagccctacttatccacactatccaccggccttattatggcgattacttactcagttacgtgaaaagcatcatcgccatagtaacagccggtcatccagcgtacgtaagttcgccacctaacggctagaatatttctcagccaatccgacgaagggaacaatcacacatgaaagtcgaaatcgatactgcagccctggccgacgccgtagcctggacctcccgagtcatcgacgcacgtccctccaacccgattctcgctggtgtcaagctggaagccattgacggaacgctgcaattctccgccttcaactacgagatttccgctcgccaccacatcgaagccggcgttgacgaagccggttccgtactggttcagggcaagctgctggccgatatcaccaaatcgctgcgttcggagaaaacgtacctggtcaccgacggctccacgctgaccatcacgtccggcaagtcgaagttcaccttgcagctcatgcccgacaccgagtacccggatctgcccgtggtaccggccatgctcggccaagtcgatgccccgactttcgttcaggccgtgaaccaggcgtgcgttgccgtctcccgcgaagaaaaccgcccggtactgaccggcgttcgcatgcaattccaaggcgacaaggtcgtcatgacctccaccgatcgcttccgtttggcccgcgccaccttcacttggactccgcagaacccggacgtcgacaccaccacgctggttcgcggctccctgctcaaggatgtggcccgtgctcttgacgagcaccagaacatccgccttgatttcgatgccgatagcccgacgctgctcggcttcgaaaacgccggccgcgtctccacctcccagctcatcgacggtgaattcccggcggtcgaccgcctgttcgccgacgaatatccgattcaggccgtagtcaacaagcaggatttgctcgacgccatcagccgtgtggctttggtcgccgaacgcaatgctccgattcgcatgaccttcaccggtcaggaagtggcgctgtccgccggatcggtcgacgaggctcaggccaacgaaacactggacatcgacatggatggcgacgacatcaccgtggcattcaacccgtcctacctgaaggagggtctgtccgccgtaaccgaaccattcgtgcgcatcaaaatgacgaccccggtcaagccggtcgagttcaatggccagcaggaagctgattccgacgagtccatggactaccgatacctgctcgtgccgatgcgctttaacaactgaaatccctgaatttccaacgattcgctaatgcacatctcccgtctcgcactcgaccactaccgctcatggagtcaggtagtggtcgatttcgtaccaggcgtgaatatcctgttcggcaagaacggtctgggcaaaaccaatctggtggaagccttcgaagtgctgtccaccggatcgagccatcgcacgtccagcacgttgccgctgatcgaacgcgggcagaccacggccaccatccgcgcgaacgtcgctgatgatgccggtcaaaccactacgtatgaagcgtcaattcatgcgcgtggtgccaaccgagcccgcatcaactcggggtcgtcgctgtatctgcgcgatatcatcggcaagattcccagcgtttccttcactcccgaagatcagcggttggtgtccggcgatccgggagcacgccgcaccatgatgaatcaggctgcggctctgctcgagcccggatacatgcagacgttgcaacagttcacgcgcatcgccaaacagcgtgccacattgttgaagcaattgaatgccaatgtcaacaatggccagccgatggatgcggttctgagcggtttggaaatctggaccggccagttcatcgaagccggtgtggcgttgacccgtatgcgcgctcatgtgatcggtctgcttgccgagccatttgccgcgatttacgccgacttggccggtgccggcgagcaggtgacgctcacttatgcgccttcattcgacgaagtgctgatgttcgacgatccgcatccgcagattagcgagcatttccaacgcatctaccccggtgaagtggctcgcggcgtgaaccttatcggtccgcagcgcgatgacatgaaccttgagttgggcggtattcccgcccgcgagttcgcttcgaacggcgagatgtggacgatggcgttggccttgaaaatggcattgttcgaaatagtgcgtgaccggttgggattgcagccgattgtgattctcgatgatgtgttcgcccagcttgacgacagccggcgcacgcagattcttgatttcgccagaaaacaggatcaggtgctgattaccgtggccgctgaaggcgatgtgcccgactatgaatcggcccatcgcatcgacgtggccgcactggacgaaccagcttccgtgatattgccaactctgggcaatttgtccaattcgcgggaaaatgagagtttgggtgggtatgacgaaaaaaccgcggtggacagcgcgtccgtagaacggaaagtgtcatgaacccgccgatcgcccgccaactcaacctggacgagaccaaactgccggccgaaatattcgagcggctctcccgtcgcggggcgaccttgaaggactacagacgccgccgtgaagaggccatcgaaaacttcggcaaaccggggcgcgatccggctgaactgggcagcgtgatgaccaccatcgccggcaacggcgtctggacggcgaatatgaagcttgcgcaattgcgcaaccattgggaccaagtggtgggtcaggccatcgccagccattcggcagtcgccgatttcactgacggcgtactgaccatccgcgccgaatccacggtctgggccacgcagctgacctaccttatcccccaactcaccgataccatccgtcgcaatctcaaaggattgaccatcaccgagattcgcgtgaccggcccggccgccggatacacacgcaaatgggctcggcggcggtagccaagataccaaacaaattcgcagaagcctcgctatggcgctcgtcgggttagacgagtaaaatcacatgcagtatggtcaaatggctagaagagccctttacgggcctcgtaagccatatcacctccgtgaatgaccttcatgacggaggttgaccctgtagtcacggaaggaagcctgttggcagacgaaaccagcaaagaggagcagctgaaggcggctgcggaacgcatcaacaatgcggaattgaccgaaggcgaacttgacgaatccatggcccccgagcattatgaggcctccgatctgagggtgctcgaaggacttgaggccgtgcgtatccgccccggtatgtacatcggttccaccggcccgcgcggtttgcaccacctggtctatgagatcgtcgacaactcggtcgacgaggcgctggccggatacgccagccatatcgagatcaccattctgccggacaacggcatccgtgtggtggacgatggtcgaggtatcccggtcgatgaggtgcccggcgagggcgtctctggtgtggagaccgtgatgaccaagctgcacgccggcggcaagttcggcggcggcggttatgcagtgtccggcggtctgcacggcgtgggcatctccgtggtcaacgcactctccacccgcgtggacatcgaagtgcgccgtcagggcttccactggacccagacgtacatcgaccagcaccccaccgcgcccttgaagcagggcgagccgatgaccgaaggcgagtccaccggtacgtctgtgactttctgggccgacccgaagatcttcgagaccaccatctacgacttcgagacgctgcgttcccgtttccagcagatggccttcctgaacaagggcctcaagatcagcctgaccgacgagcgtgagaatgaccaggccggcgacgaggtggccggcgacgccgcggacgagcccggcgcaaagcaccagaccgtcacctaccagtacctcaacggcatcaaggactatgtcgactacctggtcaaggtgcgcaaggccacgccggtggaagaggacgtcatcagcttcgaggccgaagacctgaagctcggcatctccgccgaactcgccatgcagtggaccaccgcctactccgaggccgtgcacaccttcgcgaacacgatttccaccaccgagggcggcactcacgaggagggcttccgcgccgcgctgacctcgctggtcaaccgttacgcgcgtgacaagggcatcctcaaggacaaggacgagaacctctccggcgacgacgtgcgtgaaggcctgaccgccgtgatctccgtcaagctcaccaacccgcagttcgaaggccagaccaagaccaagctcggcaactccgaggccaagaccttcgtgcagcgcgtgatgaccgacaagctcggcgactggttcgacgcccacccgaacgaggccaagaacatcatccagaaggccattgaggcctcccgcgcccgtctggccgccaagaaagcccgcgagaacacccgccgcaagtccatcttcgagtccgccggcatgcccgacaagctcaaggactgtcagtcgaacaacccggaagagtgcgagctgttcatcgtggagggtgattccgcaggcggctccgccatccagggccgcaacccgatcacgcaggccatcctgccgctgcgaggcaagatcctcaacaccgagcgcgccagcctggaccgcatgatgaagtccgacaccatcgaatcgctgatcaccgcggtcggcggcggctacggcgaggacttcgacatctccaaggtccgctaccacaaggtcatcatcatggccgatgccgatgtggatggtgcgcatatcgccaccctgaacctgacgctgttcttccgctacatgcgcccgatgatcaccgccggctacgtgtacgtggccatgccgccgctgtaccgcctgaagtggaccaagggcccgcacgacttcgtgtacaccgacgccgagcgcgaccgcgtgctcgccgaaggcaaggccaacggacgccagctgcccaagggcgaaggcatccagcgctacaagggtctgggcgagatgagctaccaggagctatgggagaccaccatggaccccgagcaccgcattctgaagcaggtgcacatcgaggacgccgccgcggccgacgagaccttctcgatgctgatgggcgatgaggtcgaaccccgccgcctcttcatccagcgcaacgccaagaacgtgcgttggatcgatgcgtaacggaatcctccaacctccctcgtcagagggaggtacacaacggacttagacaactaaaggaacaacagtggcagatgaaaacaacaccggcgacgagcagttcacgccggacggctcgatggagccgttgagcccgcaggaggcggacactaccgactacggcctgatggacaccggcgaacgcatccagcgcaaggacctgcagcaggagatgcgcgagtcctatctggcgtatgccctctccgtgatcgtcgagcgcgccctgccggacgtgcgcgacggtatgaagcccgtgcatcgccgcgtgatctacgcgatgtacgacggcggctaccgccccgatcgcggctacaacaagtgctcccgcgtggtcggcgacgtgatgggtaagtaccacccgcacggcgactccgccatctacgacactttggtgcgtatggcccagtcttggtcgatgcgcaacatgctcgtcgacggccagggcaacttcggctcccccggcgacgacccggccgccgccatgcgttacaccgaatgccgtatggccccgctggccatggaaatggtgcgcgacatcgacaaggacaccgtcgacttcgtgcccaactacgacggcaagacccaggagccgaccgtgctgccggcccgcttcccgaacctgctcgtcaacggctccgccggcatcgccgtcggcatggccaccaacatcccgccgcacaacatgcgcgaggtggcggacggcgtccactgggcgctcgaccacccggacgccagccgcgaggaactgctggaaaacctgatccgcatcatcaagggaccggacttccccaccggcgccaccatcctcggccacaagggcatcgaacaggcctaccgcaccggccgtggcctgatcaccatgcgtgccgtggtcaacactgaggagatcaacggccgtatgtgcctggtggtcaccgaactgccctaccaggtcaacccggaccgcctcgtcgtctccattcgtgaggccgtgcgcgacggcaagatccagggcatcgccgacatgcgcgacgagacctccggccgtaccggccagcgcctcgtgctcgtgctcaagcgcgacgccgtgccgaaggtggtcctgaacaacctgtacaagcactcccagctgcagcagaccttcggcgccaacatgctggcgctggtcgacggcgtgccgcgcacgctgagcctggacgccttcatccgccattgggtgaaccaccagctcgacgtgatcgcccgccgcaccgcgtacctgaagcgcgaggccgaagagcgcgaccacatcctgcagggctatctgaaggccctcgacatgctggacgaggtcatcgccctcatccgtgcctccgaagacaccgataccgcacgtacgggccttatggggctgctggacatcgaccaggtgcaggcggacgccatcctggccatgcagctgcgcacgctgacccgcatgaaccgcgacaagatcgtggccgagcatgaggaattgcagcgcaagatcgccgactacatcgacatcctcgccaagccggaacgccagcgcaagatcatcggcgacgagctcgacgagatcgtcgccaagtacggcgacgaccgccgcaccaagatcctgccgttctccggcgagatgaacgtcgaagacctgatcgccgaagagaacgtggtggtcaccgtgacccactccggcttcattaagcgcaccaaggccgacgaataccgctcccagcaccgcggcggcaagggcatcaagggcaccaagctgcgcgaggacgacgtggtggatcacttcttcctgacctccacgcacaactggctgctgttcttcacgaacaagggccgcgtgtaccgcatcaaggcctacgagctgcccgagggctcgcgcgactccaagggccagcacgtggccaacctgctgcagttcgcgcctgatgagtccatccagaccgtgctgtccatcccgaactacgaggtggccaagtatctggtgctcgccacccgttccggcaaggtcaagaagaccccgctggccgagtacgattccccgcgccagggcggcctgatcgccgtgcgcctcatggccgacgagaacggcgagaacgccgacgagctcatcggcgccgcgctgtgcaacgccgaggacgacatcatcctggtctccaaactcggcatgagcctcaagttccaggccgacgacgagcagctgcgcccgatgggccgccagaccgccggcgtgcagggcatgaagttccgtaacgacgacagcctgctggccatggatgtggtccctggcgactccgacaaggacctgttcgtggtcaccaacgagggcttcgccaagcgcaccgccatcagcgaataccgtctgcagggccgcaatggcctgggtatcaaggccgtgcaactggtcgagggccgtggtgctctggtcggcgcgctcgtggtgtccgaagacgatcaggttatggccatcatgaagtccggcaaggtgattcgctccaacgtggacgaagtcaagcgcaccgggcgcaacacccagggcgtgacctttgccaagcccgacaagggcgacacgattctctccatcgcccgtaacgaggagaaggacgagcccgaggatggcggcgatgccgcggcgaacggcaccgccgagaccgcacaatccggcgagaatgtgaacaacgcggacgaggcgtgagcagcgtcctgaaaagctggtagcctcgcatacagcagaggctaccgccaagcctgttaaggagaaacgatgagcgagaatctcgaagacaacgagccccggaccataccgccggcagtcggcaatacgcagaacgagcatgtcgagccgctgatcggtactgagcacgctccccgcgtggcacgctccgtgtccagcgatccggaagaatccgcgttgccttcttcaggtgccgccactcccgtgcgtccggcacctcgccgtagcgcccccagggctcgccgcatgagcttgtcgctgacccgcgtggatgcttggtccgtggccaaggtgacgttcatgctgtccatcgccgtggcgattattcaggtcgttgcctccgcgatcgtatgggtgctgcttgatgtggtcggtgtattcagccagattacgcagattgtgtcttccaccggtcttgatgcaggcggtttcgatctcaagaacgtgttgtcccttaccaccgtggtctccggcgtcaccatcttctcgattgtcgaagtggtgatcttcactctgctggccaccattgcggcactgatctacaacgtggtcagctctctggtcggcggtgtgcacgttacgctcggcgacgactgatatagctatactgacggaactctcctcagtgaaccgcaccccggttgttggactgaagtaattcagattcgatgatcggaggtgcggtttcttatgtgtggggatcgcaggcgtcgttgctgggccgagacttgggactccggcgacgctgggggtggcaggcgtcggtgttgggacagattttgtatctctgacgacgctgtggagggcttaccgtcgtcagcggtacagatcttggagttctgccgacgctgagggtgcgttctgtgtcgtatgcgtccaattcttggccctctgccgacgctgggcacagcaagcgtcgttgctgggccaagttttggactgccgccgacgcagagaatgcacacagtggtgttggtctgccagcgtgtggcagcttggcgccgctggggggggagtcatgagtcccattccaactcccccttattgaccacttaggggtgcatcccaacacatggggtgcaccccttttttcttgttgtgctacggggttccagtcgcatttttttcggtgatattttgaacgcgaagacaggctgggaaatgcccgatagtcgtgttcccctcagcaggtgaagccctgctttcaggctgcaaaaccgactcgggtgttccgaaagcggctttcgttgttgtacatcgatacataagagagaacacccatgaaaaacaccattattcgtgctgccggtgtgctgttggctgcaagcatgatatttggcggtgcggcagccactgcatcggccgcggaagcaacgtcgccgagcaccggcaccaccagcagcacgcaagccgcggaatccatcaatcgcgaatgggtgctgaatcctgcgaacaacactgagctggcggctctcggcactatacaaggcggatcccagacgttcgacgggctgaccatcgatgccactgcaaacggtgccaagtttgcgccgcgcgccaatgacacccagatcaacgccggaaccatcatcagcatcccggtgccagcccacaccaatacagccaccatcacccttgcgttgtccggcggcaccaccactattaccgcggatgccggtgaagtgagcagcgacaacacagttatcgccttgcctgctgcggagtcggctcgtacggtaaacgtcaccttcactgcccagacctatctcaacggcatcgcccttgccgaacagcagccggaacccgagttccccggtacgcccacggtcgcggccaaagacacgaactgggacttcacggaaaccggcatcgatcgaccggccgtgcagggcctaccgacaactaccaaggcgtcgccatcgacgctcgggcgcaaggcgccaagttcaacccgcgtactaccgcggcaagcggcggcagcgatactcaggtgaacgctggaaccatcctgtacattccggtcgcacaggccgagggcggcgctacagtcaccgtgaagggccagctgtacggtcctacgctcaagctcgacggtacggacatcaccaccggcactgctgtaaccatcgcaaccgacagcacgcgctacgtgccgctctccgttgaaggcacgggcagcctgtacctgaccggcatcgccatcgactacgcggccggctcccccgccgccaccagccacacggtcaccgtgggcccgaacggccagtaccggaccattcaagccgctctggatgctaacgactcttccgaaaccgaccgactagtgctgaagatcactccgggcgactatcgcgagaagatcaccgtgaccaagccgggcgtcaccttcgccaacgccgacgtgaccgccaagcgcgcggtgacgattcgcgccagctactattcgtccaacacattcgatgccgacggcaagtttgtgccgcaggatgaattcgaccttggcaccaacaagtgcgccaccgtgaccattggcgcgggtgccacaggtttctccgcctacggcatcaccttccagaacgattacaacgtggtggatcacacggcggcgggcgagcagacgccggccgtggcgctgaacacccaggcagacaaggtgtacctgaagaacagccgcatcatcggccgtcaggacactctgtacgtgcagggcgccggcaaccgcgtgtacgtggacggcggctacatcgaaggcacggttgatttcgtgttcggcgacgccaacgcctacttcgccggcaccgagctgcacatggccgcgttcgccggcaagaacaacggctacttcaccgccgccaacaccaagaagtccggcgtgggcctggtgtttgaccgctgcaacttgaccgttgccgcagcatatgacgacgatgccaagctttcgctgggccgcccgtggcagacgttcgcgcagtacacgcaggtgcgtaagggcgacggcagcagctatgtgaccggcgtggatttgggtacgaagaactcggcgtatacggacacttcctcggccgtgacctacctcgacagcacgatgtccagcaagatcaccaagaatcgttggaatgtgtggaccagcaagaaccagagcggcaaaagcgtggacgtgaccttccacgatgatgtgcgattcgcggaatacgccagccacgatgaaaccggcgcgctgcttgatccggctgattataagaacgtcgtgctcggctcgatgtctgctttggatgaggctcaggtgcaggcgaagcgtgctgaattgctcgcggcactgggcttcggctcggcggctggtcagtgggttgtgccggatggcgcgtggccattcgcttacgacccgaactactcgaccggcactgatgtgcagccgactcagccgggcggcaacgcctcgcctaacgcggattcggcggccaaggccgacaccatgccggaaaccggctcggccatcattgcggtggttgtagtcgccgtgccgctgctcgttgctggcttggcgctggtagcagtgcgccgcaatcgccagcagtgattgaaagcgttgctgcgaaccggacctggtgaccttgtagacggggggctatctccgttgaaagaggtacattgatggctttgcagaaagccaactgctttcaaaggggtacctgaaccacgaaacctcgagtataagcgttgcaatgacggcgtttatactcggggtttcccatattcagtacccctctgaatgcagttagcttggatcgatgatcatatccaagaattcactcgtatagtggtgcgtaatgcttacgtatttgggatagcacttgttgctcgttgtacatatagcaatgcccttgcctcctcacggggaagcaagggcattacgctactgcttagtactgcttagtattgctcagcactgctcagcgattgctcagcggcaagcgtcacagcacgccctgggcaaccatggcgttggcgaccttgacgaagcctgcggcgttggcaccgagcatcaggtcaccctcgtgaccgtattccttggcggcggccagggagttggcgacgatttcttccatgatggacttgagcttggcgtcgacctcttcgaaggtccaagacaggcggtagctgttctggctcatctccaggccggagacggccacgccaccggcgttggcagccttggccgggccgtacagcacgccgttcttctggtagacctcgatggcctccggggtggacggcatgttcgcaccctcgacgaccacggtcacgccgttgtccacgagcttctgtgcggattcgccatcaacctcgttctgggtggcgcacggcagagcgatgtcgcccttgacggtccacacgcccttgctgccctcgtggtactcggagcccggaacgcgctcggcgtattccttgatgcggccgcgctcgacttccttgatctgcttgacgacctcgacgttgatgccgttcgggtcgtagatgtagccgttggagtcggagacggtgacgaccttggcgcccaactgctcagccttctgagcggcgtaggtggccacgttgccggagccggagatcacgacggtcttgccctcgaaggagtcgttgcgcagcacgcgcagggcttcctgggtgtagtagcacacgccgtaaccggtggcctcggtgcgggtcagggaaccgccgaattccagacccttaccggtcaggacgccggagtactcgtcgcggatgcgcttgtactggccgaacaggtagccgatctcacgaccaccgacgttgatgtcgccggcgggaacgtcggtgaactggccgatgtggcggctcagctcagtcatgaaggcctggcagaagcgcatgacctcagcgtcggacttgcccttcgggttgaagtcggaaccgcccttgccgccgcccatcggcagcgtggtcagggagttcttgagaatctgctcgaagccaaggaacttgacgacggactcggtcacggtcgggtggaagcgtagtccgcccttgtacgggccaatggcggagttgaactggatacggtagccgcggttcacctgaaccttgccctcgtcgtcaacccaggccacgcggaacttgatggtgcgctccggctcgacgatgcgctccagtacaccggccttctcgtactccgggtgcttctcgacaaccggctgcagggtctcgaagacctcgcgaacggcttgcaggaactccggctgatcgccgtcacgggcaacgacctggtcgtagacacgcttgatgtactcgtcagtgagcatgattctcctcgatttgctagggaattaagacggttttattctatgcgcgcaggcccttgctgcatagagtctcgctcggataacgggaaagctatcggcgtggttatggggtggttcaagtttccgtttgttagatttttcggcgattgctggatgtctgtctgtgcgtgaatcgggtcgaaatggaagctgcatcacaccgaaggtgcgttcatatagtggacataaaggtggacttgggtgatgtcggatgtgcccgttgggaatcgtgcgccgtaggggccgaggtcttcggcgcgcaggttaccgggttcgcggtcagtgcgcgaagtaggtctgcagaatcatcgtggtctcggtgcttaccggcaccgtgcggtggatgagattgagcaattcctcaagggcggtgggggaggccacgcgtaccaccagtacgaagctgggggcgccggccaccgaatagcaggagacgatgccgtcgatattgttcagcttgtccggaatcgaggattcggctgagtagtcgagcggggtcacgttgacgaacgcgctgatgggcaagccgcgctgctcttggtcgatgatggccttgtatcccttgatgatgccgcgcttctccagcttctgcacgcgcgactgggcggcggagacggacagtccggtcgcctgggccagttgcgcgagcgtggcgcggccgtcggcctccagcatggtgaggatgcgctggtcggtctcgtcaatcgcggtcatggtgtcttctccgttcgttgtgctctgtgttcactgtacctgttgccggaatgcgatggctttccgattttgcctggtaatttcagtagttcttcctgtgttttctgttgtgtggtggaatgtttatgcctaaagtcctaattgaatgtaataattccttctaaaataagagaacgacgaaataattccattgaggagggatgatatgcagaagttttccaacatgcctctgtccgaagttgcatctgctgctgtgcctgctgccagacgggttgctgtgccgaccgccaagcccgcgagcttgtccgccgaagccctgaatatcccgcgctccggcatccgagacgtattcgaccgtgtagagcgcgtgcctgacgcgatttcactgaccgtgggggagcccagcgccacggccgcgccgcatatcgtggcggccgcttgcgaggccgcacaggctggccgcactcggtacaccaacgtgctcggcgtccccgaataccgcaaggccgtggccgattactccgcccgtgtgaagggactcacttatgatcccgaaaccgagattcaagccgttgacggtgccacgattggcctgtttctggcgctgaaagccgtggtaggcaccggcgatgaagtgattattccctcgccgttcttcacttcctatgacgccgaagtgatgctgtgcggcggccgcccggtcaccgtggcgctgcgtccggagcacggcatgcgcgtgaacgcggcggacatcgaagcggcgatcaccccgcgcacccgcgccgtaatcatcaactcacccggcaatccgaccggcgcggtaacttctgccgctgaactggcgcgtattgccgaagtatgcaagcagcacaatatttgggccatctccgacgaggtttaccatccgttcgtgtttggggaaacgttcggggaaacgcttgggggagaggcagccgtggcaccatcgattgccgcggtgccgggcatgaaagaccgcaccattgtggtggaaagcctgtcgaaaacctacgcgatgaccggctggcgcatcggctacctgctggcacccgaagcggtcatcgaacagaccggtaaaatcgccgaactcatgcactcctcggtgaactccttggcgcaatacgcaggcgtggcagcactggccggtccgcaggatcatgtggccgccatgcgcgaggaataccgcgccaagcgccagatcgtgctggacggtctggccggatgcccggtattgcgcttgattgaaccgcaaggtgcgttctacgcctttgtggacgtacgcctgactggccttgactccggtgaattcgcagaccgtctgctggacgaagagcacgtggccgtggtccccggcgaggccttcggcgaggaggggcgcggcttcgtgcgcctctcctacgccggagatgccggcgagctgcgtgagggcgtcgcccgtctgcgcgcattcgccgaacgggtatggaaccccatcaccggacaccacaccgccacttatcaccccatggaggtgttggcctgaggcttaaagcgaggctaggccgccaattcagactcgtcggcgcgagcgatggcctgctcgtaatccttggtgcctttgaacacttccttggtccacgggttgatgccctgcttcttggcgcgtagcaggatgtagccaagtgccagcacattggccgccaacgcgattaacgagactgcaaggttcacattcggattgttcacggactgggtggagaacatggaatagtcctggaacatcgggaacacctgcgcgaacatgcaccagatggccagcgtgttggcgcggttctgaatccaaccgcccttgttccagaagaagttggccacggtgggtgccagcagcagcgccaggccgcaataccaggcgtgggtgggcaggcagttgtaggtgtagcagaagttccacaggtcgtaggccacgatgaacacccaggtcatgtccggccagagcatgtcgtccttcttcttggaggcgtagatgccgaaccagccggtcatgcagaagatgttgagcaggccggccacgccgttgaagacgttgtgccagccaccgtacagggtcacgccttcggtggagatccacgtggtgccccagccgcggatggcggattcgaagtcggacactacggcaatgaggatgttgatggccacgatcacgaacgggaagcacttgaaccagtgcgatttgccgatggatccccacttgtatttgagggccatgaaaccgatgcagccgatggtggccgcgtacagcttggcatagtggaaccagctggtcatgtgtacgtaggtcgggttgttgagggcccagtcggcacccatggcggcggccgtgtagatggtgatgaagtagacggtcagcacggccggtatgacgaggaaggcgataacgccaccggttttggtgcggcgggccagttcgttggcgccgataagacagcagaagacgagtatccatccgatccattggtagatggcgttgtcgccgtagacctgaaacagcataagcggtcctttccgtgtgtgcgctgtgcgcctcgcagtcctccattgggttgctgagacgcctatagacgccgctatgttgacgcagcgtcaatttctctcacggcacagtctagcctcaagttgacatcgcgtcaaaacaaccgcattaaggctgccgcgtttcgtatcgttacgcgtaggggctggctgaggcgtaatgctgaagagtaacattgaagcaatggcaatcaagccgatttgaggaagagaagcacacgatggcgtactgcggccactgcggaaatagagttgataggccggcacgattttgcccggcatgtggagcgtctgtagacagcgcaccagttgcggcggcaccagtaccggccgcatcgccagccgtatcgcctgcgtcgataccggcacctgctgtgccggcgtctgcggtaccaccatcgataccagccgcgccggttgccccatcggtttacgccgcgtccgctgccccacagccggcaccaaccgttcccctgccggctttgccgattcccgctcctgccgcatatcaggcgactgatgcaaccgccgtcctggcaccgcagcgcaaatccagcaagaagctgatcgccgctctctgcgcattgcttgcgacgattctggtggcggccttggcgttcatcatccccaacttcaccgccgtcaaagcgatgctgggcttccggcccaccaatccgctggtcgtcaccttcgacgcgatcaactcgctgtccactctgcgcagcaccaaatacgaactcagaacccacagcagcactgacgactcccttgacgcgcggatgtctggcatgtattcgctggggcaaaaccaccaatgactcctccgcgtctgtgaccatcaagacagatgaacaggcaacaaccctcgcttggcacaaaggcgcattcgccgggaaaaacgtttggtatgatgacgacccctactacatctactacccggccgaccaatatgaagatgacttaaggaacggcgttggtagtgatgtggcggacttgatattgaacgtcaaggatgcgttggtcaagaacggtgcttgggacatcaccggcgcggagcgaacgttctacgatcagctggacaagatgaacgacgatgggtactcgaacgacatcgaccgggccaagggcacgaaaacgtctgccgaggtgaaggccgaggccagcaaattcatccaacaatatctcggcgtggagctggaagataagaatgtgcgcagccagctgttcccgaatacatcgtctgccaagtctgccggcaacacgcagctctcgtatcaaatcgatgtcaaggcattggcccagcactttgtgaattactggatcagccatgaagcgcagtatccgcatctgaaatcatgggtgattcagcagatcgaggataccggtgtgggcgatgctgaaggcgagtaccgtcaggcgctcgacaatgtgcgcaactgggacttcggcacggatgaagagccggatatgccgactatcaccgtggatctgaactacggcaggaagcgtctgatgagctcgattgccgtaagcgtgtccggcaaggacgaatacggcgactcctacaaaggttcgctgtcgttgacgctcagccagcagaacgcggtgtctgtggacgaccccgatttgactgatacggtgagcaaagccaaggacaacaacgagctggatctgtcttgagcagaatcagaatgtgcggaacgccgtgaacagatcatcgacgtgacgtcgcatgtgattcacagaacgggttttggggcttttccgttcgtcaggtagccgaagcatgcggattgaccgagccggcggtcatataccatttcaagaacaaagtcggcttgctgattgccgtgctggagcatcgtgatcgggaagacatggctacgtttgcccattctcttggcgttgaacctgaggatatgtggagcggcaacgcgcagttcggcattcgtgatatctgtgctgcccttatggagcgcaatgcggctcagccagagatggtgcggttgtatataccgtgctacaaggcgaatcgttgaacgagcatcatcctgcctatgagtattaccaaaaacgagaacatcgcgtgatggacaccttaacccgagcagtcgagcgtgacggtttggcagatcctcgtcgcgaggcgcggactgctttgtcgatgatgaacggcattcgggtccgtttggctcagggatcgggcatcggtcgatttagtggccgattggaatgcctatgccgacttccggtggcctcgacagtcgtgaggcaataagacttttctcgtgagatacgctatcggcgtgtcgtcatctttttgttgcaatacgcagaaaatgcaagaacaaaaacccttggaatcggactgattccaagggttttgttgtgtctgtggagctagccgggttcgaaccggcgaccctctgcttgcaaagcagatgcgctaccagctgcgctatagccccgtgagaaaaaaagagcggctcgcggccgcttcatttttcctgtgggcccgggaggacttgaacctccgacctcatccttatcagggatgcgctctaaccagctgagctacgggcccgatccatacgcttcaaaagcgcacaagtgattacaataccattgaacggcggtatgtcaataacggcgtgtcgcgattgtcgcttgcgccatgattgccggcgcagcggagcatgacgagtgcgatgaggctgttcgcgtggtggaagccgtaggccatgcggatggtgaccttgatcctgttgtcggacgcctcgagcctggcgttggagtagcccagctcgatggtcctgaggatgtcgggccacgacggcggatcttccgggatggcttgccgctctcgtacaactgcacgatctgccgtttgaacgcctcgtcgtagtggcggggatgtttcgggtcggccatcgtcggcctccaatctcatgtcattcgtccctcatcggactgtctaatacgttgtagccaatccacggcgtcacatcgtcaggctgtccgggtcgaggaggaaatcgtagacgctcatcgtgaggatgccgtgctcgtcgcggacgggtttgaccacgtcgcgtacgaggacgatcttctggaagctgtcatcgatctcgagcagcgaggcttctcctgcgcgaccttctccggtgtgggcagttggtacgcggattggtcagggcgccgatggaggaggccagcacgtcgaccaggtcgtcgagctcctgcgacctgcgcagcccgttgcgcatgcgcagcagcccgttgatcaccccgtacagacggggcggctcctcgccgcgcgtacgaacgcagttcatgaagaattacgagtgattcgtcgaagtcttcggcgttacggccgccgcctgagccagggcggcggccacttgttcgttgacggctccctgctgtgcgatggtgacgcggatgcctcgactggcatgcgcgtccacgcccgcaccggcccccgcgtcggctccggtggcgtcggcgctgatacgcaggctcggcaggaacggcttgccggcggccacacggatgccctgttcggccagcagtcgcagcgccgccggctcgtcgcgcaccggaatccacagattcagtccgtcaccggtatgcacgtccaaactttgacgcagcagcagcgcgtgcatcgtcttttgccgggtggcgtagatatgccgggcgttggtcaccgtgtggaacgcctctttgtcggccagcatttcatacagaatctcttgcaggaaccggctcacccatcccgatcccaagcgtcgttgggtgataatcgcctccacggcatcctccggcccagacagcgcagccaagcgcagatccggcccgtgcgacttcgaaaaactgcggatatgcaccacgtgttgcggcaatcgttgcgccaacgatgtcgcatacgcattggccacatcgccactgtgatcgtcttccacaatcagcggcataccaacgccattcgggtagtgcgcgagcagcacgtccgccaaagcgtcgatgcgttgcgggctgaagctggccccggtagggttctgggcgcgcggctgcagcaggatcatactgacctgatggccgccgtgcggcaccgccagacgctgcgattccagcatggtcagcgcacggtcgagtgcgtcgggcagcataccgaacccgtccatcggcacgccgaacgccatcgcgccatgtgcctcgatcatgtcgagaatcagcggatattccggtgcctcggtaatcacaaaatcacccggctgaacaaaagcgttcatggtgtgcgccaaaccgtcgcccgcgccggatgccatagtcatcgcctccggctcatacggccagttgcgtcgcaaaatctgttccagcatgggcaggatggtcggcccgtcgtatgaattgacgaatgccttgtgcgtgccgagcttgccgagaaacgggcggatgtccggcagcagcgaaaggtccggcgtgcccttggacaggtcgataatcggtcggtccggcgcggtggccggggcttcggccagcaagtcgccggcatcgtagcgatgcgtgcgcgactgccgcagtacgaatgttccggcgcgcccgcgggagcgcagtatgccggacctggcgagggcatggtaggcactggagacggtggccggactggtgcgtagcagtcgggcgagatcgcgtacggtgggcatgcgctggccttccgcaagtatgccggaggaggtcagcgaggtgaccgattcgacgatgcgttgcggggtggccgtcgcctcggtggtgaggatgagtgaggataactggccggcatcaacggccaggtcgtcggtggaacgcaggggagcggccgtaatgcttggctcatcgttgtagccgacggcatgtgcggttgtatgcggttgatggcgatggcgtatccatgatctgcctcccggatcttggcggcgagcgtgatgagcgcgcgtctgcgtgaatgttgccgattgccgccggctgatgatcgatggcggttgccggcttgttgctggctgcttgactgccgatagtaacggtcactgtggcaacggtagtcaaatgttagcgccgcattgtgcaatgagtatgtttttgaataacataaacattacataatctggatacaattattgttcttgttcctatgtttcaaaatgatttcgtattcgccactactgtaacattattaaatgttcgagtttgacgcgaaatgttcaactctcataatgacattcacagcgcgttgctgccctgacccgatccacgggagacggcatcgggcacttcgagaaaatatcgaggaaaggacacatcatggggcatgatctttcgcaggatgcggaaatctgggacgacgcttacaagctggaccgcgcacacgtattccattcgtggcacgcacagcgcaacctggatcccactgaagtggtaaccggttacggcgtgtggctgaagtacggcgacggccgtgaaatgctcgacttcaccagccagcaggtcaacgtcaacatcggctaccagcacccgaaggtgatcgagggcatcaagaagcaagcggaactcctgtgcaccgtcggacctgactacgcgaacctagcccgtggccgcgccgcctccctggtggcccgccgcgctccggaaggcttcgacaaggtgttcttcaccaacgctggcgccgacgccaatgaaaacgcgatgcgcgccgcccgcctgttcactggccgcgacaagattctgtcttcctaccgctgctaccacggcaacaccggtgcggccatcagcgccaccggtgactggcgccgtaagcccaacgactactctcgcggccacgtgcacttcttcaccccgtacctgtatcgctccgagttctccgcaaccacccaggaagaggagtgcgagcgtgcgctggctcacctcgagcacgtgatccagttcgagggcccggacaccatcgccgccgtgctgctcgaatccgtgccgggcaccgcaggcatcatcattccgcccaaggactacttcaagggcgtgcgcgagatcaccaagaagtacagcatcctgatgatcaccgacgaggtcatggccggcttcggccgcaccggcttctggttcgcactcgacgactacgactacacgccggacatcatctccttcgccaagggctgcaactccggttacgtgcccgccggcggcgtgattatgagcgacccggtggcccaccgcttcgacgacatcgtcttccccggcggcctgacctactccggtcacccgctggccatgggcgccatcgtggccacccaggaagccatggaagaggagcacatcgtcgacaacgcctacaccatcggcaaggacgtgctcggcccgcagctcaccgctctgtacgacaagcacccgaagatcggcgaggttcgcggcaagggcgtgttctgggccgtggaaatggttgccgaccgcaccaccaaggagccgctggacgacgccacgatgaagcagatcgtggccgaaggcgacaagcgcggcctgattctcggcgtgcacaacaaccgcatccacgtcactcctccttgcgtcatctccgccgacgaggcgacccagggcgtcgagatcctcgaccaggtgctgaccgcggccggttgctgattgggtgactcaatggctcggtgacggtttgtagccgttgccgacagcaccgttcattgctgatggcggcccgttcggaacgttaggttccgggcgggccgccatcgttgtccgccgttgtgcgagaatgacttgcgtgccttatcgccgtcgtcaatccaccgctccgaagtccggtgcgccgaaatccgttcggtccgctgccgccgggcagtcgttggatattgatggcatccatctgcacctgacgcgcaaacccatcaaaaacctgtatctgcgcatcaaaccgccgagcggccgcgtcgaaatctccgcaccgatgcggatgagcgagagtcgcattgcggatttcgtcaaagagcgacattcgtggattctcgcccagcagcagcgcatggctgaggcgcaacggcgctccatcatggcattgaacgagggtgccggcttcgagaacggaggtcgtggtgtagctggtgccagcggccatgatggaggcgttgccggtcgtccgaaaaccggtgatatcagtcgtccgggaattggtgacgccgggccaggccaagccggtacgaatgtccaaccgtattttgaccgctcccaaatctggaccgacgaacgcaaacgacaagcggcggccgcgatcaacgccgcgttgccacagctgctggccaagtgggggccggtcgtcggccggcagcccacgcatatcacgctacgggtcatgacctcgcgctggggatcgtgtacaccgcgaaccggccgcatccgtctgaaccttcaattgggactgatggaaccgcaattcctggaatacgtcttggtccatgagatgacgcatttgtgggaaagcggccacggtgccggattccagcgccgcatgaccgcctacctacccggctggaagacgctgcgccgcgacctcaaccgccgcgtggtgctgtgacgatgacgggtcaggcttcagtgccggcgatgtggctgatggcctgatcggattcgttcgcatggtccgaatgcgccaccatctcgatggccgccggacacccgctcaccgacgaagaccgctggccttggctcgacaccatcgccgcgtggatcgacgagcgcgtggccgccggcgatcccgccgtggtcacctgctcggcgttgaagaagatctaccgcgacaagctgcgccgtcaaggcgtggtgttcgtctacatgcagggcacattcgacgaggtgatggaacgcctttcccaccgccaaggccacttcatgaagccgagcatgctgcaatcccagtccgacattctcgaagagccgggcgatgacgaaattcacgtcaacgtacacatcggccaggccgatcccgaacacgaggccatggccgtggccggtgccctcggcctgtgagccatctctcggctccccttagtctcacttcgccacacgtgcggcgcatcgacgaactcgaacggcgcatcagcgaacttcagctggagctgaagcagtgtgaaggccagcaagggcgaaccggatcggtccaaacgggctactcaggccgaccagcccagccagtccgttcagaccgacctaactgatcagagcgggccctctgaccagtccgaaccatctgaccgacatgtacttgttgactaagtgtgcggcccgtcattcgttatggaacatgccggccatgtatacaggcaggtaggttacattcccttcgactgagacgttgcacgggccaagcacatagcctgtattgagatggtattcagggtgggcgagcacgttgtccattgcgcgatggcgtttgtaggatttgccggacttcacctcaatcggcagcacgtgatcgttgcggtcttggatgaggaaatcgagctcgccaagcttcttactgttgtagtagtacaggtcaaatccgtgagcgcgtagctcttgggccaccgcattttcatagattgaaccgtagttgatatcagggttgccgtcgagtacgtcgagcgcggttttcttgagaaacgagccggtaagcagacccacgtcgttgtaaaagagtttgaagaggttacgttccttgctcatctccaacggtgtgcacggttcgtccacgttgtacgcggcgacggctacatccgcattgaccagccaatcgaaatcggaagcaaccgattggaatctcatgttcttttcgattttggcgaaggtaaagcgcttgtttgggttatttaactcgctgggcaccaaatcgtagatagcgcggatatgcagccggtcttctttgcgcgcgtattggctgatatcgcggcgatattcacgctttatgttctcttgtatagtgcgcacgtccgcaacgctgccgtttgccacgaacgagtcgactgcggcaggcatgccgccgatgaccagatatttggagtatagctccatgagcctttgatgaatgaactcatccacttcctggtgcttggcaaagcattcggcaagcatatcgaatacgtcgttgccgatatgctgcgaccagcagaactcttggaaatccagtggatacatatccagctcggtcaggtacccgaccggtaccgagcgtatatcttcgagctcgactccaagtagcgagccggaaagcgcgtaatcgaaccgaccatcatctacaaggaacttaattgcggtgaccatttccttgcaacgctggacctcgtcaaagaaaatcagggttttgccgggtactaatggcgtatttacggccagttccagcctcatcagtaggtttttggcatcgcggggccgatcgaataatgcaacgaggtcagggttctcgatgaaattgagctcggcgatatggtcgtaatgctgttgggcaaagtgcctgatgatataggttttgccaatctgacgggctccggtgaccagcagtgcagtgcgtttcggcgcggatctccaagcttccagctgtgtctcgatttttcttcgcagcatgagaatctccagtcatttgtaggccttgcatctatgctgggcacgttttccaactgtttatagcgcatattttacacttttccaaccataagaatgcggttttggctacgttttccaacctcaaaatggggagttttatacacttttccaacttatgtatgtggagactctctatttcacgtgagacgaaagtggctcccctctttgaggggagccacggaatactgcttttacttatgccaggtgagagcgcatgaaccactggaacttttcgagttcctgcacgtggtcctggatgatgttggagctgatcacatccagctcgtccagctcggcgatggccttgcggtcgtcggcgatgaaggcgtcatagtactcgatcagcgccttgagatactcctcggtgcccacgcggccctcggcgtcgaacgacttccacgtgcggttgcgcacgatggcgtccgcgcggccgtccggggtgccgcccagagtggcgatgcgctcggcggtctcgtcggcctgagccagcacggcctcgacctcggggtcaagcatctcgtgaacggcgatgaagttcgggccggtcacgttccagtgtgcgtgcttcaggaccagagcggcctcctgctcctggctcagtcggttctgtaggatggcgatggccttctcactggccgcttcatcaaggcccggcacaacaaacgcaagtgtcataatgttccttctttcagtaggtggaacctgtccatataattctacgatttttggttatgccccgggccgaacgaataggtggtgaatatcacgtggctagttggcatcgtcgctttgtgattcggctggcagtggcgcatggtccggggcaccggctttgcggacttcgatggtttcgatgcggcggccatccaccttggtgacgaccatgttgtagccgtcgtcggaatgcagcacgtcgcccaccgcacccatcttgccggtcttggacaggaagtagccggcgaccgtctcgtacgggccgtcctccaattcgatgccggtcagatcggcgaagtcctcaatggtcatgctggcctcgatcgtggccacaccattgacgaacgcggtgcgggtggtgcgttcgccgcccttctcgctgggcagatcgtactcatcgcgaatatcgcccacaagttcctcggtcatatcctcaagcgtcacgatgccgtccgtgccgccgtactcgtcgatgaccacggccagatggatgccgcgcttacgcagcagttccaggctcggcagcagcttggaggtgccgggcagggagatgccttcgcgcaccacatcgcgcacgatcttggcgttcggatcgcgcacgtccagcagatcgcgcacatgcacgaagccgatcacgtcgtcgaaatccttgccggtcaccgggtaacgggagtacggctggtcgcgtacgaacgcggcggcctcggccaagggctggtcgccctcgatgaagaccacgtcggcacgcgggcgcatcacctcggcgacgatggtttcggacgcgtcgaacacatcgtccagaatcgtgcgttcgtccttggaaaggttggtgttggagctgaccagcacgcgcagctcgtcgtcggacacctcggactcggtctgctgcgggtcgaagccgagcaggcggacgatgccgttcgtgttcttgccgatgagccagatgatcgggcggcagacggcggcgaaggcgtcgatggcgggcaccacggcgcgcgcgatctgctcggtgcgctgcatggcgatgcgcttgggcaccatctcggagatcacgatggagcagtaggagatgatgagggtcaggatgatgttcaccaggccgccggcgatgccggggtgcacgccccagctttcgaccaccggaatcaggtagggggcgatggaggaggcaccgaacgaggcggacaggaagccggagagcgtcacgccgatttgcacggtggagaggaaggtgttcgggtcacgtgcgattttggcgactttggcgccgcgagcgtcctcctgctccatttgctcgatctgcgagccgcgcagagagaccaatgccaactcggtgccggagaacacggaaccgataacgagaaatacaaaaatcaggaggatgttcaaaccaagtgacatggcttcaactctaggggagcggcacgtcaaattggggtgtgctggctgggcagtaagaaactcggcaaagggaagggcactcttatcattaccgcggccgacgtgtcgaccggtgtttccgatgcgttgctcgccttcgacgatgccgtatgcgctccagcgctggacggcattactagtgcagagaggctgtttctcgcggctatggccaaggattcgccaaatcccacgcaggttggcgatgttgcggatcgcacgctcagaagctcagcacttctactttgccggaatcgagctgatagcgggcgccgacgatcatgagcttgtcagcggcgagggcctgctggatgacaggagactgctccaccaaagtttcaataatgtgggccacatgcacgcgctcgatgtcttcatgcgcgtcgagctcggcttcgcgcgcctgccagacggacatgccggcctggcgcagaataatcgattcggcggcggcgatgtgctcgtcgaggtcgtccatcgcatccgcggcctccagtgagccgtcggcttcggaagtgatggtgtgcatcaggtcgtccagctcctgctcggcggcctcgattgcgccgcagtgctcgtgaccgagcacacagatcaggctgacgtgcagtttcttgaccgcgtactccagcgaggcgataaccgcgctatcgatgagttgcccggcggtgcgcacggtgaacaggtcgcccaggccctgatcaaaaatgatttccggaggtacgcgcgagtccgagcaggagagcaccgcggcatccgggttctggccatcaagcaacgtttgacgggtctcctgatcctgccatggatggtcgggcttgccctcggcaaagcgccggttgccttgcagcatgcgactccacgttgcgtttgcggtcgattcctgttcaaagtctgactgagccatgaaacctccattatcagcgggctgctgattgccatattagcgagtattcgcgcatagtcgtgattggggcaacggccatttgggcacaagggttgcgggtggtgtgataaggctcatacgttacacccgcgcgagccgtggctcaccacattacgataggtggtggtaaacgcttgaagattaacaattcccgaaaggaccgatgatgactcttctgcagcatgaactgaccgatttcaaggtgaacgcattccagaacaatgagttccacgaagtgaccaaggacgatgtgctcggccactggtccctgttcttcttctacccggccgacttcaccttcgtgtgccccaccgagcttgaagacctggccgagaactacgccaagttcaaggaaatcggttgcgagatctactccgtctcctgcgacacccacttcgtgcacaaggcttggcacgacgccaacgagaagatcgccaagatcgagtacccgatgcttgccgacccgaccgccctgctggccaaggatctcgacacctacaacgaggccgatggcgtggctgagcgtggcgacttcatcgtgagcccggagggcaaggtcgtggcctacgaggtcatctcctccaacgtgggccgcaacgccgaggagctgctgcgccgcgtgcaggcctcccagttcgtctacgagcacggcgaccaggtctgccccgccaactggacccctggcgaggaaaccatcgagcccagcctcgacctcgtcggccagctgtgatcgacactgaataggcggtaaccttggctcccctctctgaggggagctgtcgctgaaagcgactgggggagtgctcgcgagagctagcctgatccgatatgctcccctcagtctcactacgacagctcccctcagagaggggagccagtgtatgtaagggagttttcatgactcagaccaacaatctctatgacgtcgtcgtcattggtggcgggcctgctggcctgacggccggcctgtacctggcccgcgctcgctaccgcgtgctgattctcgaaaaggacgatttcggcggccagatcaccatcaccaacgaagtcgtcaactatccgggcgtgggccgcaccacgggccgcgcactcacccagaccatgcgccagcaggctcaggacttcggtgccgaattcctctccgccgaagccaccggtctcgacgtggatggtgacatcaaaaccgtgcacacctcacgcggcgacctcaagaccttcggcatcctcatcgccaccggcgccagcccgcgcaagctgggtttcgagggcgaggccgagtacgccggccgcggcgtggcctactgcgccacctgcgacggcgagttcttcaccggcaaggaagtactggtggtcggcggcggattcgccgcagccgaggaatccgtgttcctgaccaaatacgcctccaaagtcaccgtgctcgtgcgcgaaccggacttcacctgcgatgccgcagtggccgccgaagccaagaacaacccgaagatcgacgtgcgttatcaggttgagctgaagggcgtcaccgccggccaaggaggcctgcgagaagcctcaatcctgaaccttgccaccggccagaccgaaacgtggaagcccgccgacgccggcaccttcggcgtcttcgtgttcgccggctatgtgcccgccaccgatttggtgcgcggcgtggtggagctcgacgaccacggttacgtggtcacgcacgactacctcagaacctcggtgccgggcgtgtacgcggccggcgatctgcgcgtcaagaacctgcgccaagtggtcaccgccaccgccgacggtgcgattgccgccgtggaactggagcgttacgccaagcagatgagcgagaaaaccggcttggtgccgccgcgtcccactgcttccgcttatgaggagtccgaggccaaggccgcctccgccgcctcggccgctggcacgacgcccgccccggctcccgccaaacgcagcgccgatgccgcagccgcagccagcgccgccaagaagcccggcgaactgttctccgccgccgtcaagcagcagcttggcgtggtcttcggacgcatgacccgcccggtcacgctcgctctcgagctggacggcactccgctttcggcggaattgcagggtttcatcggcgagatggttgcgctgtccggcggcaagctgaactcggttgccgttgatgccgcagggctgatcacggcggtggatggtgcttctgtgcctacttctttggtggtcggcgaaccgctgtccgtcaccttgccggacggcaccgaactgcccacttatggttcgttggacgattccggccgcgccacattcgacgtcgccggcgtcctgccgctcgcccgtccgaccgtgcgcatctgcgtgccggctgagggcgacggcaaggccggcaaggacggcaatggttcactggtcttcaccggtctggccttccacggcgtaccttccggccatgagttcaactcgttcgtgctcggcctgtacaacgcggccggtcccggccagccgctgggcgacgacctgatcgaacgcgcgaagtccatcacagacccgctgaacatcatgatcctcgtctcgctcacctgcacgatgtgtccggaaaccgtgcttgcttcccagcgcattgcctccctgagcccggccgtgcgcgccgaagcctacgacgtctcgcacttccccgaactcaaggaccagtacggcgcgatgagcgtgccctgcatcgtcatcacccacgccgacggcacccagcaagttgaattcggcaaaaagagcatcccccaaatgctcgaactggtcggcgcgtaagccgcacgacctcaggtactcaacagcaacaacaacgattctgccaaaatcgtgacgtacatcgattgatgcgatcgatgcgcccgactccggcagaatcgttgttttgcggcagctcagcctcggtcttcgacggccttcgtgacgtttctgtcgccgaggtacttgaccaagctgatgctgatcagggccacaacgaacaggccggtgagcaccgggatgagtgcggcgtagcggtgggcctgatcaggcgcgtgggcaactacgaacgaggccaactggttgccggacagaccggcgaacgcccaggcgctcagcgtcagaccgtgcgtggtggagacggttttggtgccgaagtgctgatcaagcagcacgggcagcgttgagaaaccgccaccatagcccgcgttgacgaggaacagcatggccagcacggcccacagcagagcgttgccgatgctgttggtgaagatctgcagcaagcacacggcaatcgacatgatgaagattacctgatagacggtctcgcggcgcttcaggtggtcggagagtgtggagaagcccacgcggccagccgtgttgaacacggagtccacggcgagcaccagtccgatgatgccggagatggcggcggcaaacttggcggggctcaggttggcatactgcgggaaggccctgagcacatcgtgcaggatgtccttctcttggctgatgagggccaggccgcaggtgatgttgatatagaaggctatccagatgccccagaacacgggcttcttgaggattgtcttgcggctgacgtgtgaggtcgcgggatcgtacacccagccggccggacgcttgatgagcaggaagccgacgaacatcatcaccgcgtagaccgcggcgaggatgaagaacatgctgaccaggccaaccgtgccgatgagatattccatcagtgggctggcaatggccttggccaggccgaagccggcgacggcgatgccggtggcgaggcccttgttgtcggcgaaccaaagcatcaggttcttgaccggagtcagataaccgacgcccaggccgatgcccatgatcgcgccataacagatgaacacgcccggcaggaagttcagggcgatgctcacgcccgtgccggcgaagccgaccacgaagcagaccatggatacgagtgcggatttcttgatgtttttctccaccattggcccggcaaacgcggcggacatgccgaggaagaagatggcgagtgagaagccccattccacggaggcggggctggcgtggagacggtcagcgataagctgcttgaacacgctccagcaatagacggtaccgattgggatatgaatcagcagtgcgggaataatcgcgctggtccaacgattctcggtaaaccttgccatatatggacggatcctttcgtaactggtgtacgatgacctgccgacccgaacgagagtcgtatcgcccatatccacgcacatcacgacggcatgccccccgtgaaccatccgggctgcacgaatcgaatcaaatcgaatcgtgcgaactgcgaacaattcgctaaacatccttggtgtgcatttcatcggcgctgctggctcttgtcgacgccgacaaacagaactataacgctgttatggggttgctgtggctgatttctgtggtcggaagctatgagctttctcacatcgaaaacagttatatgacggtatcggcgtgattgatacgtgacgtctgcccgtggacgcggcatatccctctcggaaaacaatgactccgtcatgtccatttcttggtttgacatgttttcgtttgcagcgtcggtgctcaccacggtgaccgcggcgttcgagtcgccgggcagggcctcgaccgagggtctcatcctcggctgagatgtgggcggtactatggattcttatcgataaggttcgtgatatgcggagatggtaacgatggtgaccttaaaggatgtcggcgaactggccggagtgaccgccaccaccgcctccgcggccctgcgaggcaaggattacgtcaagcccgaaaccacgcaacgcgtgtgtgacgccgcccgcaaactcggctacaaaatcaacctgtctggccggtccctgcgttctgggcggtccgataccatcaccttccttacctcgggcctcgagggcgactatttctcccatctggccatgtgtgtggctgaggaagtgcacaagcgcgactcgcacatgctcatcgaactgtcccggtatcttaccgacgacaacgatctgtcgtacacgttttcggacggcatcatcgccatcaatgcgccacgtgcggtcgatatcctgaagcggcacccggccgtcatgctggaaaactacgacaccagcctgcccatcgacaccgtgaacgcgccgagcgacgccggctcacgggcggcaatcgaacaccttatcgcgcgtggctgtgcgcgcatcggcatcgtcggcgacaatcgcgatcccaacaatcccaacatcattcccggctcgcgtgatattcgtatgcgggccgccaaggagacgattctcgcggccggactgccgtttgacgagcgccgcgattacatcaaatcctcgtggtcgattgacggcggtatcgaggccgggcgcggcttggctaagaaaggcaagtgcaagtacgacggtctgtactgcctgaacgacggtattgcgctcggtattctgcgtggtctggcggatgatggcgtgagcgtgccgggcgatgtgcgcgttatcggcttcgacggcctgagccagggtgcgtacagcgtgccaatgctgaccaccgtggccacggatttcaagggcatggcggataccgcgctgaccttgcttatgcggcgtatcgagaacccggacgatgaattcttcccgcagaccgtgaacgtgggctataagctcatcgagcgtgagtctactgcggcgtgaaatggcgtgaaacagggaagtcccactctggcgagtgggactttaccgatatgcgcgggtaaaaggaaacccccgctgagtcgcgggggttgctgtgctgcgatatgttttgcgcgcgcaaagctattgcgcaaaacatatcgctacgttttggccttgggaagcccaccgggcttcccaagcggtgttgggccgcacgcgcggcccaacaccggccaaaacgtcagcctgtgttctgcaggccagcggcgacacctgaaacggtgcagaggatcagatagatgaaccctgcctgctggctttgcgagagctcttccttgtccaccttcttgcgcagcgacttgagcgccagcacctgagtgacggacagcgcgtccacgtacggggagcggatgcggatggcctggccgagcacgtgacggtgctgcagcggccacttgtcgcccacgatggccagaacccacttgcgggtgagctccatctcctcgagtaccttcttgttgaggtcctcgcggtcgccgagggcgaggtacatcttggcgatgcgctcgtccgtcttggcgatggacatctcgatgttgtcgatgaaggtggagaacagcggccattcctcatacgccttgcgcatggtctccagatcgccgaacttctcgcatgcggtgccgagaccgtaccaggcggccaggttgatgcgggcctgagcccaggagaagatccacggaatcgtacgcaggtcgtcgagcgacttggcgccgaggccacgcttggccgggcgggagccgatcggcagcaggccgatttcggtcagcggcgtgacgatcgagaaccacggggcgaagccatcggtgttcaacaggtcgaggaagcggttgtgcgcggcctcgtcgagctgagcggccatatcggcgtacttctcggtcatctcggtgttgcgcttctccacgctcggcgcggactgcagcaaggtcgccgcagccacggactcgacgtggcggatggccagcaccgggttgccgtagcgggcgaagatgacctcgccctgctcggtgagcttgaagcggcacttgacggaaccgaccggctgggcgagcaccgcgcggttggcggggccgccgccacgaccgacggcgccgccgcggccatggaacagggtcaggtcgatgtcgtgcgactcagcccacttggcgatgcgctcctgagcggagtgcagggccagcgtggcggaggtcgggccggcgtccttcgaggagtcggagtagccgagcatgacctcgagcttgttgccggtggccttcagacgagcctggacctcggggatcttgatcatttcctcgagcacatccaccgagttctgcagatcctcaagctgctcgaacagcgggatcacgtcgatggtgggcacgtcctccgggtgagagaaggccaagcggttgagctcgtagacatccttgatgttctgggcgctcttggtgaaggagatgatgtagcggcgggcggccttgaggccgttgcgcttctggatggcgccgagggcgcggaaggtgtcgagcacctcgtgcgtcatcggctgcagttcgccgcgctcgccatgcaggccgtgctcgcggatatccgcaagggcgcgggcgtgcaccacggagtgctgacggaactccatctccaccatgtggaagccgaaggtctcggtctgccagatcagatcctgcagcgggccgtaagcggaacgcttggcgccggcggcggccagcgaacgctggaccaccttgaggtcggcgaggaagttgtcgcaggagtggtacatgaggtcggcatcgcgttcgatggtgtagtgcagacggtcggccatcaccagcatgaccgcgcggtgcatctccttggtggagatcagggcggccttgtcggtcagacgctcgctcatttccttctggtggctccagaggttcttgagctcggcgctcggcggcgtggtctcggcttccatcgtgaggttgcggccgacggtgcgggtggcttgctcaagggcggcgatcacgtgatcggagaacttgcgggccacggcgcggctcaccttggcggtgacgttcgggttaccgtcgcggtcggagccgatccagctgcccgggtggaagaacgcggggcaagcgggctcgacgagaccggccttatcgcccaggacccagtcgtcgaagcgacggtaaaccttggggatggtgttgaacagtgtgttgtcgaagatgtcgagaattgtgtccgcttcctcaaccggggtcggcttcttcagcgcgattggagaagtgcggaacagggcgtcgatctcgttgtagagacggcgcaggcattccttcttatccgagccgccgaggcgcttgtactcctcaagcaattcggaaacgcggcgaatcttgccttccacggccttacgacgggcctcagtggggtgcgccgtgaagacggggtggaattcgagctggttgagcagttccttggccttggccgggccagtctcattgatgagctggtggtaagcgacggtgagctcgttgatcgggtcgaccgcctggtcaacgggcacgttgttctcgcgctcgtggagcacggaaacgcggtagttctcctcggacaggtttgccagatggaaatacgtggcgaacgcgcgggccagcagctgggcgtcgtgcaacgtcatgttgtcgatgacgttcacggcctccttcaggccatcctggtcggggttcggatccttcagctcggcgaaatgctcggcgctggcctccaccgcgtaatgacgcacggtgtcgaacgtagacagcagttcggggttgtattcgcccagtacgttacgcaggatctcaagacacagatccatgtcgtacttcaggctttcgggaagatcatgctcctccgggccctttcggccggtcccggtagtgacgatggcggcgtcagcgggagtgatctgttcttcaggtgttgccatataacctcctttgccgaataacaggttgctcggtctactggtcgtctgcggctcctccgcagttgttgagaccagtcgttgcgagcccacagcccatattcaacgtggttgttgtgtgggcaatagtgtatccccgcgaaatcgctatttacgttacgaagtccatatagtgcgccaagttgtccacctatagagaccgaatatcggacagcatatgagacactgtccgattcgcggaagatttgagcgccttacgattgctggcggggaaggcagggagtagtaatgaaggatgtgagcgaacagaagaaaaaaagtgcgcccgaagcgaaaggcgcaacggctgtacgtaaattccacacccactccattccgctggacatggaagatattgcacgcgattgggaaaaaccggtggtggacgccggtatcgccgccaaagccagcgtgattgtacgagtcggcatgttggacctgggagccggcaccggctccttccgcgtgcgtgaaatgatgcaccgcatcgcctacccgctgggcgtgcacgtacgcgccgacgtgaacctgacggatatcgaggccacctgcacggatggtcgtaaccgcatcaccgaagtcgtggatttgccgaccaccggcgtgaacaccgaacgtatctggctgctggaacatttcgccgactggttctccgtgaatctcggcaaggggtcgatgtatcacgtcgattcgcaactgtccgatggcgtggtcaagcatttggacgaacgtgacgcttcgcagtattctgccgatctggccaagcgcctgcgcgaacgtgccaaggccgaggttgaggcggccaacggcagcgtggacgaggcgctggatcttgcgttgaaaaccaaggtactcgtgacctccgtggccaagtccttggacgatgacaatgaagaagcccaccgacttttggcggacagcgcggaagtcactccggtcgaagacaaagcggccgaagagaaggcctacgacgatgccgaagtgtttaccggtgactccaatgagtcggttgaatcggcgaacgcgacgaacggcgcaaccgccgaaagccctgctgcaagcagtacgaagcgtaagaatcgcgtgcccaaggaatacgccgaacacttcaacgagcgctccgacgaagagaaggccaagggcggtatcaccgtgcggcaggcgcacgagcgactcgatctgattgagcgccgcaagccgctgtacaagccgtggttctccggtctggcctccgccctagcctgcgcggccttcgtgttcctgctcggcggcggcccatacgacatgatcggtgcgttcgtgggcgcgggccttggccagtggatgcgtcgccggctgtttgcataccatctgaaccagttcttcgtcacctttgtgtgtgtggccgcggcggcgctcgcctgcaccggcaccctgcgactcatcggcattttcgacccagtcgcgctctcgcacgatacggcctacatcggcgccatgctgttcgtgatccccggtttcccgctcatcacaggcggactcgacatggcgaaaatcgacttcccctcgggcatccagcgcgtggcgtacgtgctgtgcatcatcctgatggccacgctggcaggctgggccgtggccgtgatggtgcacctgcacccggaaggctttgagccactggggcttgacccgtgggtcaacggattgctgcgattcgtggcggcgttcgtcggcgtgtggggcttctccgtgctgttcaattcgccgcagcgcatgtgcctgaccgccgccctgatcggtgcgatcacggacacgctgcgcttggaattgcaagacttcaacgtggcacccgagatggctaccttcatcggcgcgtttctggcgggcattctggcatcggtgtggcgttcatccgtgcgacgtggctggctaccgccgcacctcggctacccgcgcatctgcctgaccgtgccgtcgatcgtgatcatggtgcccggtctgtatatgtatcgtgccatgtggtacctcggcagcttccagaccatgaatgcgctggactgggcgttccgtgcgttcatggtgattatctgtctgccgatcggcttggcgatggcccgcgtggtgaccgacaagtcctggcgctacgacatctgaccgtcatcttggctctcctcaggtggggggagctcggataaaacagcgtctcagtatggaaacggtggaaggtgcttgagcccttgtatccactaccatcaggcgaagtgcgttgcggccgtattcacggctgtgacggtctgtatgacgccgctccggcgtcaatcgcatatcagcacatagttctgccatggcggtagccgcttggcgtcatgattgaggaggggcgcagttggccaacgatttctggattctgctggccatggtcatctattttgcggccatgctgtccatcggattcatctactccaaacgctccaactcctcctccaaggaatactttgcgggcgggcgcggcgtggggccgtggctcacggccctgagcgccgaagcctccgacatgagcggctggctgctgatgggcctgccgggcctggcctacttcactggtgcggccgacccgatgtggaccgccgtcggactggcgctcggcacctatctcaactggaagcttgtggcccggcgactgcgccgctactcggtagtgaccgacgatgccatcaccattcctgacttcttcgccaagcgtttccatgacaagaagggcgtgatctccaccatcgcggccgtgatcatcctggtgttcttcagcgtgtacgtgggcagctgcttcgtgaccgtgggcaagctgttcgccacgttgttcggtttcgactaccacgtcatgatgatcatcggcgcggtggtcgtgttcgtctacaccgtggtgggcggctacttgtcggtggtgatgaccgacttcattcaaggcatgctcatgttcttcgcgctcgcggtggtgttcatcggcaccgtggccagcgcgggcggtgtcgacaacaccgtggaattcctgcgtgccatccccggctacctgtccggcacgcaggtggccgcgcccaagctggacccggccaccggccagcagctcgtcgaggcgggcaaggccgtgttcggcgcgccctccgactacggcatcatcaccatcatctccatgctggcgtggggcctgggttacttcggtatgccgcaggtgctggtgcgcttcctgtccatccgcagcgtggaagaagtgcgcaagtcccgaatcatcgccacctcctggtgcgtgatttcgctgggttgcgcagtgtgcatcggcttggtggggcgtgcgatgatgcccaccgaactgctgacctccaccgatgcggaaaccatcttcatcgtgctagcgcagaccctactgccgagcttcatgtgcggcgtggtggtctccggcattttcgcggcctcgatgagctccagctcctcgtatctgatcatcggcgcttcggccatgggcgagaacatcttccgcgggctgctgcaccgcaaggccaccgacaagcaggtcatgattgtggccagggccacgctggtggtcatgttcctgttcggcattctggtggcatacgaccagaactcgtcgatcttccaggcggtgtcttacgcgtgggccgggcttggtgcctcattcggcccgttgatgctgtgctcgctatactggcgtcgcgccaacaaggccggcgccgtggccggcatgctgtccggcacggcggccgtgctgatctggcacaacctcgtcaagcccttgggcggcgtattcgccatctatgagctgctgccggcgttcatcatttcgctgctgttcatcgtggtggtttcgttgctgaccgccaagccgaacaagcgcatgctctacgaattcgaccactacatggacgatccgctgcccggcaccctgccgtccggcaccgtgctcgtcgacgagcccatggaagccatggagtccgaggtccgcagcggcaaatgacacgtgcctgctgtgcggtcggctcgtatggcagaggagtggcttttttgtggttcggcaggaaccattgaggccaaaacggacttcgaggggctgatttgacgttctggagagatctacttccgtttcaaggggctgatgcctgagtagacgcggctccaaaacggcggaatggcgttgacgtaagggcattgatacacgtggtctaccggatgatcagccccttgaaacggaagtagacctccggcggaggccaaatcagccccttgaaatgggttttgaataccgtagcgcggtgcggacggtgcggactgactctaccgggcttattattcctgcgtcgtcggaataattggcagcagaggctcgaatttcagccgtttgtacagtggaatacggcgtagctttcggacatcgctaatttgctgggtagtttgccgcatcgtgagctggaccgttttgcccgtaacctcctgtatcctttcggcaactcttcgggcaagggcctcttctcccgcttcgtcgccaatatctaatttggtgacttgaatgtacttccagccagcatcttcgatcatctggcggcgtctcgcgtcattcagccattgcccggcatgatgagagccttcgtattcgatacatatcttgaattcagggtatgcaagatcgagatatatgggtctggtgttgtttcctacgaatattggataattcacctgcgggcaattcagaccgtatttcaagagaaccaaacgagttcgtgtttccatggaggaatctgtgcccgcgcgcgccaaaagtagggcgcgacggcatttgttatacccgcggaacaaatacgaattggtgccattctctttgtcggctcgcacctgggcctcggcctcatcgagatacagagaaagggcgtcgatggttgttctgcagagccttcgatctcgtcgcatcatggaatcagcgagaacgatgagttcttcaagttcgagatacgtggagaacatggcccatgtgcaagctggtgaagtgcatgtgaattgtccctcgattatgaccgtgtctagtggaaaaggccatacaaccactttgacccccacaatgtgccgtttgtcattggcgtgtggaaccgcaacaatggttgtagttgcaaggcctctgtgtttgcttgatatgcggggtacttcaattgacaaaagctccaacgctgttgtcagggcatagggtgggcgccatgcgcttcgtcgttgaacatctgcgcacgtctgcattcgttggtacttctgcattgtcagctcggtcaatgccgttgagctacccatgatgatcaccccttcgtgatgttcgctttgtcctcgcagtgtagagtccggctaccggccttgtctaccgccccaatttttcggtggataaatgtggataagtcggtggataaactatgggtgttcatcgcagttgcaggccatcccgcaattacatggaacgtaggggtttgcaggcagccagcgggaatcgccgccgacggcgcgattcagcttgaacgaatctccatggcgttcatgcaaaggtggcatgatggcgggtatgagtagcttggtgcgtattgtcaatgccggtgttccggggtctcaggaccgcgtggatgtggtgcttcgcgatggggttgttgcgtctgtcggccctgctggaacggtctcggcttcggacggcacgatgcagactaaggcgcatacgacatcgttggcatacgcgacgaatgccattgcttctggcggcgtctcaatcccaacgtcggcctccgcacccgccgacgaaaccaccatcgacgccgacggcctgtgggttattcccagcctgtgggactgccacacgcacttcacgcaatgggctaagacgctgggccgactggacctcatcaatgcccgttccgccgccgaagcgatggacatgttgcgccgtcatctggatgagcgccgcgccgccggcacgcttgacccagatgccttcgtggtgggcatgcgattccgtcactcgctgtgggccgacgacgagcagcccacactggccgcaattgacgccgtgaccggcgaacagccggtggccctctccagcgcggacatgcactgcggatgggtgaattccgccgcggcccgcaggcttggcgtacatgtggacgaatccggtctggtcggtgaactcgaatggttcaacgcctacaccgccttcgacaaggcgccgggcgctgctgaagagactgaccgtctgctgcgcgaggccgaacaggacgccgcaagcaagggcgtggtgggcatccgcgattatgaaatggccgaaaacatcgatacatggatcaatcgtttcgcggctggcattaacggtttgcgcgtggacgccggtgtataccccgagcggttgcgagccgccattgatgcgggttggcataccggcaaggaattgccgggcagcgccgggcttggccatgtgggcgccatgaagctcatctcggacggatcgctcaacacccgctccgcctactgctccacgccgtattcgggcatcgagccgctgacgtatggcacgctgagctacacgccgcagcaaatcgaagactatatgcgcctagccaccgagcatggcttcgacattgcctgccacgccattggcgacgaagcgaacaccattgcgctcaacgcagtcgccgccacgcacgcacatggatcgatcgagcatgcgcagatgctcaaacccgtcgatatcccgcgtttcgccgagctggggctcacggccagcatccagccgcagcacgccatggatgaccgcgacgtcatcacccgtttctgggccaacccggccggcatcccttatccgttcagggccctccacgacgccggtaccacgctgcgcatgggctcggatgcgcccgtggccccgctggacccgtggctggccatttccgccgccgtgctcggcaccgaaagctctgaccgcgagccgttccagcccgagcagtgcctcgatgtgcatacctcgctggcagcctcgaccgccactggccgtgaccgccttgcatccggcgacccggccgatgtggtgttgctggacgccgacccatacgccgccgatactccggaagccatgcgcgctatgccgcaacacgtcgtaatgacattgctgtgcggggagcgtacgtattgatgcaagccatcggcatgaagtgaacagaggtccgtcttgatagccgcgttgcacggaaaaacaagaaatccgcccctcgaagtgaagataggacacagcagacgccgcaatacaaaaacgccgtgtcagttgcccagttggggctgacacggcgtcttgctacgagcggcgggaaaatcagtacttcatgcccatggcctcgcgcacctggtcgagggtctcctcggcgatggcgttggcgcgcttgttgccgtcgtgcaggatgtcacgaatggaatccatgtccttggccagctcggcgcggcgctcgcggtgcggggccaggaactcgttgactgattcgatgacgtatgccttgagcgcgccggcgccggaatcaccgatctcctcggcgatgtccttcgggtcgcggccggtcaccaggccggcggtggtcagcagggcggagacctgcgggcgggcaaccgggtcgaaggtgatgcggcgctcggaatcggtcgggctcttcttgatgagcttggcggtttcctcggcggtggcgcccagcatgatggagttgccgtacgacttgctcatcttgcggccgtcgagacccggaatctccggtgcctcagacagaatggcggccggctccgggaacaccgggttcttcttggcgtaacgctcgttgaaacggcgggcgatggtgcgcgtgatttccacgtgcggcaggttgtccttgccgatcggcacgacattggccttgcagaagaggatgtcgcacgcctgatgcaccgggtaggtgagcagcagaccggtcagcgcgtggccggacgcctccatctcggacttcacggtcgggttgcggtgcagctcggcctcggtgaccaaggacaggaacggcagcagtagctggttctcggccggcacggcggagtgggtgaacatcatggtcttgttcggatcgatgccggcggccatgtagtcgagcaccaggttcagcacgttgtcttggatgtgctcggtggtgtcgcggtcggtgatcacctggtagtcggcgatgatgatgttcgtgttgacgccgcgctcctgcatggcgacacgctcacggatcgagccgaagtagtggccgaggtgcagccggccggtcgggcggtcgccggtcaacatggtgaaggacgacggcttggcctccagcttggcgagcgtttcgtccgaacgctttttggccgcgaggaagctcgcgctcatctcattgcctgccgctgtcagttgctgctcgtcggtcatgcgaaaatcctttgaatatgccctaaataaacgctttttatggtaaaagtgtgagccgacaacgaacaagccactattagtggtactctctattgttgatgaatcgaacagcacagtaatcgcagggggtcagatgggccgcggacgtcaaaaagcaaaacagcagaaaattgcccgaaagctcaagtacctgaccaccgataccgactacgatgagctggcaaaagagctgagcgagcaggagccgggaatgggctctcctgacccgttcgccgacatcgatgaccagtatgcggacaaggatgtggattccgctgctgatgaccacgcttccggtgccgccgaggcagctcccgctacgcaggaggatgacctcgacgagtacgccaagtgggctgccgaagccgccgcaaaggcgaccagcggcgagttcccggcctccgcgcctgccgcaccgaagccggccccgcgcaagccgattccgatgcccatgccttccgcgctcaagcccaagaagagctgaacgccggtcttctcgtaataatccccttgtgcttggttgagcacaaggggatttgtggttatggctgatggtgccgccgctggtggcttacttacgcttcgcgcctcacagcggcagcaggtcgctcaggtcgtcgcgctcgccgaccgcgctgatgtggccggcgtccttttcctctgcccatgtggtgatgccgcaggccagccgcagccagacttccgggtccagctcgatgacgtccggcggggtcaggttatgcgggtccgattccgggccgtccaagattttgaccgccccccacggcgcgacacgcacctccacgccagggccgggtgcgcgccgctccagcagaaacagcgagtagcgcacggccatcgcccacaccgggcgtggcaagacaggggagacggtcagacgatgtggtgtgttgtccgccagctcccgggccgcggcacgccattgcaccagcgcgtcatgcccgcgtttcaggtctttttcaagaattactgccatgtatcccatcatggcaccggagccggaagatcttccataatgcaaacgatggcatacggtgtgatgcggaatatcggggcatgtgctacgctctaaatgagaacgtatgcaagaacgctccgccatcgtcgttacggagagttcatgcttacgtttgtgcgacgatacctatcgcgcggcataataaacacgggcacttatcccggaaggaaagtcagaatgaccgaaatcaccgcaccgaagtctcctgtcacggcggaacaattcgccgacgagattcgtgaacaactgaaatacactcagaacgtcaccaccgagcaggctacccctgctgacgtgtatgtcgccgcatccaaggccgtgcgcaaccaccttgccgactcctggttcaagacccaggccgacaccgtgaacggcaacaccaaggccgtcggctacctgtccgcagaattcctgatgggtaagcagctgcgcaacgcgctgctcaacgccggtctgaccgagcagttcgacaaggccgtggaagccctcggcttcaaggtccaggacgtcgtcgacgccgaatacgagccgggcctcggcaacggcggcctcggccgtctggccgcctgcttcatcgactccctcgcctcgctgggcgtgccggccttcggctacggcatccagtacaagtacggcatcttcaagcaggagttcgacaaggacggcaagcaggtcgaaaccccggactactggctggccaacgaagagccgtggggccacatcgactacaaccgcgaccagaaggtttccttcggcggcaaggtcgtcgagaacgccgacggcaccaagacctggcagcccgcatggtccgtgcgcgccgtgccggtggactacctggtccccggctacaagtccggccgcgtgaacaccctgcgcctgtggagcgccaagagctacgacgagttcgatctgctcgccttcaaccgctccgagtacatggaagccgtgaccccgcaggtcaaggccgagaacatctccaagattctctacccggaagactccaccaaggtcggcaaggaactgcgccttgagcagcagtacttcttcgtctccgcctccctgcacgacgccatccgcgtcttctacccgggccaggacaagccggatctgacgactttcccgaacaagatcgtcttccagctcaacgacacccacccggtgatcggcatccccgagctcatgcgcatcctcatcgatgagtacggctacgactgggataccgcgtggtccatcaccaccaagaccttcaactacacctgccacaccctgctgccggaggcccttgaggtctggccggccagcctgatcggcgagctgctgccgcgtcaccttgagatcatcgagaagatcaacgcgcagttcgaggacgagctcaagtccaagggcgtcgacaagaacaccatcaaggacatggccatctacactggcgacgccgtgcgcatggcctacttggccacctacggcggctcccacgtcaacggcgtggccgagctgcactcccagctcctgaaggacgtcaccctcaagaacttctccgacgtctacccggacaagttcaccaacgtgaccaacggcgtgactccgcgtcgcttcgtcaagctcgccaacccgcgcctgtccgacctcatcaccgagggcctcggcaccgacaagtggctctccgacctggagatgctcaagggcctcgagccgctggccaaggacgatgaattcgtcaagaagttcgccgccgtcaagaaggccaacaaggtcgacttcgccgcctacgccaagcgcgagtacggcttcgagctcgacccgaacaccatgttcaacaccatggttaagcgcctgcacgagtacaagcgccagtccctgaagatcctgtccgtcatctccacctacgccgacatcaagtccggcaaggtcaaggccgaggacgtcaccccgcgcaccgtgttcttcggtgccaaggccgccccgggctactacctggccaagatgaccatccagctcatcaacaacgtctcccgcgtggtcaacaacgatccggacgtcaagggcaagctggccgtgtacttcccgtggaactacaatgtgcgcctcgcccagcacctgattcccgccaccgacctcgacgagcagatctcgcaggccggcaaggaggcctcgggtaccggcaacatgaagttcgccctcaacggcgcgatgaccgtcggtacgctcgatggcgcgaacgtcgagatccgtgagcgcgtcggcgccgagaacttcttcctgttcggcatgaccgtcgacgaggtcgagaagaagtacgccgagggctacaatcccgcctcctactacgaggccgacccgcgcctgaagcacgccatcgatatggtggccgacggcaccttctccaacggcgaccgcaacgcctactccccgctcgtggccgactggctgaccaaggactggttcatgaccttggccgacttctccgcctacatggacatccagtccgagatcgaggccctctacgctgatgagctcgaatggaaccgcaaggccctgctcaacgtggccaactccggctacttcagctccgaccgctccatggaagactatttggaacgtatctggcacactgctcctctggcctgacggccgccggagcggcgcgccagctacgtgctggtttctacctcgcggctgtcgccgctcggcgtcgcctacgggaagcccaccgggcttcccgcttaacggctccgcgtatctggcacactgctcctctggcctgacggccgccggagcataagaagccccgcaaccgacatccatcggttgcggggcttcttgcgttgaaagaccgccctatcaggcttcggccggggcggctttcgcctcgtcatcggcctcatcctcggccttattcagacctaggtcgaccggcgaggagctgttctcccacggctcctcccacggatcgtaatccgggttctgctgcttgtagatgtacaggccaacaagcgcggcgagcaatccgccgaacagcagcgcgaagaacttccaaccgttagaagacttgttctccatgacggctcctttccctagggatcgtctggtcggtatgcccattcagaccgactctgctccctattctaggccgctgtttgtgacgattgggtggaatgacattcgtgggcgattcatccgcgcccgtctgcccttggccggctcggcatcttcgcggcgcgtggaacgcatccgagaccttcgatacagtgggctgcatgcatattcctacacaacgggagattcgataccagtgggagcgcggtggtccggtgatgacctgggcgctgattgttgcgtgcgtggcagtgtggctactggaggtattgttgggatttattgccccgggcctgagggcttggttgatgtacctcggcatggcggctccggtcagactggtggctgagccgtggacgctcatcacctcgatgttcctgcatgcgccgaactcgctattgcatatcctgttcaacatgattgctctgtattccgtgggcccagtgctggaacgaatgatcggccactggcggttcttgggactgtatgtgatttccggccttggcggctccctgggacttatggtgtgggctgcggtggctccgggaggcatcggctggcagatggcagcctatggggcttctggagccttatttggcctgtttgcatcattgctggtggtatatcgccgtatcggcgccgatatccgctccatgttgatctggatggcggtgaacttcgccttgccgttcgtggtcggtggcgtggcgtggcaggcgcatgtcggcggctttgtagtgggtggaatactcacatggctgctggtgggtggtgtgccggcgtggcgcggtaaaagcctgaaatggcgcatgcaggtgtacggctgggccatggtggtgctggtcattgcgttgattctgttgtgcaatatggccaatccttacgggtggatgagtttcggctccctgcactgatatggcttgatatggcttgatatggcttgatatggctgtaaaaaaaaacgattgatgccgggtattgcggaacatgcagtgcccggcatcaatgtatgtgcggaaagcgacgatgtggatattagcgatgtggatatcgtcgttcggcgagtgggtgtgtgccgtatgaagatatccacagtaatgagatgcgcgcaatgacgagttatccacgataatgagttatccacaatggtgacttgtgcacaagtgtgtagaaaagtgcataagactgtggataacttatgtggataagttaggaatgccgcggtattattgggtttgttgcagtggataactcgggtgtataactgttccctcgctgtggcgatgtatgccaagccaaagttatgcacgagatatacaccgagaaacgccgcttatccaccacttatccacatggttttccacattcggtggaaaactacatgggtgtaattcatccacaggctgtggataacgtagtggataagtcgtggataagtggtggatagctgtggatgaacaggctaaggcacgaaaaaggccgacctccgcatacgggaggtcggcctttctcataagaattaaggacaacctaacgatagaaaaaaacaatctaccgatagataagcgcaacgagccggaactcagcgccatcccatcgtcatcaggaatccgatcatgatcagggcgaagccgatgccgaggttccacgcaccgatgttcggaatcggccaggaaccggacggggagaggtagtacaccacgcaccaaatcaggccgatgatcataaacgcgcagaacagcggcacgaaccaacgcgggttcgacttggtgcccttaatggtttcttcaacgcgcttggtgttctccgcctggcggttcatcatacgctgcatctgcggggtcagcgtggccttatcggcagtggcgttgagcacggcctgcacctgctccatattcacgccgtaagccgcgccttcctcggcagaagcgttctctgcgttctgctcggtgtctttgctggcggtctcgtcagcaacggtgctggatgaggtctcgctctgccagtccttctggttgttcgagtcggtttcgtgcagctcttcgtcagccatcagcatagtctccattcaataggctaaaagtcataatagtggctacactcgaaagcggcgaccagagtcggcaagaagacaggaaattcatggccagacatgtaggtaagcacggtgcacggcactccctatggggtggtgtcgcggtattcgtcgtcattgccttgaccggttttctgctgagcaccaacgtgagggtcaatcgtacggttgccgccaccaacgatacggccgatctggtggagcaaggcgtggacgaggccaaccagctgcagcaggacgtcagcgatctgaccaaacaggtcgccaatcttacggacgcgctcaaggccgatggcaccgacagcacacagaaccaaggcaaggactccagcaatgtggattccagcctgatgctgcccgcgctcagcggcagcggcgtaacggtaacgctggatgattctccgttgtgggagaacgcagtcaacaacaacggcacgaccgccaatatcaacgattacgtgatccaccagcaggacgtcgaatcggtggtgaatgccttgtgggccggcggtgccgatgcgctgatgattatggatcagcgggtgctgttcaattcggcggtcatctgttccggcaacgtgctgtcgttgcacggtaagaaatactcgccgccgttcaccatttccgcgattggtgaccctcaaagacttcgcgcagcgttgaacgactccgaagccattaccattcttaagcaatatgtgaccgcgtttggcattggctacaaggtggagaatgccgaggaccttcagttccccgctaccgccgccttgctgcagcagttgaaatatgccacggtcgatacgtcaaagaccacagatgaggagcagactcagcaatgagacacggcaggcacaacagcggcgtaccggcgcccattgatctcgcgtccgtgtcggacgtacagcccttccccgaggacgatgccgcacgaatggcggcagacccggccaacgccagtagggcaaggtcccgtcgtgccgcagtacgcggcgcgtcttcgccccagcggagcccggtctggcaggcactcggcatctgcgccgaactgctgattaccgctgccgtgatttgcgccctgtacatcgtctggcagatgtggtggaccggtgtcgaggcggagcgagcccagaacgaaaccacccagtccgtcgactggagcgaccccagcaacaacgggggaacggtcaccatcgccaaagcccaggagggcgatgcgccggtacagccgaaagacgcgaaatatggcgacttgattgcgcagatctacattccgcgcttcggctcccaatggcaccgcaacatcgtggaaggcaccacgctcgagcagctcaatcgccacggtctgggccattacgacaccacccagatgccggggcaggtcggcaacttcgccgtcgccggccaccgcaacggctacgggcagccgttgggcgatgtggacaagttgcaggaaggcgatcccatcatcgttcgtaccaaggattactggtacgtctaccactacacccggtacgagattgtgctgcccacggacgtgcatgtgatcgcccccaatccggaagactccactgccaatcccaccaaacgcatgatcacactgaccacctgtgagccgaaatactccacccccacccatcgatggatcagctatggtgagttggcgtactgggccaaagtgtccgacggtgtgcccaaagagctggctactactgattcgtccggtgcagtgatgttctccaccaccgaaaccccctcgatcgcttcccgcattggctcgctggacaaggtggtattcggcgcgctggtagtgtggctggttctgttcattgccgctgcggtggcatggcgctggccggtgctgcgcgagattcgcgcgggtgagcgtcgccgtccggatgccagcatctatggcggactgttgcgtctgcagcccggcgtggcaccgattcgatggttgctgctggctctgctgctgttcgcagccgccgcggcgctgttccagtggggattcccttgggccgccgccaatatcccattcctacagcagatgtcgaacttcgtggcagcgagctgacggcatcctagtactatggcttgcagtacacgtccctcaaggagagccctatgaccgattccgcgcatattttggtggtggataactacgattccttcgtctacacgatcgtaggctatctgcaaacccttggcgccactgttgatgtggtgcgtaacgacactatcgacccagccgcgccgggtgtactggacggttacgatggcgtgctgatttctcccggccctggtgctccggccgaatccggtgccagtgaggatatgattcgcctgtgcgcggccagcggcgtgccgatgtttggtgtgtgcctgggcttgcaggcgctcgctgaggtgtacggctgcactgtggaccatgcgcccaccatcatgcatgccaagaccagcttggtggaacatatcgatgacgagattttcgagggcgtggccaaccccatgaccgccacccgctaccattcgttggccgtcgagcccgattcggtgccggatacgctggtggttaccgcgtggacgcaaggcgaccacattattcagggcgtgcgtgtcaagggcaagccgatgtacgccgtgcaattccatcccgaatccgtgatgacccaggacggctaccgtctgctggccaactggcttaaggtctgcggccaagacaacgccgtggccaagtccgccggcctccagcccaaagttacgaagtagcttttccgcgcggcgatactctccccggaatgtgtcgctagaacgaggcttgcgtactggttttgcgacgcttctcgggattgttgcgctgggatagctctttatacagcaaaggggaggggcgcagaagcccttcccctttgtgttgcgtgtatgtgttgcgctatttgcgttgcatatgcgcaacacatacacgcccggcgcttacttgctactcaccggttcactcaccggttccgcccccgttgccagtaccgttgccaccgtctccggtaccggtaccgccgccagtgctgccggccttcgtggtaatggtgacggtcgatcccgcatctacctggctgccagcgccaggattgatgctgactaccacagcggtgctgccggttggaccattggcctgagccttgaggcccacggccttgagcatgagttcggcggtgacgtagtcagtgccagcggtgatattcggcacagcgaccttctccttgcccgtggacacccaaatggtgatgaacccgccctgtgcgatggaagagcccgaatcagggcttacacgggtaatcagaccggcctccaccgtatcggagctctcctgctccacagtgaagctgaacttgccctcatactgctgtagcacgctgtccttcgactgaccgaccaaattgctcggtacggtggtcatgccggaagaaacatatatggtgatggtggtgcccttgggaaccgactgaccggcggcaggatcggttttcgtcaccatatccttggcgatgtcggcgctgtcttcggttttgacggcggcgttcaccttgaacccggcgctttccagaatgctgcgcgcctcttcctggctgcgttccttgacatccggaacctgagtggactgcgggcctgcggagaaccacaccttcacggcagatcccttggccaccttggagccggcgtccgggctcatcttggtgcaggtgccttccggctcggtggagtcggtgtcttgcttttcggtcatcttcaaacccgatgccttgagtttgagctcgatgctgtccttggatgtggaagcgttgcacacctcagggatggtgacggtgtcttccgaggacttgttgccggagccgttcatggcgaacacgatgcccacaatgacaagcactgcaacaatcgctgcgatcaccgaaccgatgatgatcttcttgcgcttcttggccttggccgccgccgcacgctgctgcgcacgggactgcaacgccgctgagttggcaccattggccggtggaatctgctcgaactgaccggtcaccgggttgaatgcttgggtgggttgctgatgcggttccaccggcgtggtgggcaaatcacgttcggcttccttgcgggccttcatattcgacaggtccgtcaacgggttgaacgcggccgccaccggcacgccgccgttcatgtaggtcaggatgtcggtcttgaattcggaggccgtggcatagcgattctggcggtccttggccatggccttggcgcagatcgaatcccacatcttcggcagccccggcaccacggcggatggcggcgtggcgacttcggaaacatgctggtaggcgatggccacggcggaatcgccggtaaacggcgggcggccggtgagcatctcgtagagcacgcagccggcggaatacaggtcggaacgcatgtcgacggtctcgccgcgcgcctgctcgggagaaaggtactgtgcggtgcccaccacgccctgcgactgggtcatggtggctgcggaatcgtccagagcgcgggcgatgccgaagtccatgaccttgaccacgccctgctcggaaatcatgatgttgccgggcttgatatcgcggtggataatgcccatgcgatgcgaatagtcgagcgcgttaagcacgcccaacatcacctgttcgcagtcgcgctggctgagtgcgccgttgaccttgatgatgtcgcgcagggtctggcccttgacgtattccatgacgatgtatggcagacgctcggcatcgccgctttcggaagaaaccagttcttctcccgaatcgtagatgttcacgatgttcgggttgttcatctgggccacggcgtgtgcttcgcggcggaaacgggccaggaagatgtcgtcgttggccagatcggcgcgcatgattttcacggccacggtacggcccagacgggtgtcaagagccacgtggacctcggccatgccgccacgaccgatgagctggccaagctggtagcgtccgccggccaatgcggtgggcatactggtgctcattgcttattccctcccaatcttgaggccggggcctccaaaacaatgcgtggcgtgctggtcactcggcgcggcagtcgattgccggacgtggccatggcggtgtcggccatttcggtctgctgatccagcagacggcgttcgatgcgtgccagcgtacgggacaccaccagcgcgtctttcgggcgatccaacgggtccttggccagcattgacatgacaaattcgcgtaactggacgtccaccgagtccggcagcggaggcacgggattgttcacgtgcgctgcggcgatatcgaccggagtggtgccggtgaacggacgatgcccggcaaggccctcgtacgccactacgcccagtgaatagatgtccgattgcggcgtggcctgctggccctgcgcctgctcgggggagatgtattgtgcggtgcccaccaccatgccgtcctgggtgatctggccctgacccgtggagtagctcacaccgaaatcggtgattttcacttcgccggtgtcggaaaccatgatgttggccggcttgacgtcacgatgaatcacgccgtgcgagtgggccacgaacaggcctcgcgcggtctgaatcaggatgggcagcagttcgatgggatccatcgcgcccttgctgtggaacaggtccgccaacgatttcgaggggacgtattccataatcagaaagccgatgccgtcatgctcgtagtattcgaacaacgcagcgatattcggatgcgccagattggcggaattatgggcttcggcacgcagacggcgtagcttggcctcggcgttggtcatgtccgagcgcagcgccttgatggccacttcacggccgagctgaatatcgtagcctttccagacctcgcccataccgccttgcgcaagacgcgaatcaagacgatatcggcggtgaataagctgtccttcgataagtttcactgctgcaaagcctcctgcatcatcgcgcgcatgatcgggccagcggcgagcgaaccgtatacatctgtgttatgcaccaacaccgcgacggcgatttgcggatcgtccgccggcgcgaaaccgatcacccagccgtcgatggcagagttgtcggtaccgatttgtgcggtaccggttttggccgccaccttgatgccgtcgatggccagctgcggattggcctcggacaccacgctttccatcatcgtggtgagcttgtctgcggaatccttgctgaacgcattggccatggtctgcggcttggtctgcgaaagcacggtgagatcggcggcgcgcacacgatcgaccagcgtgggctgcatcagtttgccgttgttggcgattgcctgcgcgaccatcgccatctgcaacggcgtggccgtggtgtcgccttggccgatggacgccagcgcaagcttgtcgtcggtcggatcagaggggaatgtggacgcggtggccgtcatcggggtgcccgtggattcggtgccgtcaatggtgatggtgctgccgaaaccaagcttggtggccatgtccgaaaccttgctcgcgccgagtttcacgccaagctgggcgaacgcggtattggacgaccatgcgacggcctcttgcagggagatctgcccgttgacgccatcggcctgtgcctcggcgttcggcaactgtgtggcggttcccggcaaggtatagctggcgcccgcaggaatcttcgtgtccgtctgataatcgccggtttccagcgcagccgaggcgacgatggtcttgaacgtggaccctggtgggtacagctgcgaggtggcgcggttgattagagggctattttggcccgcagaaagttcgttgtaggcctgagacgcggctttggtgtcatgggtcgccagtttgttcggatcataactgggcgtgctcaccatggcgaggatacggccggtgttgacttcgatggccaccgccgcaccatcgcgcgtaccgagctgatcgtaggcaacctgctgcagcttggggtcgatggaggtttcgatggacgcgccctgattcgtagtgccggtgagcatggccttggcccgctgccagatcaatgaatcggcctcaccgttgagcagcatgctgcgggaggcttccaggccgcgatcggcggtctggttgatggagaagaagccggtgaccggagcatacagaggaccgttggaataggtgcgcaggtatttgaacgcgtcgttgaccggttcggatttggccatgaccgtgccgtccgaggccagaatggcaccgcggtaggcaccgagctggtggtacagcgaacgggcgttgcgcggatcgttgttcagcgcgttggcccgtaccgccatgatgatggtggacgacaggccgagaatcacgaacagcgctaccacggcggtgaaaagctgacgaagatatttgttcatacgcgagtgcctccgttaacgggaggaagcgggggaatcgtaccggtaggcgtgtacggttcatcggcgccggcatacgccggagtggtggcatccacaatgggctcggcgatgggggccgcagcagagcccgcagaggtcacaattgcgggcacttcgggtgcctcaagtgtgtctggcgcgtgcttggtgatgtccacaatggggtcgtcaaacgattccgactcggactgcgacgccgtagccgacgcgctgcgaggctgaacgatcggctcagtggcgcgggcccgggcctcaagttccttgttgcgcagcacggccaaagcctcgtactggaacgtatccgaggtcagctccggctcgggcgcattggccgaattcgagatgatgatgagcagggtcgcgagaatatagttggcgatcagactggagccaccggccgccatatagggcagggtcagaccggtcagaggaatcaccagcgtgatgccgccgaccacggtgaacacctggaaggccatggtgaacaccagtccggaagcgagcagcttgccgaagccatccttgattttcatggcggtgataaagccggaggcaatgatgagcaggtagagcatcaaaatggccaggacgcccatcagaccgagttcctcgcccagagaggcgtagatgaaatcggagttcgcaaacgtaacgagcgaaggatggccttggccgagaccggtgccgagcatgccgcctgatgccaggccgaaaatgccggtgaccagctgccaggagccgccgggggtcttgttgtattgctcgttgctgaacgggtgcagccaggcatcgactcgctgacccacgtggctgaacatgcctgcggccagcacggcacccgcggcgaacgcgatcagaccgatgatgatccagcttttacggccggtggccgtgtacagcatggccacgaacatggcgaagaacataagcgaggtgcccagatcatgctgcatgatgagcacgcccatcgaggcgatccacaccacgatgatcgggccgagatccttgatacgcggcagctgcagaccgagcatcttcttaccgcccacggccagctggtcgcgatggtcgaacaggtaggcggcgaagaagaacgcaaggaacagcttggcgaactcgcccggctggaactggcccagtcccggaatcctgatccaaatgcgcgcgccgttcacttcctgaccgacaaacggcagcatcggggcgagcagcagcaccaagcccaccaccatcgacacgtaggagaagcgccgcagcacgcggtagtccttcaggaagatgatgagcagcgcggaaagcacgatggcgatgcacagccagatcagctgacgttgggcaaccgcccaaccttcgctctggtcaatgcgagcgatcatggtcacgccggtggcggtcagcagtagcacgcaaggcagaatcgactggctggcgtacggctggaagcgcacaatcagcccccacagcaccagaaacagcactacggccaatgccagcatgccggcgtattgcatagggaattcgccggcggcgcgctggaacatctggatgaacgccaacgcactgattgccatggcaatcagcaacaaagaaatctgacgtagacgggtaacgatcattgagaatctcccgtggccgcgttgtcggccgctccgataccggatttatccgaggaatcggatgagcttgacgaaccggacttgtctgacgaggagccggactggctggacgaatcctcggtgctgtccttggaatcgctctgggagctgtctttggaactgtccggggaattggacgcctcggccttcttggcggcgtcggcttcctgctgcttggccagtttgcgcatttcggtgcggataatacccacatgcgactgcgcttcgtccaacgaaccgactgtgatgccttggctcagctggtcacgccatgtctgaggcaggtccgcggtggcgatattggtggtctgcacttcgtgcgaaagctcaagtccaaagagattggtcggcacgccacgataaatggccacggtgccgttgctatctcccacgtagtagtgcgtctggctccacgtgtacacgccccagccagcgccggccaaggccagcacggcaagaatgcaggtaataatcaccgcaagcttattgcggcgcttcttggtgcgcgtggccttcttctgctcgatctgctcatcgcggatggctttggccacatccgggtcgttggggtcggcggacaggcgcccatccggcttttgcaccaccggaatctcaccggtatcgggattggctcgttcaccggtctcctcgcggacggtggacggctgcaccacgcgtgtggacgacggtttggccgtggtttgcgtggtctccgcctcgtgcgcgctggcgggctgaatcaatgctgcggcgcgctgggcgggggaatcatcctcacgcagtgcgggcgcggtagccaccggctcgttgacgatgtcggcaatcggctcaagattacggctggcggcaccgccgaccaacggcgtttggtgcggcaggtcgaacgcatcggcatccaacgccaacgtggcatccgcaataacggccgtgacattatcggtgctgcccgcccgcagtgccatctgcaccagacgctgcgcgcattcgccctgatcggacagcgtggtcatcgtctcttcgatggtggaatcttccagcacaccgcacagaccgtccgagcacagtagccaacggtcggcggggtgggctcggcgaaccgaaatatccgggcgcgggtcaatgtcaaagtcgccaagcacgcgcatcacgacgttgcgctgcgggtagttcttggcttcggacggggtgatacgaccggtgttgatgaggtgctgcacgtagctgtggtcgcacgtgatgcggctcaggcgtccgtcgcgcagcaggtaggcgcgcgaatcgccgatatgggcgatgacccagtagccggccaccaatgccactgcggtaacggtggtgcccatgccggcaagcttgcgttcgcgcttggccttgccgacgatggcgtcatgcgcggccataacggaggtttccatcatgcgggagatcgtctcgacgttgccaccggtgtcgtcctgctcgatgtgggccagcgaccggatggcgatggaggatgccgtatcgccgccggcgtgaccgcccatgccgtcgcacatggcgatgagatgctcgccggcgaaggaggaatcctgattgttcgcgcgcacggtgcccacatcggacaccgtggtggaatacaggaacagcggttgtgaagcggcggattttggcatgcggctacctcagttcgaaggtggtggcgccgatgcgcacaggaatacgagcgggcaggatggtggggcggctgatgcgctgctggttgaccacggtgccattggtggagttcaggtcttcaatggcccactgcccggagcgcgtgtcacggtagacacgggcatggtgggaagacacgaattcgtcatcgagcaccacggtattcgaggcggcgcggccaagcgtgatgtcggcttcggccagcggcacggagctgccggcaagcggaccatcgatgatgaccaacagggtaggctgcgccgaggcggcggacgacgcggaagcgctgggctggcgatgcgggcgcggcgcagctgcctgcggcgtttcggccttggccttatgcgcttcacgctcacggcgacgacgcgcgcgcgaaggtcgcggactgaacgtctcgatgtccttgcgcagcgaacgtacggccagccagatgaatatccacagcaggatcaggaatccatacttgagcagggcgaatgtcagttcggtcataagtggacgactttcgggcgtgtgctcgactactcctgggcttgggcggaggcccagtacaggatgcgggtacggccgatggtgatggtgttgccgtcgagcagcgtggcggcgggcacttggtggccctccacgtacgtgccgttggtcgaacccaggtcgcgggcgatcacgccgttatccgtgatgtcgatttccaggtgcttgcgggagatgcccggatcgtcgatgacgatatcgcaaccggaaccgcggccgattaccgtcttgtctttggtgagcaggtactggttgccgttcacctcgagcaccgggctatcctcggtctgcgcatcggtggtgaccggcacggcattgccctgcacggattcggaggtgaggttgaagttgcccttggacaggtcaaggtcttcctcgaagatcacgatcaccgggcccacgaaggcgtaatgctggctcttcgcgtactcggtgaggttatcggccagttcgttggccagggtctcgctaccccatgcctcgatacggtcgaagtcaggagtactgagcttgaaacggtattcattcggggccaccgtgcggtcacggcccacgggcatggcctcggcgtcaatctcgcgctccaaggcgctggaaagatcgacaggctgcaggtctttggagccaaacttggcgaatactccgttgactgcaccctccacgcttttttcaaaacggtcgagaacgctcatagtcctccctttctaatcttcacccatcctacgcggtgatgggaatatgagacaaaaaaccggtctttcacgtgacgatgagtgcaaaatatccaaaaattcagggcggaaatgggtgcggcgcaccacccgaggtgctttaccggtggagcacctcgggtgggatgcgcgtgttatcgatttgtcaggccagcgcgtcgcgcaggaaatcgcgctggagggtgagcaggttttcggccacggtctcgtcattggtcatatgggtgatgcccgtcaacggcaggaaggtgtgcgggcgacccgccgccatcagggcttgcgagaggcgcaggctgtgggcgatggtgacgttgtcgtcggcgaaaccgtggatcagcataagcgggcgctcgagtttcggtgcgtcctgcacgatgccgtttcggtagtagacatccgggtcgaggcccagatagcgctcggtgtagtgcgtgtcgtacagcgtccagtcggtgggcggggcgccggcgcatgcggccttgaacacgttcggcgcgtccagcacggccagtgcggacaggaagccgccgtacgaccagccgatcatgcacaccttgtcgaggtccggcatgggaatcgcctcccgctggcgggaggtggcgcgaagcgccggtgggtggttctcggcgtctgcctgatcgcccgcagccggctgtgccgcacgtgattccacatcggcgttgagccgggcgacggcctcgggcagggcgttgacggcctcgacctgatcggccagcgttacgtccttcatatcctcgaagatctcgcggtcccatgccgggccgcggccggtggtgccacggccgtctgccgtgaccaccaggaagccttggtcggcccaccactggccctcccagtagaaggactgcgaggcgatgacctgctggaagccgggcccgccgtacggcttcatcagcaccggcagcttctcggcgtgcgcgtacgggctttccgggctcggcgcgatgatcgccgtgtacagctggtgctcgcccagtcgcgtaaacgtgacgttcggtgtaaagccgggttcggccgccgtggacgcgatagtggcgctctgttctcccagaatatgccgcatctgggcgcgggcggaacgcatatcgcggccggagaccacgatgccgcgctcgccgcgcgaggcggtccactggccgggatcggtcgtgaccggcgtgatcgtgccgttgtaatcgatactcaccacgtcgaaactgcgggcgtcgtggtcgccgaatacggactcggtggcggccgcatcggcccaagcgtccggcacctcaggcgcgatttcgggcgcgcgctgcaccacggccagcacatcctcgtcggtcacggcgagcaccgtgcgcacgttccagccagccggcgtgaacgggcggccgtccattgtcagacggttggtgtccgtggccatatcgttgagcgagcacaccagacgaccatccggcgtgtaggcgggcgtgccgtgaaccaggtcgatccactgctcgttcgcgtgctcctcaagcacacgcgtggcacccagcgcggccccatccgccgcgactgccacctcaagcacctgatcgcgggtctgacggcggttctgcaccagcaccagcggatcgtggccgcgacgccagttcacggcggccacatactcgtacgcctcgcgatcccaatccacatcggcgttgccggtgatgcctgcgtaccggtcgttctcatcgaacgccagcgtgatcacggtcagatacacgtcggcattgcgggtcagcgcgcgcgggtaacggcggccggcgtccggcttctcggggtcagccggatcgctgatgtgccaggtcggctcgtcggcggtgtcgaaggactcgaacagcacgtgctgcgaatccggggcccaccagaagccgtcgtatcggtccatctcctcgccggccacgaactcggccagaccgattttccacgtgttttcggccggattgccgtcctcatcctccacgctcacgccgtagacggcggtgatgcggtcacctagttcgccgccgatatcgaccagcatcaggtagctgcccgtggtgtacagcacatgttcgccatccggggcgatgcgcgggttcagcaccggcgtgtacatcgccgggtcctcatcgagccattcgccggccagttcacgggtgtgcggctcgggtgcgccggtctcgtcattccaatcgatgtcggtcaggaacaggcggccgttgatggtgaacacgatgcgattgccgtcgtcatctgcggagtatccgacgatgccggtgccgccttcgcgcgcacgctcgcggcgggccttctcctcggccggcacgtcctcgctgtcggcggttgcgcccagcagttcgcgcgggtcggccagcttggtctcatggtgttcgccggactcgtcgaaccagctcagccacagtgcggtcaccagatcctcggggccgtcggagcgcaggaacagggcccgcgagccgtcgcccacggtctgtgcggagcgcggtgcgccgcagccgaagcgcagcgtgcgcgcccggaggcgtgggaaatgcttgattgcgtcattgacatcattggtttcgctcatacctcacaacctacgcgcctgtgcggtcagtggcgcgcaggcttgcgacgcattcccgggaatgtgtcgtggtgtgggtgcgaggtgtgggcgtgaggcttgtcctaagatgggagccatgcaggtgacgatgatcgacgaaaacaagtacgccgaaacgatgaccgacgtggtgctgcccgcgctcgaacaatgctgcgaggagggctggttcgatccgtccgccgccgaacgttcggccgggatcgagccgctgtccggcattatggacaccggcggccgctcgggccagctgcactacctgtgctacgactccgccaaattcgacgcgattcgcgagcaaggcgccaccgccaccttccgcggggccatcgtcatcagccacggcttcaccgagttcgccgaaaagtacgacgagctcgtctggtacttcctgcttgccggctactcggtgtgtgtactcgagcatcgcggccacggcaagtccgcgcgcgacgtggacaaccgctgcatggtgtggattgatgactggcagcgctacgtggccgatctggccggcttcgccgaaaccatcggccagcagtacgcggccggcatgccgctgaacctgttctgccattcgatgggcggcggcatcggcgcggccgtgttggagcgataccccaccctgttcgacaaagcggtgctctccgccccgatggtcgcccccgccaccggcatgccgctgggcgtggcccgtgtgctggtcggcgcgctgtgcggactcggcttcggcaagaagcgtgtgttcgggcagtcggacttcacgccggagttctcgatggaaggcaacgagggcgcttccgaggcgcgtgaacgctggtacttcaagctgcgttgcgagaatagcgaataccagacctactgcgcggcgttcgaatgggtgcgccaggcgttgaagctcaaccgggccatactgaatccgtccgcctgcgccgaagtggagacgccggtgctgctcttccagtccggacgcgacatctgggtactcaataagccgcagaatcacttcgtccaactggtcaaggacggcggcggcgaggcgaacatcgtgcgcttccccgaatcgcgccacgaaatcttctccatgcccaacagcacttacaagccctacctcgaaaagatcctcggcttctacgacgaccccatgattgcctgcgccgcgtactgatgtagctcttcacccattgttcaccgtgcggtcaccttgtggcccggcccgctttagatggcgggagagccatggaattatgggcataatgtcttctctccgccgccgcgccgccgtggttgcggccgcggtatgcgccggcgcgctcgcgttgaccggttgcacggcgttcaataattccgatgacggcacagcggacggcaacggcacgtccgccaccacgcagaccttccagccgtccggcggcaaaccgactgccaccctgagcattgcctccggctccgaaaacaaggaagtcgccgtcgccatccagaaagcggccgaccaatccaacgtagccgtgacgatgcactacatgggttcgctggagattatgaacgcgctcaaggccggcggccaggatcacgacgccgtctggcctgcctcctcgatgtggatttcgatgggagacaccaagcacatcgtcaaagacgcggccagcacctccaccacgccgatcgtgttcggcatcgccaaatccaaggccgtcaaactcggctgggctgacgacaccggcgccaccaagcccgtctccaccgcggacatcctcgccgcggtcagcgacggcaaactcacgttctccatgacctccgccacggtgatcgacagcgcgctcaacgtctaccagaccgcgctcaggaaacccagctggaccatttgggtggtcgattactccggttcgatgtctggagagggcaagaacggcgtggtcaaaggcctgaacgcggcgctcgacccggaccaggccaagaagtcgtacatcgagcccgccagcggcgacgtgaacattctcatcccgtttgaaaccgaggcccaccgcccggtcaaggccactggcacaagcaccagcgacctgctgcatgaggccgatgccaccgatgccagcggcggcaccgatatctatgaaggcctgctgagcgcgctcgacgagctgcccagcgagtcggaagcctcgcaatacaccaccgccatcgtgctcatgaccgacggccgctccaactccgatcatcaggatgaattcgaaagcgcctataagtcgcgcggccgtgatctgccgatcttctccatcatgttcggcgatgccgatcccagccagctgaagtctctcgccaccctgagcaacgccaaggtattcgacggccgctccggcgacctcgccgccgtcttccgccaagtcaagggcttcaactgatgctccaggtaatctgtggattcgttgtcggactgctgctcgccgggctcggtttcggactggtcggcggcggagtgcccggcctgatcgtggccgtggtactggccgcacttgggtatatcgccgcctccacgctcaccgagccggagcgacgcatcggcaaaatgctggtttccgccttgcccaacggtcagaagaccgccgatacgatcgacgcggcgaacgctcgactcaactcggtcgccatgctcaccaagcaagtacgtgacccagccgtcaaagccgaagccaacgacttcatcgccgctaccaaagatttagtgcaatacgtgacccgagacacctccgcctacccgacgttgcgccactacatcaccgtgtacggcgagcagaccgagaaactgttgcgctcctacgtggacgtggaaagttccggcgcacgcgatcagatagccacggcacgaatcgaaaccatcgaggcgctgcaagtgctcgaacagaccgccgccggcgaactcagccgggcggtaagtgccaagacgttgggcattacggccgactccgacgccatccaacggttggcccgcatggatggatacgacgacgtcgcaccttcgcctgtgccttcctcggctgctgatgaaggacggcatgcacccagtcagactccatctggcggcccggctcaccagtcggaccagaaaacggacgcacaatgaaactctccaaatcaaaaatcatcggactgatcgccctgcttgcggtagtgggcgtggtctgcggcacgctggtgtggcggcaatcgcaaccagcgccggccgaaccgaccgaacaggtgagcatcaccggctacctgggcggcgagaaaatcggcctgttcgatgacgccaagttcaaggcgctcgccgccaagcaaggcattgccatcgactatcgcaaggccggatcgctggccatgatggatgcggaccggaaaggcatggattacctgttcccctcctcgcgcgcggccgtcgaatacggcaatgcgaaaggcgtcaaggccccccccaaagcgacatcgtcttcaactcaccgattgtgctatacacgcacaaggccgtggcggacgggctcgtgaacggcggacttgtgaccaaggacgattctggcgcgtaccacatggatatggccaaagccgtggacgcgatggtcgccaacacaacatggccgacgtcggatacacggcaggctacgggcagttccgcatcgactcgaccgatccggtgaagtcgaactcaggcaacgaatacgcggcgcttcttgccacggtgctcaacggcgggcagccggccatggtcgattcggtggcgcgcgacggcaagaccatcgcctccatcttcgccaaatccggctggatggagacctcttccgaggattcgttcaaccagttcctgaccttgggcgtgggctccaagccgatgatggtgggctacgaatcgcagctgcttgatttggccgtgaaccagccggatgcgttcaagcagatcaaggacgacgtggtcatcgtctacccgacgccgaccgtgtggagcacccacacgctgatggccttggacgagaaaaggcggcacactgctgaacctgttgaaaacaccggcggtgcagaagctggcgtgggagcgccatggcttccgcgcggccaacttcgccggcaccgattcgatcagccgattcggcgtggccggcacgctcgaccagatcccggccgtatccgaactgcccaacaacgatgccatgcaacacctcatcaccaccctccaatccgcgcaagccaaactcgtggccgacatctccatgtacgacacgatgtacacgcagaacgcccagcaataccgcgagctgaaaatgaccgtactggccggcaagaaggcgctcgccgacttcaacgccaaccagctgccagcgctggaggccgaggccgccgccagtggcgacgccatgcaggcgcaagtgctgaagaacttcaagtccaagctcgaccgttttgccaagcgactcgacgacctcgaccgcatcagcgtggttaccttgcagaccgcgccgcagatcaaaatcatccagaacgcggaccagaccatcgtggacaagatcgacaccaccatctccaccacgattccggtgtggaagagtcagatggtgatcgcgctgggcctgtccaaccagcgcaaggttctcgacctgcagaacaaggccgacgatgtgaccaacaagctgctggcgcgtaacgcggccgccctgcacaagggtgcagtggacgcggaaaaggccaaccagcgttccgtggtggaaatcgacacgctggagaagatcaacgccgaactcatcgccaccctgaaggagaccgtgcagatccagaaggaaggcgaggccaaccgcgaggccgcccaggtcaagatgcgccaaatcgagtccgacctcaaaaacgccttgctcgaaaacgcccagcagatgtgagccgttcgcgcgccagcatgctcccgttggcggagtttgcgggaacgtgcaaccatgctcccgttggcagaggtatatgagtacgcctactggtgtgcgtatatatgctcccgctggcgggagctggcagccgtaagactggctgagggtggtcacggcgctcggctcggccggctttaccggcagccattcccgccgcaatttctctgtgggcataatcccggaatgattgccgcgctcgggaattggatgaagtgaaggttaaaggttgagagcccgggagggttccggaaccggccacgataaccgctgctagccccgcgatacgggttggcggccggcagccaagccgattctctcctaatcaaggagtaccgattatggcaatgtttccggctttgatgaatgacacgatgttctcggatctgttcgatgatccgttctttgagggttggcgcaacacggacaacacgatgagtgccgtaatgcccgccaacatgatgactaccgatgtgcgcgagaccgacaagggttacgacgtcgacatcgatatgcctggctttaagaaggaagatatcaaccttgagctcaacaacggctatctgaccgtgtccgcctcgcgttgcagcgagcatgaggacaaggctccggccgctgaggacgaggcttccgacagcaagtgtgcttgcgcgtccgattcgggcaagtggctgcgtcgcgaacgctacatgggctcctgctcgcgtagcttctacgttggcgaggacgtgaaggagtccgacatccacgccagctaccggaacggcacgctgtgcatccaggttccgaagatgcaggcccagccgcaagtcgagtccaagcaccaaatcgcgattgagggctgacgatacttgattcgtcccgaagtcccgcttcgagtagctttgccccctctgacgagggggctcccgcgaagcgggtgggggagagataaatcgtaaccaaaccatgcttcccacgccgtctgccctacgctttcaacgccgactaacctgacagacggcgggaaacatagccaatgcaaatgccgggtagggatttaccctacccggcattttgctgtttcaatcaccgaaccccaccctgttcgcgcgccggtcgcgtgccgttctgccgctgtacacatccgatgggtagagtgacttcgaaacgatgcgagagaggcggacatatggcgaacggcgcacagaacgcaagcggcacaccggcaccggcggcaagccgttccggcggccacgtcgtatccgcgcgcgccacgaccatcggcctgatggcaatcctgctgtggagcttcatggccggcaccgtgcgcatcgtctccgaaaacttcggcgccacgcttggctcggccctgatctacacggtcggcggcatcctgctgctgatgttccggcgcccggccccgattcgcgagttccccaagaaatacctgattatcggcggcctgttgttcgtattttacgaatcgtcgatatccctctcgctgggtctggcctctaccgacgcatcctcggtggaagtgagcctggtcaactatctgtggcccacgatgatggtgctgctgtcggcgggcgtatcccatcgcaagcacgcggtcgtcaaggtgttgccgggtgcgatcgtggccactgccggcgtggtgctggcggtcggcggcaattccgggcttgactggcatgcggccgtgcagcatatcgccaccaatcctttgccctacgcgctggcgttcgtgggcgcgcttgcctggtcggtgtacgcggtgttcacgccagccatgagtcatggggtggacggcacttcattgttcttcccctgcgtggccgtggcgctgtggattatccactttgcgtccgggcagggatggccggccgagccgccgagtctggtcgcatggctgtttgtgctgattgccgcggcggcgattggcggtggttatgcctgctggggatacggcattctgcatgggtctatggagcggctggctattgcgtcctatgccacgccggtgctgtccaccggggccagtgcggtgttgctgggtttggcgctgtcgctgccgttttggtgtggcgcgctgctggtggccgccggatcggtgctcaattacttggtcagtgcgcgcaaatagcggggtgactttgctcatggggcggtaataatcccatggggcggtaaaaccctcatggggcggtatcccaaaatgactttattctgcggtttcacaatttcttcaaaccgccccatgggccttttaccgccccatggataaattaccgcccgatgggcagcagcaacttactcgccgcggcgctcggacgggcggcgaatcgggtcaagcagcgtattcggatcggagatgccgaacatgctgcgcccgccggtggattcagggtgcttggcgagaacggccagcgaaatcgcccccggaatcataatgatcaccaaaagggccgccaatccccagttcacgaagaatccgagccccagtacgatggccaccacaaccaccaccgtgacgataatcgtcaacagtgctcgacgtgggttggtttccctggcccaagaggtgctggctgcgggttttgctgttgaactggccgcggcgtttgtggctgttgtgccatcagccgtgacggtcgtgggccttgccgccgcgctcgtcgcggggccagtaggggcgtcagacacgttatcggcggcattgccggtcgctgctggacgttgttcgtttgcgtgagtcatatccaccagcatattccctgcttccggctgaagctgggacaagcctgcgcgccgctaatccagcgctgacactggccttgagctgcggacgtccagaccggatgtgaacaggtgctgaacggagtctggggaaaccatgagaactcgcgacaatttttgtgaaattgggtgacgctctatgaatcgcgcgctagtgttgcgtgagcttacaaggcgaggagcctggagcgcgggggggtgaaggatgaagaactccgtttggaaaacgttcatggaattgtctctggtccgcggaatcgtgccacggaccgtgttcggactgaccgcgatcgcggcaatcatactggttattggactggcgctgagcaagagcaataagcgcggccgcctgcacccgctgattgtctcgctgattgccgccgtgctcgccggcgcggctggaatgctggttgcatggctggtgtccgacgtgtttatggtgtttggcgtatcgctgggctggccggtgatcttcaccatcgcgggcggcatcgccggcgtcggcttcgtgatcgccgcagccgtgaccatgcgcggagcccgccgtgtgctggccatcgtgctggtgccgctggtgctgctgtccaccgcgctcggcgtggactcgatttacggcgaataccagaccatcggcaccctcgtcggctacacgccgtacgcctcgctcggctcaatcgaggtacacaaggccgcgatgagcgtcagcgactggcgtagcaaggcgcagaagggcagcctgccgtccatgcccagccaaggcaaggtgctcaccgtcgacattccgaacgccaaatccaacttcacggcccgcaaggcgatgatctacctgccgcccgccgcgctgtccgaccgtccgccggccttgccagtgatggagctgttggccgggcagcccggtagccccagtcgcctcatcgacgccggcaacatcgccgccacgatgaatgcgtacgccgccaaacatgacgggctcgcgccgatcgtgctcgtgcccgaccagaacggcgaggccacgcacaacagcctgtgcgccgacaccacgcaaggcaacgccgaaacctacctcaccacagacgtggtgaactgggccaagaagatgctgcccgtggccaagtcggcccgcatgtgggcgatgggtgggttctcgcaaggcggcacctgcaccacgcagctcgtcccgcgtcatcccgaaatctacggcgcgatgttgccggtggacggcgaactcaagccgaccaacggcagcgtcggcaagatggtccaagagtatttcgccggcgaccgcaaggcatacgacgaacaggtgccggtcaacgccatcgcctccagcggcacatctgagcaggcgctgttcaccggtgctggcgaacgggacaaggaatcgattagcaacatgcgcacgattgccgccgccgcgcgcaaagccggcatggaggtcaccgagctgatcgtgcccggcgccggccacgactggcacgcggtgcaggcggtctggcggcccggtctcgactggtttggcgaacggaccggcttgggcgagatggcgaaatcgttgaaggagtacccacaagtggaggtgttgcaatgagcgaagaatcgcgtaagcacaacagtcatgcggcggaaagctggcgcgaactggccggcgacgtgcgacagtgggcggacggtcatcgactggccatcactgccacggtggcgctggtggtgctgaacttggtggtgtggctggtggtcgcgatggccggattcgcgttcccgctgcggctcgacaccagcatggccgaattcgatttcggcaaactcttctgcacgctgttcttggcgcgcggcgtcatccagctcattcttgatgccgtgctgtggctcgtcatgctgtcaatcgccgagccgtggcttggccgcgcacgtaccgtcggcaccgcgctcgcctgcgcgctcggcggcgtgatcgtgggcctgatcttgtgtgcggcggccggatggctgttccaggactcccaattcgtctcccgcatgcagttcgccctgagcccgctggtgttgccggtcggcgcgcttatggcggccagcgcgttctgcagccatctgttgcggcggcgtattcggctgatcggctacgtggcgattctggtcgcgctgctttacagcggcaatcctggcgattactgcattctcgccgccgcgctgatcggacacgcggtcggccgcgtgatggccgggtcgcccgcgcacgccgaaaccggatggcactggctgcgcagcacctccttcgaggcgcggcgcatgttcgcggccatcgccgtggtgctggcgctggggccggtcatcgccatcacctcgcataatcacgcggggccgctcagcacagtcggcctgctcatgagtccggtctccgtcgacgacggcacgctcgcgcgctgcctggccggcgccacgcacagcggctgcttcctgcaattcgacctgatgcgcgcctcgatgcccggcgcggtactgcgctcgctgctgcccaccgccgtgactctggtgctggcgtggggcctgtatcgcggacgtcggttcgcggccacctgcgccgtggccatcaacctgttcacggcgggcgttgccatcgcctattacctggtcgtgccgctgagctttgcgccggatggcatgacctccctgctgcagcacggcgcaatcaccgcctgcgtgacgaacaccttgccaccgctgatcttcgccatcgccttggctgcggcaatgaagcacttcccgattcgcgtcggctggcgccggctgatcggcggcgtcggcgccatcgtgctggttctgctggcgtgcgccgccgtgtacctgatgtacggcattgcccagccggacgccttctcgccgcgcgccacggcctcgtcgctgttggccgaactgccggggcgcttcctgcccatcggcttcctgagccatatgaagttgtcgttcgtgccgcgtaccccgatggcctcgatcgtgtatcagggcgtcggcctggtgttctggatcgtggtgctggtcgtggtgatccgctggatgagcgacgtgagcgaatcgaacgagcgggcgcaggcacgcgccgagcggctggtcgaaaccggcggcgaatcgatgagcttcatgactacgtgggaaggcaacagatactggctctcgcccacgggcaaatcggccgtggcatatcgcgtgctcaacggcatcgccttgacctgcaccgggccgttcggcgagccctccgagtggatggacgacctgaccggcttcacccagtattgcgtggagcggtcgctttcgccggtgttctacagcgtgcatcgcgaacagcgcgacgcgttgctggaggccggctggagctccatcgaggtcggcagcgaaatggtcgtggacccgcgcggctggaagacgaccggcaagaaatggcaggatgtgcgcaccgccatcaacaaggccaagcgcgacggcgtgaccgatgtgcagtccacgttcctggaagcgtcgctcgatgtgcgcgagcagatcgaggacatctccgaggagtgggcgcagctcaaggcgctgccggaaatgaagttcacgctcggcggtgtcgaggaactgcgcgacccgcgcgtgcggctgctttacgccatcgacgcggacgggcgcgtgctgggcgtcaccagctggctgcccacctggcgcgacgggcgcatcgtcggctggacgctggacttcatgcgccatcgcaccgacagtcccaacggcattatggagttcctgatcgcgcgcatggccgagcgcctgcgcgacgaggggcttgcggatcctgagcatgccgtggagttcatgagcctgtccgcggcacccttggccggcatgaaccccgagcgagacaatgcccgggaaggtggggtggcggccggcgaaggcacgcaggtgctccaacacgcgctgcagatcgtggccgactggatggaacccgcctacggcttccactcgctgttcaacttcaagcgcaagttccagccctccgaagcgccggtctacgtgtgctacccggacccggcggcgttgccgcagatcgggctcgcggtggtgcgcgcctacgtgcccagcgtgacgcccgccgaagtggccggcatgctcagtacgctgcggtcgtgaaggtgtgcacacgggtacgcaggctagccgattcgagcctgagacgggctatctgctttcaggaggtacatttggcctcttgcggacagctaactgccttcaaagagatacctaaactctgaaatcccgagtatgagcgttgcaatgacggcgtttgtactcggggtttcccgtattcagtacctctttgaacggagaaagcattctgcagaagcccgaatgtacctctttgagcggcgaaagcccagcgagaagggcgcagaaggcgctatctccgtttcgaggggctgatttggcctctccgggaggtctactcccgcttcgaggggctgatggccgagtattcacgctccaaaatcggcggaatggcgttgacgcggatgggcttttacatgcggtctagctgccgaccagccccttgaaacgggagtagacctcctgcgaaggccgaatcagcccctcgaaagcggttttgccggtgcagaggtgtcgttgactgcatcgcgagccgcctcgacgtagtaacgtggggcgcatgagcgaacgtaacgaacacaatgacggcaatacgcaaaccgcatacttcgccggcggctgcttctgggggctggagcgctacttccagaacgtcgacggcgtcacggacaccacggtcggctacgcgcaatccaccgtcgaatcgccggcctacgagcaggtatgcgcgggcggcacggatgcggccgaaaccgtgaaagtcgagtttaacccggcacaggtcagcctgcggacgctgacattgctgttcctggaggtcattgacccgttctccgtggaccagcagggcgaagaccgcggccggcagtaccgcactggcatgttctacacggacgagacgcagcgcgccgtgtatgtggcggccttggagcagctggtcgaccgccagccgcagcgcccggccgtactggtcgaaccgctgcgcaacttctacccggccgaggcacatcatcaggactatctggtgaacaatcccggcggctactgccatgtgccgatcgccgcaatcgcgaacgtaaaacgccgtcagaagtacgtggaacgcatctgggatctgacgcttgagcagttcgcggtcacacagaacgccgctaccgagcgcccgttcgtcaacgagtatgacgaggagtttgagcccggcatttacgtggacatcgtcagcggcgagccgctgttctcgtcgcgagacaagttcgattccggctgcggctggcccgcgttctctcgcccgattgccggtgacttgctgaccgagcatgaggaccaccgcattccgggccgcgaccgcatcgaagtgcgcacgtcggacacacagattcacttgggccacgtgttcaccgacggcccggccgaccgcggcggcctgcgctactgcatgaattccgccgccctgcgcttcgtgccgcgctcgcgcatggccgaggaaggatacggcgactggatttcggttgtggatggggatgagcaggcatgagcatggagaatattgcgggcgctcgcaagcccgccaagcgtgaggatgagcacacggtcgccggcgagcatcgcatgatgcgccgcgcgtaaccgtggcatcgccgccacgttcgtgtcgcataattgctgcccggccacgtcataattcgccgtgccgcgtgggagcgctgtggcggctacgacgagtcgatgcgcggcgacgccaccgccagtcaagccttcatggcccaccccacctacggcgacggcggaatggccgccgccgtacggttgaggagctgatggtcagccggctaaatgccgatagagctctggatcgattggccgggccaaacgcaggaccgacagggtgaccttcacactgccctgtccggttgcgtcaggcttggtggtgagctgaggattctcaaacgcagcgacgtggccaacgtagtagtacttgccatcggcctcttccgccttgcgcatgacgaatagcgggacgaaatgtgtgtggtcccaattcgggccaatgccgctaagcgcccatcggaattccggagactgcggagtgcgtccgttcttgctgaagtatttcatttcctgtgtgctcaggaattcatcctcgtattggctggccgcgtatttcacgaagatgggcatggtgttggtttccttgtcgagcaggtaaccacccacgttttgcggagtgttttccttcttccatccgcacaggcgcatgacgtcagccatggaatatttgcgctcgtacaagaacatgtggtcgaagacctgttgcctggcggcggcctcgcggaacatatctcggcaattggccataccggtgcgcaaagtgtccgcgaagaagatgcggaacgttcggttcgtggcaagtatgtcggcgaatctgctgctcaaccgatatgcggtgtcgcttcctgtgccggtgctgttcaaggtttcgaccaatggctggttgccaaaacgattgcagttcgggccggtgaaatatgaataatcgagcacgctgatcgcagagtcgaattgcgcgtctgaaccatcggccagcgggaattcagtacgaatcgcatcgagcagttcgctgcggccgattgacgagcccgcactccaatgctgaggtacgtcgtcgtcgagccgttcgctgacgaaatggcatagctgagcaagaatgaccaattcgtgcggtcgcaatccgggcagcagcagctccgctgccatcttgagtatcgcgtcttcaacgtcggtcaccggctccaactgatcctcaaatgtcgcttcatgatgtttgcctttgcccaggcttttttcacgggaacgcacgaaatcaagatagttgctgcgcttcgatgcgatggtatacggcagtgaggggtcgtagttatagatgtccgtaagcatggggatgcggcccagctcgtaacggacttggcgatactgttcggacagctttttcatgtcggaccagtcggcggtgtccaaagacttaaggatgcgctccttggcgatcgggtcgaaactgatggacgacaggccgattgactttcgctgcaggttcttgcgagccctgtcgcggtcgccagtgttgccgtataacgccaccggaatcagatagttgttgttgtaattgccgatgaaatcgataaccacaacgctttctttgtgagggaatttgcgcagtccgcgcccgagctgctgcgtgaagataatgctggattcggtgctgcgcaacatgacgatttggttgacggcgggaatatcgactccctcattgaacatatcgacagtgaagagatagtcgagttcgccttcagtgagcttgcggacgtattcgtctcgctgcgcttgggacacgggcctgccgtcatcgtccgtgctggtaacggcagcggtgcgataggggcgttcatcttgttgattccactgctggttaaacagctgggacagcttatgggcttcctcctgtcggctgcagaacacgagtccggtgaccggaatgttgaactgcccatattcctgcaacttgtcaatgatgtagcggactcgcttttcggtggcaagctgctcgatctcgtacttgagctgtttcgagtccttcgcatcaagacccttggagacatcgagacgatgggcgattccattcggatcgtcgtcggagccaaggtattccgcaacgccgtagtagtggaatggacagagcatgttctcgtccaacgccttttgcaagcgaatttcgtacgcgatgttatgcccgaatagctcgaagatgttgatgccgtcggtgcgctctggcgtggcggtcatgccgagcatgaagtcggcatctttgaaatgattgatgacgcgctgatatccttcggctccagcgtgatgaacttcgtcaaccagaacgtagtcgaattcatcggatttgaattgcgccaaaacctccggctgccgcatcgtctgtaccgtggcgaatacgtagcggcggtcctgttgcttgctggtacctgaatacaatcccaattcggattcatcacagccgagcaccttttggtaagagttcattgcggtttgaagaatcatctgctgttgggcgatgtacagcatgcgcttcggctggcattcgcgtacgtcgaatgcggaaaggtacgtctttccggtgccggtggccgacacgataattgcgcggtgctcgccttgttcacgaagtttcttgagattcgccaacgcctcctgttgcatggcgtttggctgaatgtcatgcccctcaaacgactgcagaatctcatgacgcggtggggcgtatttcttgaaatcttcctcatactgtttgatccactcttcggtcagcggaacggaatcggccacctgtgagtcgatttcatcctggaactgcccgaccagctctccatccgccagcgatgagactttgagattccattcgcgttgcgtggtcaatgcggctccagtgagattggaactgccaacgtacaggtcgtaatagggcgtaccgtctttcatgcggcgagaaaagatatatccctttggatggaatggctgtccttgagccattgcggccactgaggcattgcgggagccttcccacacgcgaacgtcaacaccagtggtgttctgaagatgcagcagctcccagaatgccctgggatcgttgaaatgatttttcgttgaggtaatcagtgtgcccgctcgggtcgctgtttcatggtgacttctgaagtcttcaaataagctgagcacggcctcagccgagacgaatgcgacagaaatgtcgaaggaatcgctagtagccaaggaattgccgatttcctcgcgcatggtcaatccaccggggcgatttgcgatgagggtcggcttatattcgccgggagcatctgagcgcggctcgatcagacctgagatgacatcttcgaggattgagggtgtcgggccaggatcactatgttgcgtgttggccggagagcttgaggtgctggccagattgatagacatgttgtcttgttcccttgcgattcgaattgtttgttgatgactgcatgactgcatggctgcgctatggcgcattcatcggagcgtcagctgtttgctggcgataatcgcgactgcttcgcgatctaccggagcccagttcaatgtcggcatatcggcaggattcagccatcggatatcagtatgctcggtgagatgcggtgtgccggcgatgaggtgacagacgaatgtagtgagccgtacggtcccaaagtcgtaggcgtattcgctggtgcacacttcttccgcgacttcaacttcgcataacagctcttcttcgatttcgcggtgtaaagcctgccgcgctgtttcatgaggttcgattttgccgccggggaattcccagtatccggccaacgacttccccggaccgcgttgtgcacatagtacggtgccgttggtgacgattgcggctcccacgacgttaatgattttgcgttccggatccatgaacaaccaggatacaacgcttcaagatccacaagcgatccacgatcctcgacagtttcgcaagaacgatcctgattcaatcggaactactggaatcgcagtgttctagggcatttgtggaacgaaaagaaaggctgatcaatggtgaatgaacggcagaccgatacgtgtgcggacgtgatgtacaggcgtgaacggcagagaggctgtggcgaagcagggctggacttcgcccctttcattccctcacaggatgaagttgatcagcagatgagcgcattggatgacaagcttgtgtccaaggctcaggaacaatacgcgaaccgagaaatctatcctttggacgagtgctatcagttggacgggtcgacgtttatctcagccgaggcgtttgaagagattcttggcgacgagcaaacgcattatatggcttggaaaaacggctgtattgataagctgtccattgattattgggagatgccggatgtgatggcctatcttgtggagcgcagcattgcggaaggtgacggcggtgaatgctgttatacggatgctcagccgattgattatgcggaagattgtgcgtactcgcccagcgagatgttggagtgcttaggcgccaattggcaagagcagggtgttgccgatgatggtttgagttacgcgttgtacgggcacccgaatatcaatgtcgagaacgtgtccggttcgatgatggtcgtatcgacggagcagcctgggctttcggtgatggttgattatcgcagcggaatttgggtggtccagccgtttgcccatgacgagtcatttgggtctgcgattcagtttggtgagcggcttgcgcccgttgaggctggccttttgcggcccaatgtctatcagcattttttggaggcgaaacatgtgtttgattacgcaatcgcgtggattgaagatgttggggaaggcgctctcgactattgtggtagccaagagaagcgatccgtttccgaggtgagattcgggagcgatccgactctcggcagtgattcatctacgcagacaagccaaaggagcctcgccatgattctcgtcaccaccaccccgtccgtcgacggatacaccatcaccaactaccagggcatcgtcttcggcgaagtggtatccggtgtgaacatgttcaaggatcttggcgcgggcctgcgcaacatgttcggcggccgcagccagggctatgaggaggagctgatgcgcgcccgcaacgaggccatcgccgagatgcagcagcgcgcggaggcgatgggcgcgcacgccgtggtcggcgtggacatcgactatgaagtgctcggtgccgacaacggtatgctgatggtcaccgcgtccggcaccgccgtgcagatcgcgcgtacggcctgagctcatcgagcacaggccaaacctgggccagaactcgtccatcaagccgcactctgtcggttatcgtgacgcattacactggcgctcatgaccatacgaatcgaagcatacgaccggctgcccgacgcggcccgcgccatacgcgagcaggtgttcatccgcgaacgcgactggcggccggaattcgatgaatgggatgccgtgtccgtgcatctgctggcgttcgattcgaacgatgcgcccaatcgccccggcctgtccgcgcaatcggcctcgtctattcagtccggccagcccgaccaacccgggcgatacatcatcgcgcgactggcggtgctgcccgaggcgcaaggcaggcacatcggctcgcggctgctggccgacgccgaacgccgcatcgcgcaagccggcggagccatggccgccgtgcactcggaaaacgaccactacaagttctacgaacagcgcggctaccggctcactgacgaggtctatgaaggcggtcgtcacggctggctggtcaaggacttgattcttggctccgagaattaagggccgctgtctgtcccgcgccgtgttcaaatcgctgcaatacagcgagttcgaagcatcctgtatgaattgctggacgactacagcgcgcagacaatcagataaatcgccacgacgtggcaggcgtacccgatgaccgtgcccaagtgaaacacctcgtggaactcgaaccagccgagaacggggttcggcttgcgcagcgcgaagcatacagcgccggcgatatacgcggcgcctccgcatgcgatgagtatggtcgcagccggacccactgcgggagccgtccatagctgcggaataagcgtcaccggcgccaatcccagcacaacatacacagtggtgaacacccagttcggggtgcgcagccagacgatatgcagtatcgtgccgatcgccgcggtcacccaaatcaccgtgagatatggccggcgaatcgccgggctgagcgcgaacagcacgggtgtgttggtgccggcgatgatgaggaagatgttcgaataatcgatgccgcacagtacgcgagtcaccttcgcgctgcgccacggcacgacgtgcagcagcgcgctgttgccgaacagcagcatggccgaggcaccgtacactgcgcaggccgctttgaccgagccggccggcgcgatgcagatgagtacgatggacgccgcgatgcacagcggcagggtggcgaggtgaagccatccgcgcagtcgcggcttgcgattgccgaatgcatccacggggacgatctggcgcttgatcgccttcagtgcggccttggcttggcggtagcgcgattgcgcggccctgtatcgggccgatgcacggtccagtgcggtggggttggcgcttgcgctggatttttgactcgcggttgcggaaggcgcaactgttgcggcggaagccatggttcgtccagatggcgtgctgatggaaacgctcatactgatcacctcgctatggccggcgacgctctcccgaccactaacctacgctaccgtaacctagtataggcccgcgcaataatcaaggttgatttcgtaatgcttacagttcttccgtggtgtggtattcggtggtgcggttgcggaatacatcgccgagtctgtgaactcgtattatgcgtgtctgctgggtccgacttgtgtcggttcctgatttcggattgctgcgaatgatgctcccgacgccgccccgccagttgccggattcgtacggctcggccgttcggccgagctggtcgtcggtgactccagatacttcgttggtttcgtctcggttcatgatgttatgtaatgctagtttatggcggatggaaagttgaggaaagttaaatctgcttcatgggcttctctctgatctgtatttgtcccggttcatatgtcaatcgtttgacctgtcgaccggggcagaatccgctgtcccggtcggcgatttcggcttgttttcgtgaaccgggacactccggtttcctcaactcatatcgtctggcagacggaatcggcggaataaggccgattctggaattggcacgttgtcccggttttcgcataaatcgattgacatttataccggggcaacaaaaattgtcccggtttgcaaagatcgcccgaaatcgcgaaccgggacagcggattctggcctggcttgaacgtcaaacgattgatgcaggtaccgggacattttccgccacgaaagttgggccataagtctcaagtcctaaagcccccctgaaaaacggcgcttgcccggacaaagcaaaagggctggaaccttccgattccagccctttagttgctggtgcgagtggggggagttgaacccccacgagcatacactcactgccacctgaagacagcgcgtctaccattccgccacactcgcagacaatcgactaacttacacccggctgggtaatcatgcaatcttcggcgtgtcgcatgggaggcagggatatatcgcttgtgggtctcctgcgggcgccgtgatctttgagggtggcggcactcccctcagtcacttcgtgacagctcgtccgcaattaaggacgggccttgcctgcaacctgctggttcgactatcgtctcaccttcgactacaacagcccactgggctgtttgcttaacgtctcagcctcagcggggggagcagagagaagttcggcacaagccgcaacgaaggagaaaaactcacaaccctggccggcgctcgccgttgccgtagaagtgggccaacgcttcgtcgcggaactcatcaaagtatccgccgtcgatcgaggcgcggatgtcgtccagcagcttcacgaagaaatgctcgttgtgaatcgtggccaacgtgaagccgttgaattcgcgggcgcgcagcaggtggtcgacgtatgcgcgcgagtagtgacggcacgtgtagcagtcgcatccttcctccagcggcccgaaatcgaacttgtgctgggcacgcttgatgttgtaccggccggcgcgcgtgtaaatcgcgccgtttcgggcgcagcgtgcgggggccacgcagtcgaaggtgtcgccgccgttctccacgcaagcgaaaatgtcgtccacagaggcgatacccagcacgtggcgtgggcggttttccggcatcgcgtcgcagatccatgcgcaggtgtcgccgatgatgcgcttctcgatcgcgccgccgatgcccacgccgtcgaagtccagagaggcgatctgcgaggccgcacgtcggcgcagatcctcgtaattcgcgccctgcaccacgccatacaacgcctgatacggcttcccgactcgatcagccgtcagccgctggtgctcgtccacgcatcggcgggcccagcggaaggtgcgctccaccgagtcctcctggtaggagcgggtgttcatcagcgtggtgagttcgtcgaacgcgaacatgatgtccgcgccgattttgtgctggatgcccatcgaaatctcagcggagaaacgatgtgcgtcaccattcaaaggcgacttgaacgtcacgccgtcctcatccacccaggccatgcgctccttgcccttggcgatgatgtcgtccgacttcatgccggtcacgtccatcgccagcgtcttcttgaagccgacgcccagcgacatcacttggaaaccgccggaatcggtgaacgtgggcccatcccagttcatgaaacgcgccaagccgccggccgcgtccagcacgtcctcgcccgggcgctcgaacaggtggaaggcgttggccagcaggcactgtgcgcctagatccttcatctgctcgggcaacacggccttcatcgcggcttgcgtgcccaccggcacgaaggcaggcgtgcgaatatcgccgtggggcgtgtgaatgatgccggtgcggccgtatcgggcaccgtctcgcccaagcccgctggccgtggatggcaggcgggtgatcgtttcgaaatggaaggcgctgcggtcgccgggctgtccgggctgtgcgcccaacggatgttcaagaaggctgatcgtcatatgttcactttaggcagaagggccagaaaagggccggaaattgtgaagaactcggtttcgaggggcggatttcgccgctcccgaacgtctacttccgcttcaaggggctcccggtcaagtaggccggctgcaaaaatggcggaatggcgttaaatgagggcccttgatactcggaattgaccgcgcgaacagccccttgaagtgcaagtagatgttcccgaaacaggaaatcagcccctcgaagccgagatgcccataagactctgcgatgattacgcatagactttcaatcaacgttcagaaaacctccagattgactgcctttactactgaggtagcacacgagaagtggcaatgggcaagtgcccgaatagccgccgaacagacgtgataggaatttaggaaaaggagcagcaatggctgacgaatttaacccgcagggcgtcgaccagaccccgcggaataacgaaaaccccaatagtactgccgataccggcaacgccgagccgaagaacccgtttgtgggtggcgactcggttgatgccggcaacgccagcgattccagcgagcagcaagccccggtttcctcggccgccctcgctgccgatcagcagcctacgcaagccgccaccgagcccatcccggactacgcctccgccaagggcgagagcacggtggtctcctcctcgccggcttctccggcagcgccggccgcagaccagacctcggccacaactccgctgtaccgcccggccccggaatacggcgcttatgggccgaccccgactcaggcacagggccagcagggcggccaggccggcaacaatgcccagcccacgcagcaattcccgttcggccagcctgcacagcaaaccccacagggccagcagggcaaccgcaacccctactacaccaataacccacagccgcagggtaacggcaatccgttcaatccgcccacgcagccgcagcagaacaacggcaacccgtttgccagccagtccggtcagaatggccagaatggccagcagccccagcagggcggtctgttcggtttcggcactcccggtaccggtacgccgaacggtcaaggtccgacccagccgggacagcccggtcagcccggccccgccaagcagggcatgtccaagacggcgagcaacatcctcatcgccgtggtcgccgccgttctggctgcggccctctgcctgggcctcggttacggcgccctcaccagcggcctgatcaccttgccgaccagcaattcgctgtccaacgtcagctcgaataagtccggctccgggtccgccaccgccaagagcggcgaagcccccgactggcagaccgtcgccagcgatgtctccggctccgtggtctccatccagaccgcgttgagcaacggcaccgccaagggctccggcgccatcatcgacaccgaaggccacatcatcaccaacaaccacgtgatctccggcgcccagcagattcaggtgacgcttgccaacggcaacatgtattccgccacgctcgtcggcaccgacaccaccaccgatcttgcggtcatcaagctcgacaacccgccgagcgacctcaaggccgtgaaattcgccgattccgacaagctcgccgtcggcgagaacgtgatggccatcggcaacccgctcggctacgacgacaccgccaccaccggcatcgtctccgccctgaaccgcccggtgaccgtgaccgacgataacaacaacgagatcgtcaccaacgccgtccagatcgacgcggccatcaaccccggcaactccggcggcccgaccttcaacgcggccggccaggtgatcggcatcaactcctcgatcgcctccaccgccacctcctccgactccgccggctccatcggcatcggcttcgccatcccgtccaacctcgtcaagcgtgtggccgacgaaatcatcaaggacggcaaggtcaagcacgttgccctcggcgtggtcatcaagtccgacacggttgaagccgacggcgtgacccgcggcggcgcgaccatcaccaagtccagcgccaccggcagcgcggtcgtctccggcgtcccggccgacaaggccggcctcaaggagggcgacaccatcgtggccttcaacggcaacgccgtgaacaacaactactcgctgcttggttacgttcgtgccgcggctttgggagacaaggtgacgctgaccatcgtgcgcgacggcaagaccatggatgtggacgtgacgctcgatcaggaggagtcgtcggtgaacggttcgtccagctcagattccaacggcaacagccagaataaccagaacaaccagaacggcaatggccagaacggttacggcaatggcaatggcaacagcgatggcggcaccggtgacggcggcggcttctccgacccgttcggcctgtggtaaagccgacccaacaacgtcacacggtgttgagcggtaaccgctgaacaccgtgtcagacaagcaaaggcccgtggcagtgagcaaactcctgccacgggcctttcgtatgcgcgattgtgccccgcgcccatgccgccaacgcagtttcgatatccggcatgtcgcgcaacgctcgttgatagggtaggccaagcactgagttcgggcgacgtcctgaacacagcgcataattcaatacaaaactgaatacatttctttacgccgtgtatcggaaggttgcgcgggagccgagcaaagcgaagccccaggcaaagccgccggtgggttaacaaggcgtgaccgtagcgccgattgcgcgggccacgcttgccgtaccgcaatcgactccgtatacgagcgtaaggagcaatgatgggcgcactcatcagattcttcaccaaaattctcgacatctgcaagcttgtgccgatgcttccggtcgtcgtcatcgccgcaattccgttggctttactaggcgattggcgtccgtggggcaatgcgatggcgattccggtactcggcaatccgggcttcggccagtggctggttatcgcactggtgctgattatcgtgattgacactgtgcgcggcatgattgacgatttgcgtcatgggcaggttggagtcgatgtgctggccgtggtcgcgatcctctccaccgtggccgtcgccgaatactgggcaagttgggcggtgacgctgatgatcacgtccggcgaggccattgaggaatacgcccaagccaaggccgagcgcagtctgaccgcgcttatggaagccgcgccgcagaccgcacacgtcgtcaacctgcctggtgtggggtgtgggtttgctaccgataagggcgattcgtccgatggcttccggcgtgtgggcttggcgtcggctgcggccgccgcgcaccgcttcgacacggtgccggtcgagcaggtgcagctgggcgatgtactcatggtgctgccgggcgaaactgtgccggttgacggtgagctgctgtccggcacggccacgctcgacctgagcaatatcaacggtgagccggtgccgcgtgaagtgttcgccggcgcccgcgtgatgtccggcgcggtgaacggctcgactgcattgaccatgcgtgccacccaggtggccgccgattcgcagtaccagcgcatcctcgagctcgtggcctccgcgcaggagtcgcgcccggccgtggtaaaaaccgccgaccgcttggctgtgccctttaccgtgctctcgctgatgattgccggcatcgcatgggcgatgtccggggtgccgacgcgattcgcccaggtgctggtgctggccacgccctgcccgctgctcatcgccgcaccggtggcgtacatcgccggaaccggacgcctcgccgcagccggcgtgcttatcaaagcgcaggacgtgctggaaaaccttggccgcgtcacgcaggtgttcttcgacaagaccggtacgctcaccgtcaagcagccgcaggtcgtgcgcgtcgagatgctgcccggtgccgcaacccgtctcaacgaagaccatgtgctgatgatggccggcgtggtggaaagctactcggtgcacatcctgtccaaaggcatcgccaaggccggaacggaggcgatggcccgattgcgccagcggttcgaggatggtcagcggctctgccccgagccggaggccagctggcccggccatggacgggagtatccggtcatcaagaatatcaatgaagatgccggcaaaggcgtttccggcgaggtgaacggacatgcggtgcgcgttggccggctgtctttcgcggctgctggggaggatggattcctggcggtcggcgaggctgcccccctcagcccgcgaagcggccagctccccctaagagggggagctcagcaaaaagatgacctgcgcactcgctttggcctgctgcagccggatgagatggcgtcctacgtgtccgttgacggccggctgatcgcgcgcatcgtgctgcgcgatgtgccgcgtgccaacgccaaggcagtgctcgccaaactgcatgagttgggcgtcaccgagctcgccatgcttaccggtgacaagcgggcttccgccaatatcattgccagcgaagtcggcattgacgaggttcacgccgaactgttcccggaggataaggtagccgcagtcagggccgctacaggagccggcaaaaccgtcacgatgatggttggtgacggtgtgaatgatgccccggtgctcgctgttgccgatatcggcgtggccatgaccgatggcacgtccaccgccgcttccgaaagcgctcaggtggtcattatgaatgacaatatcgccgccgtgccgcgcgccatcgccattgcacgccgcaccaagcgcgtgatgcttcaagccgtaatcgcgggccttgtgcttgccaccatcggcatgattgccgccgcgttcaaccttatcccggtcgtcgtcggtgccttcctccaggaggccatcgacgtggtgagcatcctctgggccctcactgccctaattgatcgggattgattaagataaaccggaattgattggagccgcatccggattatgtgcaatataacaagttgatatcaatattttgtgtgtgcttaccggatgcgggcgccgtaggtggcagtctattagactaaaggctgtttgcagcatcatttaggggcattgaggcccttgccagaggagtcgatatgtcagagggtgaggaagagctcaatgtgggcgcagtccgtttggaggaagtggcatcggcggctaatgtatcgctgtccactgcgtccaaggccttgcgtggaaagcctcacgtcagcgagaaaacccgtattcgagtgattgatgctgcgcagaggttgggctatagcgctgcagaagctatggcatcgatggcaaggttaagcgtcagggattctcacggcgtgcaggattttcgcgttggcatcattggcgttgatatgaaaggcgtcttttccccgaccattcttattggagcggagaatgcgtttcaagcgcgctcagccgcagcgctgctgttcaatgcgtcaggcaatgaggcattgttccacagtggtattgaacgaatgttggtgcaaggagtgtcgggactgttgattatcagcaggcgtacggatccggtgccatactacgtggattctccggtacctgtggtctacgcctatggcccgtcccgtgatcccgatgattgttccgtggcacaagacaatgtggaatcagggtgtttggccgttcgccaccttctttcctgcgggcgcactcgtattgcgattattgctggcgactccgagtgctcggttgcacatgaacggatgcggggtgcgctcaaggccttgcatgatgctggattacagttggttggcgaagcgcggttcggttcatgggaagcggaatgggggcgcgccgctgcccgtctgctgctcaatgacggtgctgcattcgacgcagtgatatgccaaaacgatgtgttggctcgtggctgcatcgaggaattggaacgtagcggatgtcgcgtgccgcaagacgtagcggttatcgggcacgacaacagtccggattatgtgtcgtacgcgcatccgttgcttacttctattgatgacaacaacgaaatgctggggcgtcaagctgccctatgtctactggatgcgattgcggggcatcctcaccatggtgtggagcgtgtgccggtgaagctaatccaacgcgagtcaacgttgccgttggattgataacgtcaccggataggcggcagcagccggtttacatcttgcgtggcatcatccagacctttgcgaatatcattgatgccggaatcctgtacaaggccgtgaacgtcgatgttgctttgttcgctcaacgcttggccgcgtacgcgcatgctatggataaatcgtccgaccttgcgtgcgtagtcgggcagcttgtcggggcctaccagcactaaagcgatgacaagaatcaccatgagttccgtgcccgaaatgccgaacaacatattattctccttctgcagttattgttgcaggggcttcctgtttgccggtgcgcttggctttgcgcgccgcgcgaaatggtaacgcggcgcgcattttatgtaaaagtttgagaagtttgggttcttcgcccgccgcgcgcatgactttccatagctggatgtgctcgtatactgcgcatacggctatggctgcgaaatagattgcgatgatgggcaaagcgagtgcgcataatgttcctgggtcgccggttggcgtggccacggccgcgaagataaacgctatgaccgttgcgagacgccactgcttcaaccatgttcgtgtttcgaccgcattcatcatcgtcaatgccgccataactacgggtagcaggaatgagaggccgaaagcgactgtcatgcgcagaatgaaatcaaaatagacgtcggcgctgagcaatgtggcggtgtttgcgggggcaaagccggtaaggatcgccaccgcttggggcagcagataccatgccagtccggctccggtgaggaacagcggcactgaggctccgatgaatgtaaccgcggtccagcgctctttgcgcttcaaccctggattaatgaatgcccacacttggtatgaccaccacgggcaggaggccgtcagaccaaggaagaacgcaatctccagctttacgttgaatgcggagaccacgccattgaatgtgatgctcatcagtccctgttgctgcccggccgccgtcaggaacggttgttgcaggatacgaaacacctgatcgctgaacatccatcccactatcgacatgatgatgatgccggcaatggcccgaacaaagcgtttgcgaaattcgacaagatgatcggccagaggcatcaccgcatcggggttgcggggcttgcgcgttttggacttgcgccctacaccccgcttccaccggcgtgtagggtgttgcgcacccgcgctggcctgctgcgtggcctcgtgtgagtgatcgatgagatcgtcgaggtcaagatgtgtatcccgatcgccgggatgcatcgccggtgcaaggggtgccggaagcgcggggtttccgggaaccgtgctcatcgctgttcggctccggttgctgtagtcggggcggcggtggcgttcatcgtgacggcttggggtacggcgggagcgggagccggtgctgccgccggagctggggcaggggcgtcgctgactgtattgacggtttgttgtgttgccgggtcatcggtcttggtctcggcacggaaaatcttcatcgattggccaatgcttttggctagctcagggagcttcttcgcgccaaacagcagcacgatgataagtagaatgataatgagctcggtggggcgaagattaggcatgatagtatgtccttccaatttctgtgttgtgacaggggaagggtatacctcattaacgcaccaatttatcagtatagcgaggaatggtgtgttgttcaagttgaagtgcggtgttgcgtttgagctgcttgtgagagttgctcgggaacatgttaatttgaatgcatttactgtgttattggtgagcatatgtgtttgggttcgttggttttcgcaagaggaaaacaaaaggaaaattacgaaaatagcatggctggaaatgctgataaagactgattttcattggtattgtgcgctacgaaaaccagagaaaaaatgagtgagtcgctttctttgacgcatggtgagaatcgtctgtttgagttattgtgaacgtgcacaacgaagacaagcggcatggagggcgcgcaaaaactcgaataatcgcatatggtaactgtttgctttaccgtcatctctcccatacatacatgacgacggggacgcaccacaatgatgtgatggtaaaacgggcagtaccagacgattccgagtatgtgtgtgccatccactgacgcatcttacctgcgtcgtcgggccattgaatggattaagtgcattgaatggttgcgaatgcggcagagtgtcttcgtccgtcatgcctcgcaatgaacgcgcggcagtccaacgaaggagcaagatgagttcaacggaagcaacaaacggcatctctcgccgtgctgtgctcgcaggcgcggccgccatcggcggcaccatcgccgtggcgagtgcattgggtacaggagtgacaacggtgcaggcagcgccatccgtcgctggcacggcaggtgcaacgggcgcgaacggcgcgggcggcgtggccgttcccgcagcgcagcgcaccacgaaaagcgcgaagaccattaccgacgcgcccgctctgccgggctggaaggtagctccgttccctctgcggaacgtcgccatcacctcgaacagcgtgttcgatcgtgccaaggaagggatgctcgactatgcacgcaactatccggtagaccgctggctggtttgcttccgtgcgcaggcgaacctgctgcctaaggacaacacgacgcagccttccggtggctgggagaacttccccagcggctcgctagacaaggctgttgaacagcaatggggcgatgccgaatacacgcgtggccagaacaagaacggtgctgatggtctgttgcgcggccactttgccggacatgcattgcacatgctctcccaagcgtatgccgaaacgggggaggaagcgattctcaacaagatcaacgagttcgtctccggcctgaaggaatgccgagattccctgcgcgagatgaagtataacggcaaagcccgctacagccaccccggcttccttgccgcctacggcgagtggcagttcaaggcattggaggaatatgctccctatggcgagatttgggcaccgtggtacacggagcacaagattcttgccggtctgattgccgcttacgagtttgccggtaatgccgacgcgctcgacctggctgaaggcatcggacattggacctatgcgcgtctgagcaaatgcaccaaaacccagctgcagaagatgtgggacatctacatcggtggtgaatacggcggcatgaatgattcgctggtggatttgtacaacgtctccaaggacaaggaccgtagcgaatttcttaaggcctccgcatttttcgacactgacaagctcattgacaactgtggtgctggtgtcgatatcctcaacaacttgcacgccaaccagcacattccacagttcgtcggttacgccaaagacgcggccatgggcgacgcggatatcgatgctgatgctcgtgcgcgttatctcaaggccgttgaggggtactggggcatgattgtgcccggccgtatgtatgctcacggtggtactggcgaaggcgagatgtgggggccggcacatactgtggccggcgatatcggcaagcgcaacgcggaatcctgcgcggcatacaacatgctcaaggtggctcgctatctgttctttatcgaacaaaaacctgcctacatggactattatgagcgcacgattctcaaccatattctcggaggtaagtcccgtgacctcgattccggcacggccctcacgccgggcaactgctacatgtacccagtgaatccggctacgcagaaggaatatggtgatggcaacatcggcacttgctgtggcggcaccgctctggaaagccactcgaagtaccaggattccatctacttccactcgacggacaacaaggaactgtacgtcaatctgttcacagcttccacactcgactggaccgacaccggcctgaagctcgcacaggaaaccaactatccggaggaggagacctcgacgatttccattacggccgcgccgaagagcgccgtcaccttccgcatccgcatccccgcgtggagcaaaggtgcgaagatcgaggtgaacggcaaggctatagatggcgtcaccgctggcgaatacgccaccgtggccggcagctggaaggtcggggacaagatcgtcgtcaccatcccgctgcagctgcgcaccgagtcgactgatgaccgcaaggacatccagacgctgttctacggtcccacggtgctcaacgcgctcaacccatccaccaagttcatccaacgcggcttctacgagcgcaacggcttggatggcaccatcaaactgggcgtacagaagaaggaaggcacgaagaactacttcatcattgacggcgacgagttcgagcccgcctacaacggcgacaacaccccgtaccacatgtacttccagcgcaaggacgagtatgtgggcttcgcaggcaagctcaccgatgtgctgaacccgaagcgcccggctgcacaggaccgtagcgagagcacgctgatggatgacatctgggcgggcgcgccgttcaaggaccgtgccgccttcatcaagaaggtgcaggaggtcacgaagacctatcaagacgaggggctgctttccagtcgtgatcgtcaggtggttctgcttgcctccgctcgcgccaagatgagctgacgttttcctgcgaccaaaccgtctcccgtagtgcacgacacggcgggagatgagtgatacaaaccataacgcctaacagaaagaatattatgaccatcgaaagcactacttcggccgtgaagggcggtgtggcgaaacgattcgccgcactgttcgtagctgcggccacgctgctggctggcggtgtcttctccgtatcggccgcgccgagtgcactggcggacgacgctgaaacgaatgttgcgctcaatgcagaaaaaggcaacgacaatgcaccagacgttcaggtcagctatgtcactggctggaacagcactgctgccatcaatgacgatagcttggacggcaacgccagctatggcggttggggcacttggggcaacaccagtgccagcgaaactgccacttacacatggaatcgcgccgtgaccacgtccaagtctgtgggctactactggacgaacgtcaagaccggtgatggtggcgtgccgctgcccaaggatgtctcgattgagtatctcaatgctgattccggccagtacgagaccgtgccgaacctgaaggtggacaagacattccccgccgacgacgagctcgacgccaccaacccggtgtatggtccgtatacctacaccttcgaccaggtcaccaccaagtccatgaagcttgtggtgaacaagaaggccaatgacaacaagggtattaccgtcactgagtggcaggtgtttggtaccagcgctgcactaccagtggatccgggcgacccaggtgctttcttagacgtgcagcaagttgccgtgcgcaccacgccgggcgtggacccgacctcgaagttgcctgcagaagtgtgggcgacacctcaagatggtcccagcattaaggttccagtgacttgggaaaccgttccggccgacgcttatgctacagctggtactaccgccgaagtcaagggcactactgctgccggtacctatgacaacatcaaagttgcggccggtcaggcgacggccactattggtgtctacgaccagctcaacaccgaggtgaccgacgcggagtacgtctccaccatcaccgctcccggtgtcaagccggtattgcaggataccgtggcgctgacctacgctgacggctcggtcgagtcgggtcacaaagtgacttgggacagtatcccggccgccgagtatgctgaagtcgaacaggtcggcttcgtggaaggctctatcgagggtgtcggcaatatcaaggcggaaggcacgttcttcgtcgtcgcgccttccgacccgaaagcccagccgattgttgctatcgatttcgactccgcggcccccggctccggctggtacaccactgccccgaagttcaccatcaccgcgcagcgcggcgtctccaccgtgccgataaagacgatcgagtacaagatcggcaagggcgagtggaccagtggcaagggcccgatcagcgtgaccgcgcagggttccgtgaccatttccgcccgtgccaccgatgaaaacgacaacagccgcgaggtctcccagaccatcaaggtcgacaccaacgtgccggtggtcaccgctaagcaggagagcaagaacggcaacgatgtggtcgtctctctcaccgctgatgacggtgccgcaggctccggcgtgacccgtgtgctgtactccaccggcccgtccagcaacccgaagtccaacgagaacacgatgtggggcacctacaccgacgaggacaaggtgaaggtgcagctctccgctgaccacgacacttacgtgcacttctatgcgcaggatgccgccggaaatgagtccgactacgccaacatcaatctcggcaagggcgaagccgtgaccccgaccccgactccgtctgtggattccgttgccgtctccggtgatggtgtcaaggatggcaagctggcgctggtcgctggtgatactgcccagttgtcggccgaggtgaaggtgaccggtgatgcggccaagaccgtggcctggaagtcctccgacgcgaaggtcgctactgtggacaaggatggcaaggtgaccgccgttgccgaaggtacggcgaccatcaccgccacctccacggttgacgagaacaagtccgcgtccgtcgaagtcacggtaactaagcccgaggctccggttccgcctgccaccgatgaggagcgcaagcctcttaccgacaagatcgccgctgttgagagtgagaagctcaaccagaacgactacacggctgattcgtggaaggcatatgcggatgcacttgctgccgcaaagcaggtagtcaaggatccggccgcaaccgcaccgcaggtgaccgctgcgctcaacaaactcactgccgcacacgatggtctcgccaagaaggatagcggcgaaaagcctgaaccgcagaagcccggtcagcagaagcctgggcaaaaccagaagcctgaccagcagcagaagaacgctactaccactgcccccacgggtagtgcggtggctgccgttgctgcggccgtagttgtgctcggcgcggctggcgccggtctggttatctggcgcaagcgccgtgcctgacgtgaggctattgcccctaggctaataacaacccaataattgaatacaggtcttatacctgaagttgatctgcgtcgcactggcttgaacccgaatcgatgttcgggctaagcctgtgcggcgcatttcgttgcggctgtgttgctcataatccggtatcggagttattcattaggtcggtttgacgtttattaggtcggtccttggtcggagcggcccttgaaaccccgccgttccaagggatggcttcagcaccctccgacctaatgaacgaagaaatgacctaatgaatgcaatcgaggtcgtaaagagccgttggaggtgacgtcttcagtgtcatcaagggattcgccggttgtgcagtattgttattgttctgcggcggctctttaccgtcggccttctagccaatcgagggcggaagtgacgcggattccttgtgagacataactatgttcaacccgactggttacgtactgttgctcacacggtataccgagaacattgccaattaaagtgaggtgccgagcgaatcggtcatgataggtttgtccggatttgatttctatgagcatacggttgttaggatcggtgaaatccaacaaatccacctcgaccttgctggcatcgcggtagaagaataattgtggctcctgattggcgttcaaatgctgtttcatggtttccgcaatgatgaggttttcaaatatatcgccgaacttggggtgcgcaaccagtgcttcgaccgtccgaatgcccaagagatggcacagcaagccagtgtcataaaaatagagtttcggcgttttgaccacctgtttgcgtgcgttcgtgtagaacggtatgagatggaatgcgatgtaacttgattccagaatcgacatccatgcctttacggttcgcggacttacaccaagttcattggcgatgttggtgtagtttatgagtgctccggaactgagtgcgcaaagagtcaagaatcggcggaagtcagccaaattgcgtacatcaagatattcggaaacatcacgttcgatataagtgtcgatgtagttcgagaagaacagattgagcggcattctcgtgtcgtaaatgcgtggataaccgccttgcagcataaacgtatccggagtaagggcctgatccgccttgcatgcttcttggaatgagaacggcaataacttgaccaaaccgactcggcctgccagtgattgttgaatacgcttgagtagtaggaaattttgagaaccagagagaacatattgtccttgttcgctacgttcgtcggaagccacttgaatcatggagaacaaatcaggagcatattgagcttcatccactatgagcttggaaggacgctgccgaatgaatcccaccgggtcgtcaatggcggctttgcgtgtctcaggattttccagattcacgtagtcataatcagggaacatggcttttgccagcgtggatttgccgctttgccgaggcccggtaatagagaccacgggaaaccattgcgcaagttgtttggcctgtttcccgagcgcgcgtggaatcatcgatgcctctttcccataatccgacattactgattatcataatcttacattagagaaacccataatcctacattagggaaacccataatctgacattagcagtgctcgtaggtttcccaaacgcacaaactatggcctaatacacagaattcccaccaccctccctctgtcgcaacggaaggctttgcgttaggctagagcgcgtgactgaatccgtgaatactgaactccgcattgctgttatcggcgctggcccggccggcgtctactcatccgatatcttcctgcgccagctcaagaagctgggcgaagaacttggcctcggcaccgaagcgcgcatcgacctgttcgagaagctgccggtgccgttcggcctggtgcgttacggtgtggccccggaccacccgtccatcaagttcatcgcctccgcgcttgagaagacgctcgacaacccgaacatccacctctactgcgacgtggaattcggcaaggacgtgactcttgacgacctgttggcccgttacgacgccgtgctgttcgccaccggcgcggtcaaggacaagccgctgaacctgcccggtgccgaccttgaaggcgtgtacggcgccgccaagttcgtcgaatggtatgacggctaccccaccggtgcccgcgaatggccgcttacggccgagaacgtcgccgtaatcggcggcggcaacgtggccatggacgtggcccgcgaactcatgcgcaacgccgacgacctcaaggtcaagaccgacattccggacaacgtgtacgagggcatcggccagaacaaggccaaggtgctccacctgttcatccgccgtggcgtggcccaggccaagttcagcgtgcaggaactgcgcgagatggagaagctgcccggcgtgcagctcatcatcaacgaggacgacttcgatctggacgacgagaccatcgaggtggccggcaaggacaagctcacccgccagatggtcgaggagctgttcgccgtccgcgagatggccgaagacatggaagatgacggcgacgtcgacttcgaaggcaacccggccgaccgcaagtactacgtgcacttcaactccgcccccaccgagatcctcggcgaggacggcaaggtcaaggccatccgcgtggagcgcaccgaaaccggtgccgacggcaagatgcaccgcaccggcgagttcaccgactacccggtcgaggccgtctaccacgccatcggctacaagcccgccgaagctcccggtatcacctacgacgagcacggcgcccacctggccaacgccaacggcgacggccgcatcaccaccgaggccgacggcggcaaagtgcgcgaccgcctgtacgccaccggttgggccaagcgcggcccggtgggcctgatcggctccaccaagtccgatgcgctcgccatcgtgaccaacatgctcgaggatctggccaaggccgctgaaggtggccgtgtggcagccgaccgcgaccccgaatccatcgaccgactgctggccgagcgcggcattcgcccgatcgacttcgccggctggaagaaggtcgacgctttcgagcgcgccgagggtgccaaggaaggccgcgagcacaagaaggtcatcgagcccgaccagatgcgcgagctcgcccacgcctgacggcccgcccacgcccgtctggcattcgtccacccagccgcgccccgtgcggacgcggccgggctcggggccggacgggccgggcgaatatgggacattgcgcgtggcgcatatccagcaatcattcagcctgcgattttagtgtgtgcattatggatgccaaagtacgggtgcacggccatttcaacggcctgaaaacaacgctgctgtttgccctgatgtgggccatcatcatgctgatttggtgggccacgggcggcagtcggcaaaccctgagcatctatatcgtcatcggcctgattaccacgttcggcacctactggttctccgacaaactcgccatcgcctccatgggcgcgcgggaagtcagcgagcaggaagccccggagatctaccagattgtgcgtgaactgagcgccaaggccggcaagccgatgcctcgcatctacatcgcccccaccatgagcccgaacgccttcgccaccgggcgcaacgaacggcacgcggccgtctgctgtacccaaggcatcctgcagattctcaacgcccgtgaactgcgtggtgtgctgggccacgaacttatgcacgtgtacaaccacgacatcctgacttccgccatcgcctctgccatggccactgtcatctcctaccttggctattcgctgatgtatttcggtggcggctcgcgagacgaccgcgatagttccggtggcctcggcctgatcggcgcattgctgagcgtgattctcgcgccgattgccgcgtctttgatccagatggccatctcccgcacccgcgaatacgacgccgatgaagacggcagcttgctcaccggcgatcccgaggccctggcttccgcgctgaacaagatttcctacggcgcacagaccgcgccgatgcgcaaaaccgccggcacccagtccgtctccgcaatgatgatcgccaacccgttctccgcggtcggtttctcgcgcttgttctccacgcacccgccgaccgatgagcgcatagcgcgtctcatgcagatggccaacgaaatgaacggcacgccgatcgctccgcccacctactccacgcgcgtcggcaggtgacgtgctaggataactattcgtgcctcgtttggctgagcatgctcgtcacgtgaggtgcagcagccgtaaggcatgcggacatagttcatcggtagaatgaaagcttcccaagctttagaggcgggttcgactcccgttgtccgctccattgattttcaatgattttcattatttccgggaaagtgtcgcgcacgatcgcaaaactacgcgctatttgagcgctttgcccgcggaacccagctgccggcaagcctcgaccacgcgggcggacatggaatcctcagccttacggccccaagaacgcggatcgtagaacttcttctcgcccacttcgccgtcgatcttcagcaccttgtcgtagttctcgaacacgtggtcggcgattggacgggtgaaggcgtactgggtatcggtgtcgatgttcatcttgatcacgccgtagcttacagcttcggcgatttcttccgggcgtgaaccggagccgccgtggaacaccagctcaaacggcttgccgttggggaaatcgactatgccggccgcgctaggcaactcgccttcggccaccgcgcgcgccacacgcgcctgaatgtcgccgagtagcgacggacgcagcttgaccacgccgggcttgtaggcaccatgcacattgccgaatgtgaaagcggccatgtaccggccacgttcgcccaaacccagtcggcgggcgacttcgaggccatcttccggagtggaatacagcttttcattgatttcggcggagtgaccgtcttcctcaccgccgaccgcgccgatttcgatttcgagcacggtgtgcgccttctgcgacttgtcgagcagttcctcggcgatgtccagattttccttgagcggcacggtggagccatcccacatatgcgactggaatgtaggctcctggcctcgtgccacctgatcggcctcatgcgcgagcagaggacgcacccactcatccagatactgcttggcgcagtgatcggtgtgcagagcgatggtgatgttcgggtatttcgcagccacttcatgtgcgaaagccgccagcgccagcgagccggtaacgcgatcattgacccccctgccggagacgtaggccgcgcctcccacggaaatctggatgatgccgtcggactcggcgtctgcgaagcccttcaacgcagcattcagtgtctgtgagctggttacgttgatggctggataggcgtaaccgcctcggcgggcggcctcgagcatttcggtatagcgttccggtgttgcgatcgtcatggcttcattatcgcgcgaggcatgccctctaggctccgttcttcaacctgtgcgctgtgcgattggtcacagcatcgcctcgtacgagtagaaattcgtcacccattccgggttgtcgcacctccagcctcgccctgcgtgagacgaaacttcgcagggtagagggtgtacggtagtctgtttccggcggaatcgtgcgaatgcggaggtgcatcatgcctggaattgttcttattggtgctcagtggggcgacgagggtaaaggcaaggctaccgatttgatcggcaccaaggtcgattacgtcgcgcgcttcaacggcggcaacaacgcgggccatagcgtggtggtcggcgatgagtcgtacgccctgcacctgctgccttccggtattatcaacccgaacctgaccccggtgatcggcaacggcgtggtcgtggacccggaagtgctcttcgaggagattgacggcctggaatcccgcggcatcgattgctcccacctcaaggtgagcgaggccgcacacatcatcgcgccctaccaccgcacactcgacaaggtgaccgaacgcttccttggcaagcacaagatcggcaccaccggccgtggcatcggcccggcctacgcggacaagatcaaccgtgtcggcatccgcgtgcatgacctgttcaacgccgaccatctgcacgacaaggtggaggccagcctacaccagaagaaccagatgctggtcaagctctacaaccgtcgtccgattgacgtggaccagaccaccgaggagctgctgaagctcggcgaacgcctcaagccgtacgtggccaacaccggcctgattctcaacaaggcgcttgacgaaggcaagaccgtactgttcgaaggcgctcaggccaccatgcttgacgtggaccacggcacctacccgttcgtcacctcttccaacccgaccgccggcggcgcctgcaccggtaccggcgtgggccccaccaagatcacccgcgtagtcggcgtctccaaggcctacgtcactcgcgtgggcgaaggcccattccccaccgaactgctggacgagtccggcgaatggctgcgtcagcagggccacgaattcggcgtgaccaccggccgcccgcgtcgctgtggctggttcgatgcagtcgtcaaccggtacgcctcccaggtcaacggcctgaccgacatcgtgctcaccaagctcgacgtgctcgccggcctgaaggagattccgatctgcgtggcttacgacgtggacggcgaacgtcacgacgatatgccgactgatcaggccgctttcgccgcagccaagccgatttacgagaccatgcccggctgggatgaagacatctccaactgccactccttcgacgagctgcctgccacctgccaggcctacgtcaagcgtttggaagagctgagcggctgccgtatctccgcgatcggcaccggtccgcagcgcgatcatgtcatccagatcaattcgctggtcgactgaccgtctgcaacgaatttcccggcttgactggtaacgacgcggcacatgatatccgccggctgattccgcgattcgaccacttgaagtggaagatggcggcggccggcatagtcattggtctggtttcaggattgctggttgtcgtataccgtctcggcatcgaatacggcacggatgcgtcccgttggatatatgcgcggattcgcgagaccccgtggctgattgcgccgtgggcggttgccgcggtggcggccgcgctggcgatcgcgtggatggtcggcaaggagccgatggctggtggcagcggcatcccgcagaccaacggcgtggtgatatgcggcttgaagatgcgttggcagacgattctgccagtccgtttcgtcggtggactgttgggcgcgttgtttggtctgtcgctcggccgtgaggggccgtccattcagattggtgcgtcgggcgcgcagtgtgtgtcccaccgtttgcgcggccgccgccgtgaggacatgcaggagcattatctggtcaccgccggtgccgcggccggcttgtccgccgcgttcagcgcgccgctgtccggcatgatgttcgctttggaaggggtgcatcggagtttttcccctgcgattctgatgggcgccaccgccgcatcgctgaccgccgatttcgtctcaaaatactgtttcggtctgcgtccggttttggatttcggtgatatcggtcagctgtcgttggaagagtatgtgtggctgattccgttgggattggtggccggtttggttggttcgctgatgaaccgctcgttgcttggcttccagacgctgtacggcaaactgccggcatggagccgcccgatgattgcgattgcgatcgcgttgcctgtcggcatctggttgcccgatgtgctcggcggcggctcgaatctgattgataccgccgaacatgcgcgcgtcggcttgggaatgctgtgtctgctgttcgtggcgaagatgctgttcacatccacgagtttcggctcaggcgcgcctggcggtattttcatgccgattcttgcggtcggttcgttggccggcggcatctgcggtgaagtgttgcatcgattcggtgatctgccatccgacgcagtggcggtgtttgcggtgtgcgtgatgacgggcacgctcgccgcgtccgtgaaaacgccgatcacgtcgattctgttggctgtggagatgtctggaacgttgacgcacatgctgccggtcgcggccgtcgctttcgtcgcgctgttggtgtccgatttgctgcgcaccaaaccgatttatggggagttgctggagcggtacgtgcgcgcgcaaggcatgcagatggcgatcgcaagccatgtgggcagcggcattatggaactgccattggaaatgggagcgattgcggacggcaagcgggtgtgtgacgtgcgttggccgtctgggtgcctgatcatcggcctgcgtcgcggcgaaagcgagatcgtgccgcgcggcgatacacggctgcgtgccggcgactatctggtggtgctgttcagtggcgaggaggagcgcgaggtgcgacctgcgatgcggcggctgtgtgatgcccggcttgactgagcctggctgaattcggctggactctggatgtacgaatctgcggaatcggacatccagggtgcatacgttggcgctccgtgtaaactcatatgcgttaggaaggcggcaaccgcggcccagctcgttgttgcacggcctatgggcggaacaacgctgtccgcggaaggccagtacagggggagcgcaatggaatcgcaagaacaatcgccgggagacgtggtgactgcgggtgaggactcacatcccatcacgcaggcaatcgacactgttgaggtgatgcatgctggtgcaaccgcgcccgccgctaacaccatggatccgcctacgattcccctggcgccgatgaaacgtatgcaggcgcggttcaatccgctcgccgacggactgatgtatgttgtggtgttcgtcggtggatttgttggagtcggctgtcggcatgcgttggatatgctcctgccgtcggtcagcgggacgccattcgttgtgggcacgtttgtgtcgaatatggtcgcctgcttcctgttcgcgatgctgaccgaattcatggcgaccgcttcgtggctgcgtcgccgggtgcggcaggttgtcagccgtggcgttgggctcggcttgctcggcgggctttcgacgatgtccggcgtgatgctggaaacgatggaaggtctgcacgagcggcatatcgccagtgcgcttggctatcttgcgggaaattttgcaggcggtttgctcactgccgccgccggcgtggttctgatgcaggcactgctgtcacggagtactcgaaagcgggttcggggtgcgttttcagctgtttccgtgtccgattctgccgaatcggacacgcagggcgtacgccatgtgaaagtggccgacgtggcgcgttctgccgcgcaggccgcaatggaagccgcgcagacggcccagcagattgcacagacgggacaggttccgcgagtcgaaacaccaaccgtgccgccgaccgccagccagcctatgcagacaggccgcgttccgcagattcctccgctggccgttcctcagctgacgcagccggcgcatccgttgctgcgcgagccggatactccagacttggggcagctgcccgagattcagcagtcgcagccgatccagcagccccagcagcagtcgcagccgatccagcagccggccaacccgcttccacccagcttcgagcccaaaccgatcactgcggagatttcgcttgtcgccgacccgactaccggggaggtgcgctgatgatgtggatgatctgtctgttcggcggtctgggagccatggcccgttacgtgctcgacgtgtcaattcaacaaggctggaaccgcgagaatcgaagaacgaaccgcaacttcccgctatccacgctcgtcatcaacggcgtcgcctcgctatgcgcgggcatcgccatgatgtcctactattcgcaatcggtggatatggacacggtcatgatgttcgttgtcggatttctcggtggtttctcaacattctccacggcgctcaacgaagtggtttcattgattcgccagcgtcgttttacgctggctctgggctatggaatagcaaccgtcgcggtgcctctcatttgtgtggccgccggtttcggcattgcgctgcttgccaatccggcgtaattttcacgttacacggacggtcgctgagtaacgtgaaagaaatctgagcgcaactgccatcaaggccgccagtccggatgcaacgctggtgattgcattcgaccagaccaagccgctgctgaaggccttcgcctccgcgggagtcgacactaagaagctgtatttcgttgccggactgtcgaacaggttcgagagaatgtaaatgaatgtaatatttcgtggtaagcacgtgagcatacaacgatagaacagtgataacggggaaggtgcgatcatggtcggcatgcgcgatgtggcgaagaaggccggggtgtctctgagcaccgtctcgctggtggtgaacggcaacgggtacgtgtctgatgacatgcgcgaacgtgtgtgcaaagccatgcaagccctcaattatgtgccgaacgagcttgcccgcaatctgtatcatgatcgtacgaatctggtcggcgtcatcgtgcccaccatccgccacccgttctttgcaacgtttaccgcacatctgcagcatgcgctcgccgcgcaaggattacgcactatgctgtgctctaccgcagatgaggcggacggcgaaatccagtatgtcgacatgttgcgtcggcacatgatggacggcatcgtcatgtgtgcgcacacttcgcatcccggcgattattggacgtcgattcatcgcccgatcgtcgcgttcgaccgtgtgcttggagacggtatttcgtcgattggatccgaccacgagcagggtgggcgattgattgcgcagatgctgatccgcaatggtaccaaacatgtggtgatgattggcggtccgcgagatcaattcttcgatttggctgcgcgcggagaagtcgaggaaggaccgttcgatttgggaaagaccacgttcccgacggtgcgctactacctcacgttggaacaggaattgacctccgcaggcgtgaaatacgagtatgttgaagctggcgaagtgatggattttgccggctatcatcgtgcggtcagcaatgcgctcgacaaggtgacgaccgacggcgtcgatgccgtggtcagttccgatattggtgcatcgttctgcgtgcgcgaagcgttgggccgtggaatttccattcctgacgagctgcagatcgttgcctacgatggtacgtatttgactgatttggccggcatgaagctgaccgcggtcgcgcaggatttctcggcgatcgcacagtcggcggccgaccatatcgtgcaggcgattgccaatgaggaagtggccgcggctaacgcttcacgcaagaacatccccaagccgttcgagccgaacgtgcttattcccatgacactggtgccaggcgataccacgcgttgatactgtgcgtcttcatgcgtgtgcccggtgtggatcgcatcgatttcagcggcgtccacaaccggcgaacgcccgtcgatagtcgtgctcatcattcgacttgtgcacatgtgtccgattctgccgaatcggacgtctgagttccgaaaaatgtgttctgtgtgtccgattctggagaatcggtcatgtgtgatgtgaattgggatgtttggatgtccgtttctgcagaatcatctttgctctgtactcgttgattcgcaaatacggcgcatggctcgtcataccggccatgctcggcggcgcggccttcctggcggactcggtgctgacgccggccgtgtcgatctcgtccgccgtcgaaggcctgaagacgctgccggcgttggagcatctgttcaccgagaacaaggatctgacgatgatgatcaccgcggtgatcatcgtgatcctgttcgccgtgcagtcgcgcggcaccgaatcgatcggcaaggtcttcggctcggtggtgatggtctggttcgcgttcctggcgatcgtcggcgtggtagccatcagcaacgactggtccgtgctcgccgcactcaacccgtactacggcatcaagttcctgttcagtccgaataacgccaccggtctggcgctgatgggcaccgtgttcctttcgaccaccggcgccgaggcgctgtactcggatatgggccacgtgggccgcggcaacatctacttcacctggccgttcatcaaggtggcgctggtgctcaactacttcggccagggcgcgtggatgctgcgcaaccagaacaaccccgaactggccgacgccgaggggatcaacccgttcttccagatgatggatccgaacgtgcgctatgtggccgtcgtgctgtcggtcaccgccggcatcatcgcctcccaggcgctgattacgggcgcgttcaccatggtctccgaggccaccggcctcaactggatgccgcatctgcaggtccgttaccctgcccgtacccgcggccagctgtacattccggtcgtcaacgtggtgctgtgcgtggccacgctggccgtgccgctgctgttccgcgattcggaacatatctcggcggcctacggcttggcactgaccatcacgatgatcaccaccacgatcctgctgggcatctacctgtggcaccgcagcaacaagttcggcaccgttgtgttcaccatcgtgttcctggcgatccaggtcctgttcttcgccgcctcgatggccaagttcctgcacggcggctggttcacgctgctgctcacgctggcgatcctcatgatcatgtacacgtggaacgagggcaccaagctggagcgctcgcagcgtcggcacatgatgccgaaggacttcctccccgcgctggacaagctgcacggcgatagccgcatccaccggttcgcggacaacatcgtctacctgaccagcgatccggacctgaagcgtctcgatacggacatcttcttctcgatcttcgccgaccaccccaagcgcgcccgcgcatggtgggcggtggccgtcgagaccaccgacgagccgttcacccgtgagtattcggtcgagagcttcggtaccgactacctgttccgtgtgcgcatccgcctcggcttcaaggtctcgcagtccatcccggcctacctgcatcagatcatgcacgatctggagaagaccggcgagctgccgaaccagcagtcgatctacccgaagcttgacgccgatcccggcatcggcaccatccgctacgtggtgatccacaaggcgctgatgcccgagtcgaaggtctccggccgtggctccctctcgctgcagatcaagtacgcgatccgccgcgtggccggttccccggtcaagtggttcggcctggcgccgtacaacccgctggtcgaggtgcagccgctgttcgtgtccacgcgccgcccgccgcgcctgacccgcgtggccagccaggcgcccaagcgcgagggctgagccggcaggccgaacagccggtgcgagccgggtggcctaatggcatgtcagggggccgcgaaccgtcatcgtacggttcgcggcctttgcatatgcgaatgatgcagagtgggcggtactgcttgtgaatgtagcgggtggacgggtgacgtggttgatgccttttgccgtatgttcacggtggctatgcgtcggatgggactgtaattcgacttcttgggatcttttttgctgcagtggtgcgccaaaaggtctcagccgtctctgcgccacgccttccggcagtcagtacaaggttgtactacactggtggctgtcacacggatgtccccggtcgcccgcgcctccgcggtacatcgttgtatggatacgtgtcacgtatgcagagtgcatgcagatatgtagaaaggaatcccatgccccagcaggaccatctgaccgcacgtctcgtcgtcgatgacgattttgaggtcgctccggtcaacaatcgtctgttcggttcgttcgtcgagcaccttggccgttgcgtgtacaccggcatctacgagcccgaccacccgaccgccgacgagcacggcttccgcaaggacgtcatcgacctggtcaaggaactcggcgccaccaccatccgctacccgggcggcaacttcgtgtccggctaccgctgggaggacggcatcggccccaagcaggaacgtccccgtcgactcgatctggcctggcattccaccgaaaccaacgaattcggcctgcacgagatggccgaatggcttgaggccaccggcggcaacgagctgatggaggccgtcaacctgggcacgcgcggcctgcaggaggccctggacctgctggagtacgcgaacgtgcccggcggcaccgagctgtcggaacgtcgccgcgccaacggcgccgacaagccgttcgatatccgcatgtggtgcctgggcaacgagatggacggcccgtggcagctcggccacaagtccgccgaggactacggcatgctcgccgcctccgtggccgccggcatgcgccagatcgatccggacgtggaactggtggtgtgcggctcctccgcccatggcatgccgaccttcggcaagtgggagcagaccgttcttgagaagacctacgagaacgtgaacttcgtctcctgccacgcctactaccagccgttcttcaaggaggacggcacgcgcgacatggccagcttcctggcctccggcgtggatatggacggcttcatcaaggacgtggccgccaccatcgacgccaccaaggctcatctgaagagcgcgcacgacgtgtacatctcgttcgatgaatggaatgtctggtaccagggtgaggagccgagcaagacccccgagggcatcggcaactggccggtggccccgcgtctgctggaggacatctacaccgccgccgacgccgtggtgttcggcgatctgatgatcacgctgctcaagaacgccgaccgcgtgcgcgccgccagcctggcgcagctggtcaatgtcatcgccccgatcatgacggagccgggcggcccggcctggcgccagaccacgttccacccgttctccgtgaccgcgcgcctggccaagggcggcaccgtgctggagccgaagctgtccgccggcaccgtggatacgccgcgctatggcgaggtcgacggcgtgaacgccgtggccgtgcgctgcgccgacggctcgctcgccgtgtttgcggtgaaccgttcgctcgaggcgaccgccgagttcgagatcaggctgcaggacggcgcgcagccggcatccgtcgaggcgcagacgctgcacgacgacgatctgttcgccgcgaatacgctctacgaccagaaccgtgtgaccccgcacgccaacgggtcggccatgtacgatgccgagtccggcgtggtccgcgtctccctgccgccggtgagttggaccgccctgcacatcaagtgacgcgatgggccgcgcggtccgttccggagaaggacggatcgcacggcccttgcttcccgggccgggcggaagggaccggaccggccggggaaaacgcgttatgctggaatcagacgggcgttccgcctgaaccgtgcggaacatgcccgatggtgcgacgagaggggtgctgtggcgaaacgggtgaccatcaccgacgtggcgcgcgagacgggcgtctccatcaaaacggtgtcgaatgtgctgaacaacaccggcagtatgcgcccggagacgcgccagcgtgtccaggatgccatcgaacgcctcggataccgcgttaacgtgtccgcccgcgccatgaaaaccggcggcacgaagctcatcggactggccatcaccgatttctgccagccgttcatgccctatctcgccgacagcatcgtggcggcggcacgttcccgcgggtacgcggtgatcaccgatacctacaacagcgccggcggcttggcgcaggcgatcccggagacgaagaagctggccgcggacggctggattttcttcatgggcttgccgatcacggatcgcacgatactgcaccagccgtatccgttggtgattgtgggcgattacgatacgcagggactggccgattgggtcacgatgccgaacgtggaggccgtacgcaccgcggtgggggcgctgctggattcgggatgccgtaggatcgcgttgatcggcggcaccgcggagaacgcatgcccggatgccgaccgcgagtcgcggcccgaaaccaccagcacgatgcgtacccgcggctatgtgttggcccatgaggagcgtggcctgcaggtcgattggcggctggtccgtaacgcggattgggtgcagtccggcggccgcgatgcggtggcggggctgttggacgatccggatgcgccgcgtccggatgcggtcatgtgcctgaacgacgcgctcgccatcggggtgattcatgagctgcagcggcgcggcgtgcgcgtgccgcaggatatgcaggtcattgggttcgacaacgtgccggatgccgagtactgcatgcccggattgacgacgatcgacccgcatgtggatgattacgcgcgacatgccgtggatatgctgatcgcgcgcatcgaggggtcggcggatccgttccgcacgtatgtgacctcctacgatctggtgcgtcgtgcctcgacgtgttgacggcccggcgttcgcctggacatgggtctgtgacgggctgctgtcgcctctcccgtggcgtattccgggagaggcgacatgcgggctaggatcggagcagcacctccgtcagcgcttgacggacggcgctcggcatatgcgaatcggagcaatcttccatgtccggcccgctgacgtgctcgagtgaatccatcgtggccaatgcgtcgatgccgttctccgctatggcggcataagcctgttccttggtcagatatcgcatttcggcatgccgaaggatgtcgaagacgtcttccatgcggggatcggcggccatcgtcgtgtcgccgatggtgacacgtatctcgctgcgggtggatacgtcggcgaccgttacctgcaatgtgagggtttcggcatcataccggcgatccgaatcgacggatgcgccgtcggcctgtacggatatgtcgctgtcggtaatgcctcggaacaggaaatcccatgttctccgggccggcagagcgtgaacgtctccctgggctggcgataccgtgagtgcggatgtggcgccgtccttgcgccatcgataggtgatcgcggtggtcgccggggtgatctgccgagagtaatgtcccgaatcctccatcagcgtgaagtcgccgtccgctccggggaagacgatgatctccagatgctgcgggttgtcgacggagttgatggaatccccctcggacaggggctgcatcggcacgatgccgccggccttcgcgaacacgggaattccgtcgagcggacgccagacggtcatgcgccgtccgttgggcgaagacgcgctataccggcgcccggtgaagaagtcgaaccagtcgccctgcggcagccatacgtcggccttgccccgtcgggaggatttatccatcggttccgtgatgggcgcggccagcagttcggtgccgaacatgtattcgttgggaacgtggtatgcggcgtcgatgtcgggcgatccccaatacatgggctccaccaggggaaggcctgtccgggatgcgcgccagttcatggtgtggaggtacggaatcatgcgatggcgcaggcggagcgcatcgtccatgatcgcacggagggggtgcggatgtttttttggacggtcaggcggccagtccaagacttctgcggtattgcacggggctcatccagtccagtgacttcttgatcctggtttcattgtagtgggtcaggtaggcggccaggcgttcgcggaactcctcgtagcccacgcccctccagtcccgcccgtagaataactcgttcttgagcctgccgaagaacccctcggcggccgcgttgtccgggctgcatcccttggcgctcatcgaccggatcagcccgtgctcctcgcagatgcggatccattcgtcccaccggtagtggcagccgcggtcggagttaaaccgacatcggtttaacagtgattaagccgggtttgttgttaagccggggaacggttcggggtcttggtggctggccgtgtcccatgtggtttcccggcttaacgttccgggttatgttcgtcttgtcccatttgattcgaacgaaggagtttgccatgggtgagacgacggttggccatgtcgcgggcgaggtggtccgcgcgctttacggggccggttatatggaatccaccataggccagtaccgcaagtccatcagggcgttggaacggtacgccggaggcccggatgcggtgtacacgcgtgggttgggcgcggggttcgccgcgtcgaccttcagtgagcggacgggcggtttcagcaggcagcggtggttcgattacggcaggctggcgcgtttgtgcgactcgtatctgcggtccggttcggtggacctgggcaagtggcgcaggagcaggcttgcggagccggtggttccgggtttggccgtggtcatggagcgttgggaggcgtatctcgccggttcgggactggcttcggcgacggtggggcattaccgtcggatggcgggcttgttcctcacgtggctggaatctcatggggtcgtgtcgttggatggttcggatggctcgcatgtgctggggttcctggccgggctgcgttcacgctggtcggagtcgtcgatgcggcacgccgcgtcggacctgcgcccgttgttcagatggctcgggcgggatgacctggcggacgcgatcggcctggccggcatacgcaggacccacgcgatcgcgggaacgttgcccgacgacgagcaccgccgcttgctggaggcgtgcgcctcgcggtcggtgccgtcgagggacgcggcgatcaccctgctgtcgctgacgtgcgggctgagggcatgcgatgtgatcggtctgaggatcgccgacgtggattgggattccatgagcataggtctggtgcagcgaaagacgggcaatccgttgaccgtgccgatgacgggaccgctggccgcgaggctggcgtcctggctgttggacgaaaggcccgccaccgacgacgaccgtgtgttcgtgcggtacaaggcgccccatgtcgcgcttcggggtcattcatcggtgtacgaggcgatcagccgtgtcatgcggcacgccgggctcggacgccggggcggttccaggctgttgcggcgcaacgcggcgacgaggatgctggaggcggccacgccgttgccgacgatcagcgcggtgcttggccacgccgaccccgattccacacgcgtctacatggccacgcaccgcgggggaatgctcgcgtgcgtgctgcccgtgccggaaggcggatcgtcatgagacccacggaacacggattcgtcggcccgctcgccggcgaattggaggagtgcatccgcttcaaggcgtccatgggcaggcatggcgccacccgcgtccgggtcctgcgctcgttcgaccggcattgcctcgaacacggggccgtgcgtctggagcggggcgtcgtggagcgatggatcgcccataggatcgacgcgaatcccgggggttgccgctcgtggttctcgtacatcagggacttcggcaggtggatgcgactggcccacgatcccgacgcgtacgtgctctccgaccagtggaaggccggatccccgcgtccgacgccgtacctgctgacggaccgcgaggccgccctgttcctgcgggccgcgggaacgttggagtctccgtcgccgtgggcgtggcagtctcgcgcgttcttcatgctcatggcctgctgcgggctgcgcacccgagaggtcaggagactcgccgtcgggcacgtcgaccacaaggcccgttccatcgacgtggtcgattccaaggccggtcgcagccgcaggctgcccgtgggcgacgaggtcgccgccgaactgctggaatgcgaccaacggtcccgcgaacgcttcggagacgaccgtcccgcgttcttcgtcacctccaccggcaatccggtctccccgggcatgcccggcgtggtgttccgccgcgtctggacgcgggccgggctcgagtggccacaagccggcaaacggcccaggccctatgatttccggcaccggttcgcgttcgcgaacatcgagcggtggactcgcgacggcgtggacgtgatggcgatgctgccctatctggcggcctacatgggacacgccggcatcgacagcaccctctactacgtgcacgccagccccgatttcatggacggatacgcggacctcgtcgccgacgccgaacgcgtggtcccggaaacggaggaaccatgagcaaggcaaggaaaacggccgccagctccggtgaaccggacttctggcgagtcgcgcgcgactggctgcaccactggctgcccaaggtgcggggcagctcgccgaagaccgtcgaggcgtaccgcatcggcctggaatcctacgtccgatggctcgaaaccacggaaggcacgcagcgcagccacatcggtttcgggcatttcgaccgggcgcgcctgggccggtgggtcgaatggatgcggaccgagcgcgggtactcggaccgcaccatcatgctgaggatgacgacgatgcgcgtgttcctcgaccacgcgggcctcgaacacccggcattgaccgcgctgggcaacgacgcggccggcatacgtgtcaaaccacctgcgcgcaaacccgtcgaccacctcggggaggagcacaccaaagcgttgctgaccgcatggggcaccggcgacgccaaatcgcgcaggaaccgcatgctcctgatcctcatgtacgacaccgccgccaggatcggcgaactcgccgcactgaccatcgcggacgtgggtatggataagccggccagggtcacgctcaccggcaaacgcggcaagagccgggtcgtgcccctgggagaaaggacacgaacccacctggccgcctacctcgaggaattccatcccggaccgtccatgcgcgacggcgacaggccgttgttccactcgacgaggaacggcgccatccagccgctctccgtggaccggatcgacgagatcctcaaaaccgcggcggccagagcacgccgcgggacgtgcccgtccatgcccgaacgcgtccactgccacctgatccgccggacccgcgccatggacctctaccaacagggcgtgccgctaccgctcatcatgcaactgctcggccacgaaagcatgagcacaaccagcgcgttctacgcgttcgcgaccctcgacatgatgcgcaaagccgtcgatgcggccaaccccggccccgacccctccaaggagacatggctcagcgagcaacgactccgacaactacacaccctcaaataacccggaacgttaagccgggaaaccacatgggacacggccagccaccaagaccccgaaccgttccccggcttaacaacaaacccggcttaatcggaatggatgattggatgttccccgtccctgagcgtggcgaccgcgtcaaggagcatccggttcgccatgtcggcgttcggggagcgcgacaaggtccaggagaccaccatcccgtcgaagcagtcgaccaccggggaaagccagcacttgtacccgtccatggtgaactgggtgacgtccgtgacccacagcatgttcggcgcgtcggcgtggaagtcccgctccacgaggttcgccggggcctcgccgatctcgccggcgtaggagctccaccgcttcggccgcttcaggtacacgggccgcatggccccctcgcgcatgatccgcctgacgaccttctccgagacgacgatcgggtcggactcgtcaaggcgcagcatgcggtggatggtccggtatccccatgcgcgcccaccctgctcgaacaggccggcgacgcgggcccgcagcacggcgtacctgtcgcccgcggcgatcgcgccgcgctcgtaatagtaggtgctgcgtttcagccccacggccttcagacaggccgccaggccgaattcacccctgatcgcgtcgacgacccgcgtcctctccctgttcgtcagcatggacgggtcgaggcgcgggtcgtcggcttttaaaacatcgatcgtctcccgcatcaccgcgttctccagccgcaggacctccacctgccggcgcagctcctccacgtcatcgccggccgcgggcatcggttcggccggcatcggcgcgtttctcctgtccatcagtcccagtatcccctcgctccggtagcggcgcatccactggtacacgctcgtcggcgtgcaacccgcgtcgcgcgccacgcgggcgaggggctcgccctcgagcgcgcgtctggccgcattcgtcttgcattccagcgtatacgaacgcctgcacgcgcccgtgatctcgtcggcctccgcgtccagcatcgcgttcaacagctgttcgaccttctccgacaccaaccggtccagcttcgtctcgagcatgttctcgtcgacctgtagaatctgattcggcatggttccgtcgccttcctaaataggttgatttggtttggcgactgaaatcgtacccggacgacggaccatgtctctcaactcaagcctcaaccaaaatgcgcaacaaaccgggcgttatcaatcggacacattggggtcggacaggctaagctgcatagaacaccgcatctaatcggttcgacacgcgcatttcactgcgcgactggacattgacgtccctttcgaggtaatatcgaaccggttcgatacatacgtgagtatgcaaatacgtaaacaacaaacaggcagatgcgcacgcaaattgcacccgcgcccatgagccaagggaggtcccatgaaaaacaaagtgcaactcatcacatacgccgatcgtctcggcgatggcactcttagctcgatgaccgacatcctgcgcacccgcttcgacggcgtgtatgacggcgtgcatatcctgccgttcttcactccgttcgatggtgcggatgcaggcttcgacccgatcgaccataccaaagtcgacgaacgtctcggcagctgggacgacgtcgccgaactctccaagacccacaacatcatggtcgacgccatcgtcaaccacatgagttgggaatccaagcagttccaagatgtgcttgaaaaaggtgaggaatccgagtattacccgatgtttctgaccatgagctccgtgttcccgaacggcgccaccgaagaggacctggccggcatctaccgcccgcgcccgggcctgccgttcacccactacaagttcgccggcaagacgcgcttggtctgggtgagcttcaccccgcagcaggttgatattgacaccgattccgacgagggctgggaatacctcatgtcgattttcgaccagatggccgcctctcacgtcagctacatccgcctcgacgccgtcggctatggcgccaaggaagccagcaccagctgcttcatgactccgaagacgttcaagctcatctcccgcctacgcgaggaaggcgtcaagcgaggcctcgaaattctcattgaggtgcatagctactacaagaagcaggttgaaatcgcctccaaggtggaccgcgtctacgatttcgccctgccgccgctgcttctgcactcgctgttcaccggtcacgtcgaacccgtggcccactggaccgagatccgcccgaacaacgccgtcaccgtgctcgatacgcacgatggcatcggcgtgatcgacatcggctccgaccagctcgaccgctccctcaagggcctcgtgcccgacgaggacgtcgacaacctggtcaacaccatccatgccaacacccacggcgaatcccaggccgccaccggtgccgccgcgtccaacctcgacctctaccaggtcaactccacgtactactcggccctcggctgcaacgaccagcactacttggccgcccgcgccgtgcagttcttcctgccgggcgtgccgcaggtctactacgtgggcgcgctcgccggccgcaacgacatggaactgctgcgccgcaccaacaacggccgcgacatcaaccgccactactactccaccgccgaaatcgatgaaaacctcgaacgcccggtggtcaaggccctgaacgccctggccaagttccgcaacgaactgcctgcattcgatggcgagttcagctacgaggtcgatggcgacacgtccatcaccttccgctggaccgccgccgacggcacgtccacggccgccctcaccttcgagcccggacgcggcctcggcacagacaacgccaccccggttgccagccttgcctggagcgatgccgccggcgaccacgaaacccgcgatctgctcgccaacccgccgattgccgatatcgactaaccgttggcccataaacgccactccgctgtgcgcgctccaagtagtgcgcccggcgtaagctgggtccatggaaaacaaaccgcccgcagtgcactgaagccagtgcgcccgggcggttttgcgtatgcggggttgaaggtcatgctcctgcgggcgcggcccaagcatcccgccggaatcgacgagacgagcagcagaacagagaaagagcagcatcatgttggaaccgtatgtgcgtccgggtattgatgatcgcccggatttggacaaggtcctaagtcccgaagacaaagccgccgtggccagactgaccatcaagaatcgccgccgcccgcccgaagcctctgcggaccagcctgaggcccaggctgtgcgattggcttccgccggttcttcggcagccgctgctgcagccgccagtgtggacactcccgcgccggatatgtcgtccgcctacctcgacatgcgcgatcccatggtcgccgtcaatggccaacgccctaccgcaggtcaggtctcccgactcaactggggtttcttcgctgcttcaattctggtcggcgcaccttgggtggcgttgaacaccattgccatgcccaacgcgattgcgcgtacgttcggctatgacactgctgttgccggtcatatcgccatcaatccggccactggccgcccgttgcccgtcgccaccgaattggcgatgcccctggccgtgttggtgattgtcggcgtagtggcctccatgtttgcgatgccgctgatttcagtgttgtccgaccgcacacgcacgccattgggccgtcgtaccccgtggatggttggcggaggtctgctgtgcgcgctgatcacgctgattctggggcagaatatcggcatcattgtgctttgtattttctgggtgttcctacagttcgcctatgcgatgctttccgtgccgttgaccagcgccatcagcgaacgggtgcccgacaagttccgccctcgcatcgaacgctggcatggcatcggtgtgatgctcggccaagcgcttggcgtgtgcatgggtgcgcttggtgtgatgttcaattcgtttgcgccgtttagttacaccgccgtgctatttgcagtgtccggtattgccaccgtattgattctgcccaaggagccttctagcgctgagcagccgaaccagctttttgaccgcagtcaggtacttgaccaattgcgcccgccggcccacgctcccgagttctcccgggtgttcgccgcccgtacgtgcatgatggccggtgttgggctgaccggtgtgtttctgtggtatctcgtacgtttctgggtttatggcaaggccgtggtacttacgtccgcgccgctgaccattccggccggattcctcattgccggtatggctgtggccacattgatcggtgccgcgctcgcctcctgggccgccgggccgatttccgagcgaatcgaggaaaagaacattcccgtggcccgtgtggtggccggtgcctgcctgctgtatgcgattggtctggggctcgcatggggccttggcgtctggtccaccggcactgcccgtgaaaacggcatgctgctgtttgcgttgatctccggattcgccttcggcatttacgattcgctcggacttgaactggtgatggactctttgcccgacccgcgccgagccggccacgacctcggcatttatgcgctcgccaactcggccggtctggcgctcgccgccatcatcggcgcgctactggtgaacgccttcgagcatagcttcggctattacctgctcttcccgtccgccatcgtcatggtgctgctggccggaatcgtcaccctcaccaccaaatctgccgaataataaaccggttcgagtacactggtcagcagtgatccagtccagtactcgcaggggagcaaaaccatggtcggcatgcgcgacgtagccaaagcggcaggggtgtccttaagcaccgtttcgttggtggtcaacaacaccggctacgtctcggccgatatgcgtgccaaagtcgagtccgcgatgcgccagctcaactacattcccaacgagctggcccgcaacctctaccgaaaccgcaccaacaccatcggcgtgatcatgccgaccatcgcccacccgttcttctccacactcaccgcgcatctgcagcgcgagttcgccgcgcgcgacctcaaaaccctattgtgttccaccgccgatgcggacaaaggcgagggcgaatacgtcgatatgctccagcggcacatgatggacggcatcatcatggcggcccacaccgagcatccggccgactactggacctccatccatcggccaattgtcgctttcgaccgcacgctcggtgagggtgtgccggtcgtccggtctgatcatgaacagggaggccgtctgattgctcgccagctcatcgattccggagcgcgccacgtggtgctcgtcggcggcccgcgctcccagttcgctgcggccaccacgttccccacgattcgctaccatctcaccgtcgagcgtctgctggccgatgccggcattgcctgcgattacgtggaagccggcgccgtggccgacatcgccgcccacgaagccaccgcatgcgccattttcgaacagtatcctgatgtcgacgccatcgtcggctccgatgtggtggcatccgtggcattgcaggaagcctcacgacggggtatcgaggtgcctgctgatctgcaagtcatcgcctatgacggcactctcatggccgaaaccgccggcaaacgcctgaccgcgattcgacaggacttcccggccatcgccgccgcgctcgccgtccgcatggactcacagatcgccgccgacggtggccccgcctctccgtccaagaacgatagcgcttcggacgttgacacccaacccactcccgaagaagtcatccccgtagccctcatccccggcgaaaccacccggtgactcctatcttggctcccctctctgaggctgagctgtgaagcaaacagtccggtggactgtttgtaggcgaaggcgagccgggaggcgagcaggcagactgcgggcggtagcccgtctgtaattgcggccgagctggcggcgtaggcgactgaggggagccgagtcacggccgcccacagtcacccatctcacatgactcctacgtcacaatgtccacaatgtgaacccttgctggattggcaagacatacaaacctatgtttacattccagttcaggtcgaacggcctgaggaaataccgaaaggaggccacgcgatgactggattcaatgcttctgcgtttgtatccgcacgaattattagcccgtcttcgctggcggactaattcggcactgatgcttgaagccccgtcaacgaaggcagggccaatcaagctgacacaatcggcacggccctgcatgatgcggggctttttttgttgcgctcacaaggcttacggcagaatcccgcagacggaaacggtagcggacagtacacggcaacaacacagcgacagaacaacaacctccctgtggggcgaaataatcgcccgccgatgagagtgaacgagagcaaaacaggagtaacaatgactgcagcagtcgaagagactggcttagggcaggcggcaggtaaagccgctaccttggtacgcgattcggtcaagaccgtgatcgccgcgtcgatggtcggtaccgccatcgaattctatgacttctacgcctacggcaccgccgcggcaaactacttcccgcacatcttcttctccgcgaaggacaaccccaccgtcgcactgctgatgagcttgctgaccttcgccgtcgccttcatcgcccgcccgctgggctcgctgatcttcggccacttcggcgatcgcatgggccgcaagaccacgctggtcgtcagcctgatgaccatgggtgtcggcaccttcctgattggctgcctgcccacctacgatcaggtcggcgttggtgcagtcgccatcctctgcctgctgcgtttcatccagggcgtcggcctgggcggcgaatggtccggcgcggcactggtcgccaccgagaacgcgcctgaagacaagcgcgcactgtacggctccttcccggagctcggcgccccgatcggcttcttcctgtccaacggcacctacttcgtgctcgaatccttcaacaatcaggacgcgatgctggcttggggctggcgtgtgccgttcctgctgtccgccatcctggtgatcgtcggtctcgtggtccgcgttcacatggaggagaccccgatcttccgtatggctcaggagcagaagaaggttgtcaagtccccgctgaccgaggtcttccgcaagtcttggcgtcaggtgctgcaggccaccttccttgtggctgtgacctacacgctgttctacacgctcgccacctggtccctcgcttggggcaccaaggagcagggcgaaggcggcggcaaccttggcttcaccaaccaggaatacctgctcatgctcatgatctccatctgcttgttcgccctgttcatcgtgctgtcctgcctgtacgcggacaagatcggccgccgtcgcgtgctgaccttctcctcctgcgcacttgtggtgttcgccgtactcttcccgttcctgctggacggtggtctggtcggccagaagaacttcttcgccaacatggtgttcctgtgcgtcggctttgccctgatgggcatcgccttcggcccgatcggcgccttcctgcctgagctgttcgacgccaacgtgcgttactccggctccggcatcggctacaacctggccgccatcgtcggcgcggctttcgtgccgaccatcgccacttggctgagctcccactggggcgtccactccgtgggcctctaccttgccgtgatggccgtgtgctgcctcgtctccgtgctcacctgcaaggagactaaggacgttgactttaccaagtgacgatgttcacaacgtgaaaacccctaattccactaagtgaacccctacagggcttttccgatgcgacgggactaaacctgcatatcggaaaagcccacaaggaaagccacaacagaatatcgctcagcgaaaccccgcagaacgcaagaaaaattcaaccccataaataaacaaataaataaaaggagcgccaaaaatggcagcaactatctggtacgagaaggacgccgatctgtccgtgttcgatggcaagaaggtggctatcctgggctacggttctcagggtcacgcccacgcgctgaacctgcgtgactccggtgtcgacgtggtcgtcggcctgcgtcctacctccaagtccgtggagttcgccaaggagcagggccttgaggtcaagccggttggcgaggccgttgccgaggctgacgttgtgatgattcttctgcctgaccagtaccaggcagccgtctacaagaaggacgttgagccgaacctgaagccgggcgctgccctggccttcgcccacggcttcaacatccactacggctacatcaagccgtctgaggatcacccggtgttcatggttgccccgaagggcccgggccacatcgttcgtcgtgagtacgccgctggccgtggtgtcccggtcgtcgttgctgttgagcaggacccggacggcaagacctggccgctgtgcctggcttacgccaaggctctgggcgctctgcgtgcaggcgccatcaagaccaccttcaccgaggagaccgagaccgatctgttcggtgagcaggacgtcctcatgggcggcatcaaccacctgtgcgacctcggcttcgacgtgctgaccgaggctggctaccagccggaaatcgcctacttcgaggtgttccacgagctgaagatgctggtcgacctcgctaacgagggtggtctgaacaaggctcgttggtcctgctctgacaccgctcagtacggcgactacacctccaccgtcatcaccgaggagaccaagaagcgcatgcagtatcagctcaagcgcattcaggatggctccttcgccaaggagttcatggatgaccaggctgctggcgccccgaagttcaagaagctgcaggaagagtactctcacccgcacctcgagaccgttggcccgaagctgcgcgccatgttctcctggaacaacgccgaggccaaggacaaggacgaggctgagtccttcaacggcaagatcgctcgtacccaggttcagtgattgccgcccctgaaggggatttaagctagcaaaccgccgttcccgcccatacgggagcggcggttttgtgttgttgcgcgcagcgaatcattctcaataacaactatgcgctgatttcttgcaggcaaacgaacaccgaatatgcaagatcgttgatatctcagcctttccccatatgtgggattgtgcgattctgttcaaaagggtgcagagttgttatcgagaatcgttctctgcacacggctgtccatactccaatagtgacctagctcacgttgtggactccagcggggctgcgacggcgttctcggtaggattgaactcggtttgaaggacacaatcctcgcaaaacaggacttatctgcacaccgtagatacccccggcgcccagcggcgccacaacccactactgaaaaggagtgccaataatggcagcacaaatctggtatgagaacgacggcgatctttccgtcctcgaaggcaagaaggtcgcaatcatcggctacggttcccagggccacgcccacgcgctgaaccttcgcgattctggtgtcgacgtggtcgtcggcctgcgtccgacctccaagtcggtcgacttcgccaaggagcagggcctcgaggtcaagtccgtggccgaggcttccgccgaggccgacgtgatcatgattctggcccccgaccagtaccagcgcaccatctgggccaacgacatcgagcccaacatcaagccgggtgccgctgttgcgttcgctcatggcttcaacattcactacggctacatcaagccgtctgaggatcacccggtgttcatggttgccccgaagggcccgggccacatcgttcgtcgtgagtacgccgctggccgtggcgtgccggtcgtcgtggccgtcgagcaggatccgcgtggcgacggctgggctctgaccctggcctacgccaaggccctcggtgccctgcgcgccggtgccatcaagaccaccttcaaggaagagaccgagaccgatctcttcggcgagcagaacgtgctcatgggtggcgtgaacaagctcgtcgagatgggcttcgaagtcctgaccgacgccggctaccagccggaaatcgcctacttcgaggtctgccacgagctcaagatgctcgtcgacctgatgaacgagggcggtctgaacaaggctcgttggtcctgctctgacaccgctcagtacggcgactacgtcaacaccgtcatcaacgaggactgccgcaagcgcatggaataccacctgcagcgcatccaggacggctccttcgccaaggagttcattgacgaccaggatgccggcgccccgcacttcaaggaactgcaggagaagtactccaacgagcgcatcgagaccgtcggcccgaagctgcgcgccatgttctcctggaacaaggatggcgtcaaggatgccgacgaggccaactccttcaccggcaagatcgcccgcgcccaggttcagtgattcttccttggctcccctcgggtgaggtgcgcacgaacagcgagccggcaatcgcagccttcaggctgtccgtgttgcagtacgctggcgcgtaagcgcctgagggtggtccccagtgcataccaaaaggccgccgctccgattcattcggaacggcggcctttcgcttattccaagggatctacttgataacccacgcagaagtgtcggtggggagctggccttcgggggtcagcgggccggacgccagcaccacggagccatcgggcagcgcgaccggggcattgccgaagttggtgattgaggtgaacacccgcccgccaaccgccgcgcgggtgtacgccaccacatcgtcgcccatgtccacctgctcggccgtggtgtcgcgcgtggcggtcagcgactcctggcgaatcgccagtgcggcgcgatacagcgcgagcatcgagtccgggtcggcttgctccacgtccaccgcgtaatccttgaaccacagcggttgcggcaggtgcgggtcggcggccggcgtcacgccctcagcgcgcgtagccggcgagaagccgaaggaagcgcccgtgccgaactggccggctgcgcacagcggcacatggttttcgccggtaccgtcatcggccggagccggacggctgaaatcggccaaggccggctcatcggcggcggtccacggcagcggcacgcggcagccgtcgcggcccttgtccatcgtgttgcgggtggtgtggaaggcggtcggatcctccaagtgatcccacggaatatcggccacctcaaacaggcccagttcctcgccctgatagatgtatgcggcaccgggcaggccgagctccatcagcgcggcggcacgggcacggcgggtgccgagctcgcggtcttcgggatatgtggtgccgttgcgcagcagccagtcgtgcggcagctggtggtagggcgcgcccttgacctgcggcagaccgtagcgggaggggctgcgcggcacgtcgtgattgttcatgacccacgtggtggtggagccgccggtttcggccgccgccttaagacccgcggcgatggccttgcggaactcgtcggcataccagttggcctgcgcgaagtcgaagttgaaggactggcccagctcgtccatcgaagcgtacaggtgctggtgctcaggcaccacccacgcctcggccacggcaaagcgcggcgggttgtattcgttgaacaccttgcgccactcgcggtagatgtcgtgcacctcacgacggtcgaacagcgggtggctgaagtcatgattcagcacgccgaccacgctgtattcgcggccgagctcttccaacggcttggattcgagatccttggccaggccgtgcgccacgtcgatgcggaagccgtcggtgccgtggtcggaccagaaacgtagggtcttcttgaactcctcgtggatgtccggattcttccagttgacgtccggctgcgccttatcgaacaggtgcagataccactggccgtcggccacgcgcgcccaggccgggccgccgaagaaggattgccagtcgttgggcggcagttcgccgtgctcgccgcggccgtcgcggaagatgtagcggtcgcgcgccggggagccgggctcggcggcgagggcctcttggaagaacacgtgcttgtcggcggtgtggttgggcacgatgtccacgatcactttgatgccggcctcgtgcgcggcctcggccatcgcgtcgaagtcgtccatggtgcctaggcgcgggtcgacgttgcggtagtcgatcacgtcgtagccgccgtccgccagatccgaggggtagaacggggagatccagatcgcgtcgacgccgaggttcttcaggtaatccatcttctcggtgacgccggcgatgtcgccgagtccgtcgccgttgacgtccttgaagctgcgcgggtagatctggtagacgacggcctgcttccaccagtcgtcattgaggttgttggcggtcatgccgattccttcctgttccgggtgcgttgtggttgggttgttccggttgtgctcgaactgctgtgtgaaggcccaaccgttgtattgatgatgacaacgatatcatgtgaattacgcatgcaaaagtcgatttatcggcgttttgcggtggtaacgtagtcacgcctgcgcggacgctgctgttgcggcaggcggcgcggtggtttcgcgcagtattagcggagtgtccggccgtacgaatgccggttcgattgacttgcccgcaatggcatccaataccatgtgcccggcggccacgcccattgcgaacgggtcctgatgcagtgtggtcagtcccacggcggcggacagggtggaatcgtcgaagccgatgatggagatgtcctgaggtacccgccgcccgtattgacgcaggcgatacagcacgggtgcggccatttcatcatcctcaaaacagaaggcggtgatgctgggggaggcgttcagtacggcgttcaatgccgcgttgctttcgccaagaccgcgttgaatgctcaggggcgttagctcgatccccggatgggcggcagcggcatcaatgacgccctgcaaacgagcctcggcactgtagcgcatgttggtttcggtcggggcgctgccgacgaacgcgatatgccggtggccgagtgcaatcaggtgctcgatggccgaacgtgtggcggcgtaatcgtcaatgctcacgcctgcgtcgaacccatcggtggagggaatgttgatgccgacaatcggcacgtgcatatgcttcagtcgctccacttcagccggctcaatgtcgaaggagctgacaatcaccgcatccgcattgcgtcgcacgggcaaatccgcaaagaagtcatggcgctcggcggcgttgcgcatggggtagggcacagtgtcgtagccggaggggcgcagcgccgagtcaaggccggcgaagatgtttgcattgaaccaggtggtgatggtctcgctggccagcagcgcaatgcggaacgactggccggacttcagtgcggcggccgagcgagagacggagtagtcgagcttttcggccgcggtcatcactcggtctcgagtctctggaagcactagatccggcttggcgaaggttcgggacaccgtggatacggaaacgccggcctcgcgggccactgcctgaatgcttgccttggtcatatgccgtcgctcctttaccgtcgcgaacaatcattgtcatgacaacgataacatgcccataacaagtcgccgtcttcggctatctcgattacgaggggctgatttagggtgtcccggacatctacttccgtttcaaggggctccttgccggtgaaaccacaagtgcaaacgactttgtgccaacgtcattccgccgttctcgcgctgggtctacttgggcaccagccccttgaagcggaagtggatgtccgggaaaggccaaatcagcccctcgaagccgatttagaccaatttcccattgcggaatcgatcaccgcttctctcggcgcatcacggcggctagggactgcacgcgtggcaggtcgaagacctcgtcggtatgtaccacgtggcctgagctgtccgccagcggcacgcgccagttcgaatactctctggaagtgcccggctgattctgggagcggcattcgcccacgccgtccaccagcgctgcctgcagcagcagcgacggcgtatcggtgagcatggcgtgcatcgcttccacgatttcctgcacatggccttccacatcatccgccacggtctgcgagatatagccgttctccaccagacggttcatcatggccgtgcgctcggccatcgccgaggcggcgaatgcctccaccggctcgctcaggagatgcagctcctcgcgcagcttgacgtgtgcgaagttcaggtagccggcggtgggtggcagatcgtgcgtggtcaccgaggccaatgcctgtttgcgatagtccttgggtgcgcggtacgggtcgccggcgttcggcgaatcgtccacgcggttgaaccattccacgtcagtgccgagcacgccgtgatcggccagaatgcggcgcacgtaatccggtacggtgcccagatcctcgccaaccaccatgcctccggcgcgcgtggcctcgatggccagtactcccaacatcgcctcgtggttgtacgtcacgtatgcgccgttgcgggcaccgagcccctgcggaatccaccacaggcggaacaagcccagcacatggtcgatgcgcaccgcgcccgcgtgctcgtacatcgaatgcaccatctcgcggtacacctggtagccggtggcctccaggtagcgcgggttgaacggtggctggccccaatcctggccctgctggttatagaagtccggcgggcagccgaccgtgacgccacctgaggcgaagcgttccggattggcccaggcatccgcgccgagcccgtgcacgcccacggccatgtcctgcatcagccccagcgtcatgccgtggtccagcgcctcctgctgcgcggcgttcacctgctcggcagcgatccactgcagccagcggttgaactcgaacaggtcgtggtgctcctcgacgagctggcgcacggccgggtcgtcgatggtcttctcgaagaaccaacggttctcgccccacggcgcgccccatacctcgaagcacaggcaccatgtggcgaaggaatcgaggtccgggccggcggtggtcttgaaatgctcgaattcgagctcgcgcttgttgttgcggcccgcttcgaagatcaggcgcagcgccgggcgcttggcctcccacgccgcgttgatgtccatcggggtcgattcgtcgttgcgcgcggccaccgaatcatgcagcgcatccacctgcgcgcgcacgtcggccggcagtgtggcatattcggggatatcctgcggccggatgtacgtcacgttgaggaatcggcgcgattccggtagatacggcgatggctcaagcggcggaatcggcgcgccggcgtgaatcggattgatgagcatgaagtcggccttggacttctcggcggcatctgccaaaagacgcttcagatcgccgtaatcgccgatgccccacgattcgcgggaccgcacggaatacatctgcgtcatccagccccaccgctggtgctcggcgaccgcctccggcacgggaatgcgcgcgggggcggcgatgatggccgccttgccctcgcgcccgtcaaccgtgacggtcagcgtgtggtaacccatcggcaggtcgggtgcgatggtcaagtccggcttgccggaattgaggttcggcagcagggcaaagtggccaaacgcggtgccgtcctccagttcgatggaggcggtgatgtccgcgtccgacgagcagttcagggtgatgccggtcggtttgccggtggtggcgacgatggtggaggggagcaaacgtttgctgttttccacctcaagttgggtcatggagcgtacgatggcctcgtcgctggatgcgtccacgtcgagggccttgagtacggcgaccaaggccgcgtcgctgatttcggtgtaggtgccgagctggtcgatgaatgaggtggcaagtccgcaggctttggcgagcttgatgagcgggcgggcgagtcgttccgtgctttccgcgcgctgcggggcaccggaagcggcgttgttggtggtgtctgcgatggtgccggtgctggttgctgcgtcgttgccgtatgcgtcggtcatgatgactccttgcttgcaaatcgggtactgctagtcgtttgcattgctgttcgagggccgctctgcgttgaggttccggcaacctgacagaccaatgttcgagctgttctgcctctaccgtaactcatattgacaacgattgcaatacattcggtgagttggacgaggctagaggtgttggtgtttgtcgtgatggcccgttgactatccccagtcgactttgccgacagcctcgccggcggaggtgaggtcgaacgggtttaaccaaacacgacgaacgattgcggggagagcgtcagctgcccgccgctcacggccggttcaccaagactgagcagcacgtcggcgtcggaagagagctcgtccggcaggtattccgtgaggaatgaggcgattgaggcacctgaatcggcgttgaaataactggaatcgccttcgtgctccataggcgtgtcggtattgcgcagcaacaggttgtagccgttcgggtggccgtcccggcgccagtcgaggtagaggtccatgtcgaagccggcctgcatcgattcgttcggatggcctggacgccatcggcggaccgacctgggtggattccgataaggcggccgtatgggtgaccaactgggacaccgagcgcaacggctcctcgctcaccacccgtgacggcaccagctacctgctcgccaacgccttcatgctcgcctacgattacggccagccgcacatcttctccggctactactacgccggcgtcgacgacggcgctcccggcgccacccgcacctccgtgccggacatgacctgtccgaccgacggcatcgaaaccgccggcacctggcactgcgcgcaacgctggaccgccatccgcggcatgatcggcttccgcaacgccgtggccggcaccttcaccgccaccgtggccaagggctcggccgtcgccctatacgccggcgcgacgcccgcaaactgggccggcacccggaaatacgatccgtccgatcccgcctggttcaccggcgaaacaccgcataagggcgatgacaccgccgccaagtccgccgattccgcagcgtccgccaagtcaggcgacgccaagtccggaaaggcaacgtccgatgccatccgccgcgccgcaacgctcgccgccatcctcctgcccgtcatcgtcggcgtcacgttcatggcgatagctcgcaggaacggcaaagcccagtccgacaacagcggcccgaataacgactgattcggccccgctcagccgcgcacccgcggcgcggcggtggagtcgcgtaccagcagttgcacggggaagatctcgtgcggctggtccagggtgcgcccctcgataaggtccagggccttgcgcgcggcggcgacggccatgtcgtacggcttctggcgcacggtggtcagccccacctcgcccgagaacgtgctgttgtcgaatccggtgacggacaggtcggtcggaatcgccatgccgcattggcgcaggcggaagaacagcggaatcgccagcgaatcctgatggaagcacagggcagtcggggcgtcgtcgcgcgcgagcagcgcggtgagggcggcgtcgaccggatcgtcgccggcctgcatgtccatcgtctggccggtcacgccgtccagttcgctgcacgcctccaggaatccggtgacgcggttgtgcgagctgaagcccatcgtggcatcgaacgtctcgtacaaatacaacaggttgcggtggccgagcgtggtcagatggcgcacgatcagccggatgccggccttgtcgtcgatgcccacggaggcggtgaacccctgcgaggccgtgttgatgccgatgagcgggatccgcgtggtgttgagtcgcctgatttcggccggggtgatggcgaacgacgagacgatgaccgcgtccgcgttgccacgcaccggcagttcgtcgaagaactcctcgcgcgcgcccgcgtcgccgatcggttggatgaccagatcgtagccggccgatcgcagcacttcgttgaggccttcgatgatgcgcgaggtgaaccagtcgagcttgctgctgcccaccagcagcgccacgcggtgggagcggcccgatttgaggatgccggccatgcgggataccgagaagtcgagttgttgggcggcctccatcaccttggcgcgcgttttggcggagaccatgtcagggcgggagaacgcgcgggagaccgtggcggtggagacgcctgcttgcctggcgacgtcctcgatgctggctttcatggcccctcccggtttttcaaagttgacggtgtgacaaacttctcttcattgtaaatcattgcagtacgttttacgacagtcatagtgcaatgggttgcgatattgcgacacgccgaaaatatagaccaatatggtctcaatagctttggaatgtaacaggttgcaaatgtaacggtttgcatggctgagaaagccgggttgccgaactagttcgacacccgtatactgaaccgtgttcacttagagcttgcgcggaagtaagggagataatgaagatcaagaaatctctcgccgcgctgactgcaaccgtgagcattatggcacttgcaaccggttgcagttcgagcggttcgtcaggcgtcgtcgacacccaggccgacaagggcctggccgtcatgggcgacaccatcacctacgaccccaaccacttggtcaacgacggccagcccatcgaactgggctactggtcctggggcgacgaaagcactgacccggtgatctccatgctccacgagtacgagaagatccacccgaacgtcaccttcaagatctcgcaggtggcttggagcgactactgggtcaagaccccgctctcgctcaagggcaacaagaacgcccccgtgctgttcaacgtccacaactccgaggatgccctgctccgcccgcacgccgtccgcctcgacggcgccagcgactggcgcatcttccaccaggtggtgctgccgatgagccgcaattccatcgccgcgctcgccatcttcaccttcctgtggaactgggaggactacctctggccgttcctcatgatcaccgatgacgacaagcagctgttgtcggtgggcctcaagatgttctccggccagtacggcaccgattacggcggactgttcgccgccacctccgtgaccatcatcccggtggtcatcgtctacctggtgttccagaagcagttcatcgccggcatcgccaccggctctggcaagtaaacccggccggtttcggccgaatccgaaccgcgccgcagtctcccaccagtcccggggagccgcggccgcatcactcgtatcatcgtgaataaccgtacagaaggggtaaccatggcacagtcaccacaactcaagcagtcgtctccgacctcgcccgatccgcaggacttccgcctcgacgccacgccggccatgcgcgccgacaatgtggtgtccggcgagcactggcgcatcggactcatcaccgattcgctcgtgcgattcgaatggtccgattccggcgtattcgagaaccgcccgacccagaccgtcctgaaccgcgatttcggtagcccagtcgaacgccgcgtcaccgagcgtgacggccgcgtcatcatcgacaccgcggccctgaccatcgtctacgaccagcagccgttcagcaaggaaggcctgagcgtggtcgtcaaaggcgtggccgacacccagttcaacacctggcattacggcgacgcccagcgcggcaacctcaaaggcaccgcccgcacgctggacgaggcggacggcgccatcgagcttgacaacggcgtgatctcgcgcgatggctgggccgtcatcgacgactccgccgccaacatcatcatcgaaaccgacacggtgaacggcaaggcgaacccgttcggcacctgggtatccccgcgcgccaccgccgaaacggacttgtacttcttcggctatggccaccgctacatcgaggccgtacgcgacttctatcgcctgaccggccccacgccgctcctgccgcgcttcgccatgggcaactggtggagccgctactaccggtacacgcagggcggctatctggccctgatggaccgcttcaagcgcgagggcatcccgttcaccacctccgtgatcgacatggactggcatcgcgtggacgacgtggacccgaagtacggttccggctggaccggctactcgtggaatcgcgaactgttccccgacccgccggccttcctcgccgacctgcaccggcgcggcctgcgcaccacactgaacgtccacccgcgcgacggcgtgcgcgcgttcgaggacgcctaccccgaagtcgccaagcgcgtcggcatcgacccggccaccgaggagaacgtggaattcgacctcaccaacccggacttcgtggacgcctatttcgacatgcaccaccgcatggaggccgaaggtgtcgacttctggtggctggactggcagcagggcggcgtgacccgccagaagggtctcgacccgctgtggatgctcaaccacatgcactacctcgactcagggcgcggtggcaactggccgctcaccttctcccggtacgccggccccggctcccaccgctacccggtcggcttctccggagacacgatcgtgacctgggaatcgctcgccttccagccgcagttcaccgccaccgcttccaacatcgggtatggctggtggagccacgacatcggcggccacatgttcggctaccgcaacgaagagctggaggcccgctggtaccagctcggcgcgttcagcccgatcaaccgactgcattcgtccaactcgccgttctccggcaaggagccgtggaacttcaaccgtgacgtgagcgccgcgatggtggacgcgctgcgtctgcgccacgcgatgatgccgtacttgtacaccatgaactaccgtgccgccgaagccggccgtccgctggtcgagccgatgtactggcagaacccggatacgccggacgcctacgaggtgccggatgagttccgcttcggcaccgagctcgtggtcgcgccgatcgtctccccggacgatgccgccgcctgccgcggccgcgccgacgcctggctgccgcagggggagtggttcgacttcttcgacggccgccgatacgtctcatccgacgccgctggccgccgactggaggtctggcgctcgctcgaccgcacgccggtgttcgccaaggccggcgcgatcgtgccgttgcaggacgtcgcggaatccggcgaagcgatcaactctatcgccaacccgcaggccctgcgcgtgctggtgttccctggtgccgacggctcgttcgtcatgcgcgaggatcgcggcacgtggggcgcccccagcgccgacaccgcgatagcgttcacgtggggcggggccgatgcgtcgcccagcgccttcaccgtcgcgccggttaccggcgatacgtccgccgtacccgagttgcgcgactggacggtcgtgttccgcggcgtcgcgccggttgacgcggccagcggcgtgcgtgcatggtccggcgaggctccggtcgaggcgacggtggcgtacgacgaggcgaccatgagcctgaccgtgtccgtcaccggcatcagctcggctgccagtctgcgcatcgagattcccggcggtctgcgcatcgccgacaatccggtcgaatcggacgcgatggacctactgctgcacgcccagatgctctaccgcaccaaggagctcgcgctgcaggcggtccacaagctcggcatcggcgcgatcggcgccctgcgcaccatgaaccgtggtccgcgctacgccaacgatttctggatcaccgacatgcccgatgcggtggccggcgcgctcgaagaaattttgctgcgcagctgagcccggttgcagttttctgcaacatccgggtgcgccccggtatgcggcgataagttcggcatggttgccgaagagcgtggcataccgggtgcagtgcgtgggatggccttcgcgattgcactcatcgtgcggtcagtggaaaggaacttttcatgcacaaggtgaaacagcacaagggcgtcgcggtggccgccgcggtctgcgcggtcgcgatggcggcctcgctcgcgacccacgccggcgcggccggggaccggcgttattgactggctggcgttatcgagtgattggcggtatcaattagccggcgttgttgatgagccggtgttgtcgattagccagcgttatcgaccggcactgaagcatgcagtacccactgcccgcgtttctcccgcacatcccaatccccgtgcgcatgcagcacacgctcccgatagtacgcaagcccggaatgccgccccctcaaacgtcgcgtcaccttgacgcggacggtccgtcacatcaatggtgacgcggtcctgagcggcggaaaccagcaccacgtaacgctgcgtcgaatcggcatacctggcgatattgccaaacaattcccgcagaaaatcggcgacaaacactgtgtctgagttattcagcgcatcgatgcccccagcgacaataacgtcgccgacacaccccatgcgccgcaatcgcgcgccgccgctggcaagtctgatggcaaggctgatggcgcgccccagtcaccccttgcagttttctgtataagtggattttggctccaaacgcaccactccgtcatcgccgtcagtcactcccacaaaaaacttgagccaaacatactcaactttttgtgttgaaattgggaatagaacttgccaaatggaagttgagtgatgtaggctcaagtttggaaggtccaagagacgaccaatcggaacttgggcaaagaacgtaagaacaaacgagtaattaaggagcacacattatggcacgtgcagttggtatcgatctgggaaccacgaattcctgcatcgcaactcttgaaggtggcgagcccaccgttatcgtcaacgctgaaggcgcgcgcaccacgccgtctgtggtggccttctccaagtccggcgagatcctcgtcggcgaagtggccaagcgtcaggccgtgaccaacgttgaccgcactatttcttccgtcaagcgccacatgggctccgactggaccgtcgacatcgacggcaagaagtggaccccgcaggagatttccgcgcagatcctgatgaagctgaagagggatgctgaggcctacctcggcgagcccgtcaccgacgccgtcatcacctgcccggcatacttcaacgatgcccagcgtcaggccaccaaggacgccggcaagatcgccggcctgaacgtcctgcgtatcatcaacgagccgaccgcagccgctctggcctacggccttgagaagggcaaggaagacgagcgcatcctggtcttcgacctcggcggcggcaccttcgatgtctccctgctggagattggcaaggatgacgacggcttctccaccattcaggttcaggccaccaacggcgacaaccaccttggtggtgacgactgggatcagaagatcatcgattggctggtttccgaagtcaagaacaagtacggcgtcgacctgtccaaggacaagatcgcgctgcagcgtctgaaggaagccgctgagcaggcgaagaaggagctctcctcctccacctccaccagcatctccatgcagtacctggccatgacccctgacggcaccccggtgcacctggatgagactctgacccgtgcgcacttcgaggaaatgacctccgacctgctgggtcgctgccgtacgccgttcaacaacgtgctgcacgacgccggcatctccgtgagcgacatcgaccacgtggtgctcgtcggtggttccactcgtatgcccgccgtcaaggaactcgtcaaggagctcaccggtggtaaggaagcgaaccagtccgtgaacccggatgaggttgtggctgtcggtgccgccgtgcagtccggcgtcatcaagggcgaccgtaaggacgtcctgcttatcgacgtgaccccgctgtccctcggtatcgagaccaagggtggcatcatgaccaagctcatcgatcgcaacaccgccatcccgaccaagcgctccgaggtcttctccaccgctgaagacaaccagccgtccgtgctgattcaggtctaccagggtgagcgtgagttcgctcgcgacaacaagccgctgggcaccttcgagctgaccggcatcgctccggctccgcgtggcgtcccgcagatcgaggtcaccttcgacatcgacgccaacggcatcgtgcacgtgtccgctaaggacaagggcaccggcaaggagcagtccatgaccatcaccggtggttccggcctgccgaaggacgagatcgaccgcatggtcaaggaagccgaagctcatgaggctgaggacaagaagcgcaaggaagacgccgagacccgcaaccaggccgaggccttcgcctactccaccgagaagctcgtcaacgacaacaaggacaagctctccgacgacatcgtcaaggaagtcaccgacaaggtcaacgctctgaaggaagccctgaagggtgacgacaccgagaaggtcaagaccgctcagaccgagctgatgaccgccgcccagaagatcggccaggtcctctacgcccagcagggtgccgagggtgctgccgctggtgctgacggtgccggcgcttccgctggctccgcctccggttccgacgacgacaccgtcgaggccgaggtcgtggacgacgatgacgacaaggacaacaagtgatgtccgagttcaacaaggacgactacctgaacgacctgccggatccctcagatgctgaggctgccgctcaggcctcttcaggggctgacgcctccgtcgagtccggctctgcgcaggattcggctgcccaggctccttccaatgaaggagccgacgcggctcctgccgcagctgagggagagaagactggcgaaggccagtccgattccgcagacaccctcaccccgctcggcaaggccaagaaggaagccgcagactacctcgaagccctgcaacgcgaacgtgcggagttcatcaactaccgcaatcgcacgcagaaggagcaggagcgcttccgccagcacggcatcatcgacgtgctgaccgcgctgctgcccgccctcgacgatatcgaccgcattcgcgaacacagcgagatggacgactcgttcaaggccgtcgccaccaagattgacaaggccttcgagaagttcggtgtcgagaagttcggcgaaaagggcgaggacttcgaccccaccaagcatgacgcgatcctgcacaagccggacgcggatgccgaaaaggaaacggttgacaccgtggtcgaggccggctaccgcatcggcgatcgcgtaatccgcgccgcccgagtagtagtagcctccccgcaaaactgacggtcagctcgctgcaatgagttgatatttaccttggctcccctctctgaggggagccaatcataaagacttttctagaaaggagacatgaatggctgaaaacgaatggctcagcaaagacttctacaaagtccttggtgtctccaaggacgcttcggacgacgacatcaagaaggcgtaccgcaagctcgcccgcaaataccatcctgacgtcaacaagaccaaggaagccgaggagaagttcaaggacatctccgaagcctatgacgtgctgagcaagaaggaagatcgccagaagtacgacgcgattcgtcagttcggcatgggcggtgcccgcttcgccggcggttccggcggcttcgatgcttccggtttctccgacatctttggttccatgttcggccagggtgccggcggcaatggctcgcgcatccgcttctccacttcgggcggcggccccaacaacatcaacgacatcttctcgatgttcggcggtgctgcaggtcagggcggccagccgtatggcggctacggccaatcgccgtacggcaatgccggcggctatggctatgaggaggccccgcgccccgaaaacggcgaggaccgcaactccaagatcagcctgaccctgcgtcaggcggtcaagggcgctaccgtgtccctgtccgtggacggcaagaagttcaaggcccacgtgcctgcgggcgtcaaggacggacagaaaatcaagctggccggcaagggcaagctaggcatcaacggcggcaaggccggtgacctgtacctgcacgtcaccgtcaagcccgatgccacattctcgatgcgcggccatgatatcgtcatggacctgcccgtcaccgtgggccaggccgtggccggtggcaaggtcgaggccaaggatatcgacggcaatcccgttaccttcaaggtgccggcaggctccagctccggcgcggaagtcaagctcacgggacttggcgtccagcgcagcaaccagccgggcgatctgatcggccgtgtgcagatcatggtccccgccaagccgggtctggccgtcaagcacgccgccaaagaattcgacgaaaaagccggcgactatctcagcctgtaatcaggaggtgaacaatggcgcggttagccaaccagatgaagcagttatacgcgatgtgcgcaaccgcgctcgtgatgggcagggccgatctcgacggagccgatgacgtcggcttcgacatcgaactgcccatcttcaccgtcggccagaccgccgagttggccaacattcacccccagactctccgtcagtacgaccgcctcggtttggttcgtccgcagcgcaccgatggcggcgcacgccgctactgcctgcgcgacattgcccgcctgacccgagctcagcgcctgagccaggatgagggcatcaacctttccggtatcgcgcgcattttggtcctcgaagaagagaatcgccaactgcgccgcgaagtcaaacgcatgcaaaccggcgaccaggagagcgttttcgccgcaggccgtgacggcaatatcgtggagatacaacgctccaaccgcgcccgcctctggcgcaacgccatccgccgcgaaacccgcgaactgcccggccgcgatactgccgccgatatcgctgccggcgccaccggcgactccaactacactcccgccgactccaagtccatggtcctgtggggttggtgagtctggccgcattgcttcgattccttctccattcgtaaaactgtttgttatctcacatcgggcagctgccgaaaagcacgaatcttcttgacggagatgtcaaggtttgttacggtgacgtgcgaaaaccgattcgtaaggggtgctttaggctgagacggtatgtgccgaacccttcgaacctgtgagctaacactcgcgtagggaatgcgacggttgaactcctctgttcggctcggcatcccatatgcgcgttgagagagaggaagcgtatgtcaatacgcaaggagctgaccgcccagaacgtactgctgggtttccagcatgtgcttgtttccaacgtctggcttgatccggtgtttgtggccggagcaatcggcttacctattgccctgtcgtcgaacatgattaacgccatcttcatcgtctctggtctggttactttggttcaggccactcggctggttcgcctgccggtggtgcaggggccgtcagccgcgtttgacgcgttgatgatcgcggcaggtacggccggcatgctgggggcggcgagttcgtccattctcatcgcttcgcttgtgttcctgttgctgtgcctgaccggtgtgatagagcggatgcggttcctgttctctccgatgatttcgggcgtggtcatctttatggtcggtgtctcgctgtctggattcacgctgagcgagtttctaggcggggctcccggcgacaagacgttcgccgatccgcacatcctgaccgtgtcgattctgaccacggcgattgtgcttgtcctgtcgttgctcggcaagggcctgctcaagtcgttctcattcctcatcgcgctcgtcgtcggcaccgtggtcgccgcagcgtttggcatggtggacttctctcctgtggcatccaagggatggttgggcctgccgaccttcctgccctacggtccgttcacatttgactggaagatcttcatcccgttcttcattgcctacatggttgccgtcatggaagctctcggcgtctatcaggcggcttctgagattcagggcacgtccctcgaacgcaagcaggtgcgctacggtcttgccggcgaggcggccggttcagccatttcctcgctgattggtggattcaccaccaccgcctacccgcaaaatgtcggcctgctcaacctgaccggcgaaggcaagttgcgcacgcgcacgcctgtgatcatcgccgctgtgctgttgctgattctgggcttcgtgccaaaggcgggcgcgttgctgtccgtcattccctcggcagtcgtcggaggcattttcctgccggctgcggccagcctaatcgtgaccggcctgcgcgccctgcgcaaggtcgctgatgacgagcgccgtcaaacggtcatcggcatgtctctgttgctcggcatcgccctgcccaaggcgctctccggcctgaccggcggcgcaagcgtgttctttggcaacaacatcatggtcggtgtattcagcgccatcattctcaatgcgcttttcgtcgctcttccggatttggtggcgaagcatcgtgcgccggcgtccgtggatgttccagcagccgatccggcggatgggactggcgctgcggcgtacgatgaacgataatgctggttgatattggatattgacaggagcgatgcaatgactgatgtgatggatgacgcgcgtcgtatcaagcgcgggattctggattttatccatacctatggctgtgagcaggccccggaagaggcgtttggtgcgttggcgcgcgacgtgttcatctatcagtacacgtatgatctgccgtaccgtcgttactgcgcggctaaacgcgtcacccccgcaacgctcaaggattggcgggagattccgccgatgccggtggacgggttcaagcaccttgacctttcgaccataccgaccgagcagtgcgaagccgtattcatgacgagcggaaccacgcatggcggcaagatgcgtgggcgcaacttccatcccgatcttgaggtgtgggatgaatcaatgattgtgccgttccgtcatttcatcatgccggatcgagagcgtatccgcatcgccgtgatttcgccggcatgggacatgaaccagaactcctccctgtcgcgctaccttaccaaggccgtggagtgctgcggcagcgaaggcagcggtgtgttcttcgacgagcatggactcaagttcgatgaaatcatcgccttccttaaccgtgcggtgtctgacggtgaaccggtgatgctgatgggtgtctcgtcgtcctatctgtatctgttcgattacctgcatgagcatgatctgacgttcgcgctggcccccgatagccggttgttcgacactggcggcttcaagagcactaagcgcgacatcaccgaagaccagatgcttgatgagctggaacagacactgggggtgccgcgccaccactgcgtcaacatgtatggcatgaccgagttgagctcgcagatctatgaccaaaatattctgtcgtggtatacggatggcaccagcaactatctcaaggcgaaccccgcctgggtgcgcacggtcttcctcgatccggaaacgctgactcccgtcaaggatggtgagaccggtgtgatagcccattacgaccttgccaattggaattcatgcatcggtattctgaccgaggacctcggccatcggaccccggacggattcctgctgcagggcagggcgaagggagccgaggctcgtgggtgctcaatcgcggtagacgaggtcatcagtgccaaccgttgatgaatccgtgagtcaggccattgatgtcttccacctgccctcgggagtggatgtttcggattacgaaatctatgaggtcgccacatcggatggggtgaagcgtttgcgctatccgcgactggatggctcaaaggtgacttcccttgccaagcagcttgtcgatgttcgcaaccgcacgcttgccgcgatgagtgtcaacgatattctcgacatcgtggccgacgcggcccaactatgggccgatccggattttgagctgcggcgtcaggctgaactgctgattcccgcaatcaccggatatgagcctgacatggtgcggattgagctcaaacggtatatgcgccagttcaggcgtcgtgaactgctccggttccttgactccgaaatcggtcagccgtctatgctcgacgaattccggccgaacaaggcggggggatactctaaatatgtgggcccagcgctcacctatcaggtgttctccagcaatgtgccggggattcccgtgtggagcatggcgatgaccctgctggtcaaaggcgcgattcttggcaaatcttcattttccgagccggtgatgcctgcgttctttgctcgcagcattgcgatggtcaattccgacctcgctgatgccattgcggtggttccatggaagggcggctcgcagcagctcgaggattcagccatcgatgcggccgatgccgtgattgtttacggttcttcgcagactaccaaattgattgcgggcaaagtcgccgggtccaagccctgtctaggttacggagcaaaagtcgggttggcgttcattggccgagaggctttgcgtcctgatacctatgccgataccgtgcatcgtgtggctgttgacatcgccacatatgaccagcaaagctgcctggctccgcagaccgtgttcgtggagactgatggagccctcacccctcgtgaagtggctcagctgctcggtggcgagcttgagaatcagcagcgcaaatatccgcgctccgtattgagtgacgccgagaacgtggccattcagcgggcgcgcaccgacgctgagatgagagccttgatgggcgggaaggccgcggtgttcgccagtggccatagcacggcatggtcggtgctgtatcgagaacttgacggtagcggtgccgacgaggatgttgcttcgctgatgtcgccgttgaaccgcaccgtcaacgtggtggcggtgccagatttgttggacgctgccagaagactgacttcctgccgtggctggctgcagagctgcggtgtcgctgtggattcaaccagactgtttggtcttgcagatacattggccgaggtcggtgtgaatcgcatctgtccgctcggtgagatggatcgggcgaaatccggctggcatcatgatgggggcttcaacctcatcgatctgttgcgcgtggtggatgtcgaacgcggcagcgacgcgtacagcgattcgttcgatatggatatggaataggcctgtgctgttgcgggcagcagaggctggtagcagggcgaaaggcaagggtaatgacagagcaaagcgatatggcacggcgtccaatggtgaatctggatggcagaacagcgatcatcaccggttccggcaagggcataggagcggctgtggcgaaatgcctggcatcgcacggagccgctgtcgtcatcaattacgtacatgacgccgccagcgcgcagcgcaccgttgaagacatccactcgctgggaggcttggctatagctgtacaggcggatgtttgcgatgaatcgcaatcttccaagctagtgggtaccgctgtcgactcattcggcggcgtggacatcttagtgaataatgctttcggacgcttctcctttgacccgcgtcgccgttccacttttgctggaggcgattgggatgagtttagcgcacagatcgagggatgcctgcatggtgcatatctgatgtgctcacatgtggtgccgctgatgcgagcccagacctccgggcgtatcatcaacatctccagcaatctggtcgattcgcccatcgtgccctaccattcgtatatcactgccaaaggcggcttggtcggcatgacccgctctctggcccaggagctgggcggcttcggcattaccgttaatgccattgccgcaggtttgacggccggaaccgcatccagcgcagccaccaccgaggatgttcgtgaacgaatcattgccatgacgcctcttggccgccttgcccgtcccgatgacatcgccggaggggtcgcgttgttggcgtccgacatggccggcttcattaccggacaatgtctgcacgtcgatggtgggctgaccatgcgctgaggcgcaggggcggtgtgctgacgcgctatggttgtcgcatccgattggtgcaatggaatgcagcaagagtaaaggcgccaattggcgtgcgggcatgtggacggaggtaactatgctgctcaaagccgtgttctgggatttggacggtactctcatcgattctgagccgctctggcatgacggtgagattgagatcgcgcacaacaatggcggcgagtggaacgaggacctcggttgggagtgctccggcactccggtaccacacgtggcagaggtcatgattgcgcatggctgcacattgagcgttcccgaaatcgacaagcagctcaaggattatgtgttcaaggcggaggtcgaacgtctgccgtggattcctggtgtgcaagacgtgctgcattcgctcaaggaagccgacatcccatccatgctggtcactacttcgcctcgccgcatggccgagaacatcatgaagcaggctgatggattgcttgccggctacgtctgcggcgatgatccgtacgagcacaagccgagccctgccccatatctggccgcggctgagagactcggcatcgcgcctgaagacatggtcaagtgcgtggtaatggaagattcctcatccggtctgcgctccggcgccgcctcgggggccacactgattgcgcagactggctggattcgcaccgacacttccggccttggccagtttgcctccatcgactcgtatgagggcatcgatgcggccgcgctggacgcctttgtgcggcagcgtttgggggagtagaaatttcgtttgtattgcggagtttgtgtgggaaaccccagtcgacctgatgttataggccggctggtagggtatttgacggtttgcatataactgtctggttcattgggctggcagctcaatacaagatttaggactcataggaaacacatgggcttcgttaatttcatcatcgaactgctgaaggatccgcgtgccgcgattgccggttggattgccatgggcgtggcgccgaccctcggattcatcttcctcatcgtattcatcgaaacgggcgtggtgttcttcccgttcctgcccggtgattcgctgttgttcgcggccggcgtgttcgcagccccggatgctgcgaccggcaaggccgcgctgccgctgttctggttgctgccggtggtttggtgcgcgccgattatcggcgaccagtgcaactacttcatcggtcatttctttggccgccgtattatccaatccggcaaggtgaaggcgctgactcctgagcgactggccaaaaccgagggcatgattgaaaagtggggcccgctggctgtgttcctgggccgcttcttcccgttcattcgtacgttcatgccgttcatttccggtatttccggtatgcgttggagccgtttcacgccgttctcagtgctcggcggcctgtgctggtccacgttgttcacgctgctgggctacttcttcggcaacattccggccgtgcaggatcacttcgaactggtgatcgtgctgattctgctggtttcgctcgccccgaccatcatcggtctgctcaaggccaagttcggcaagaagaagccggccaaggtgaccgatgctcagttggacgtcatggaagacggcatcaagaacctcgataagtaagcaaggaatgtagattaccgcataaggaatcgtcgtgaaaatgaaggccctgactgtgcatatgaggtcagggccttttctgcatgagatgggcgtgaaacaacagcgtggttatccacatttgtcgtggacgacatgccggggtgtggataactcagcaagctagaaccacaatggtcgattcgtgttgagcattgaactcggacacgtttcaatcggcttatgaatagcaacaccacaccccgcgtggcgcgtaggatcacctcgccagcggtagcacctccgggcattccgctgcccacggacgatgcgccgattccagcgcatcgctactacactccgccgcccaggccgttggcctcatgcgaacggcagagatcgggcgaggctccggcactcgccctaactacagacaccagcttccataacattgtgacgatgacgtcaggtcatggaggcgtggggttgagtgtcatggcttccatgcttgcatggacattggcgagacgtgaacacagctgcgctctcatagacgctgatttcgtggccggatgccttgacctgctgctgggtgtagaacgagagccgggtttacgattcagccaagtcgacgcacccctcggccgcatcgagggcgatgcgatgaaccatgagctgatgatgtgggagggtgtgcgagtacttccctatgacccttggagcgcgcgccagcctgactggtgggaagttcaagcggccattcgagccttggcggaaacgaacgacgttgtcatcgtagatgccggtcagggtggactcattgagaccgtacccgatctgcgcagtggcatgcaggtgattgccgcggaattgtcggtgatggggctggccagagccaagtcgcaccggtccagactggattcatggggctgtgaagcgccacatatcgtcggcgtggaaccacgtggcgctccacgtgggagaggccacgtgggtattggtgaggcgcaggactatttgactgccacggtattggggcctgtcaaaccaagtgtcaatctgtgtggagacgtactggaaggcctcggcatcagatcggtgaccaaaggcagccgcaaagccgtgagcttgcttgccgatcttgtcgagcaggccattcgcccggtttcgggagcttcttgcaaggaccggtgatgcggtatggctgccgtaatcactcgggctgatgagcccggcgcagtgcccagaactgtgttcttcggtctattgaatgatgtggcatccgacccgcaggttaccgatctggcggtgacctgtgatggccgcgtttgggcggaccgcggcaacggcatgcgagaaacagtattgcgtgtgccgtttcgctcgccgcaagtagttcgagaatacgccgtccaactgtgcgcgcagcttgggcgcagactggatgatgcctgcccgatagcggacgccgccagtccagacggcatccgcgtgcatgcggtgattgccccattggtgccacaaggtgccgcaatctccatacggttccctgacaggaccatggcatcgttgcgacatctgagccaattaggtgtattcccggctgcttggctgccgatgttcgtgggactggtgcgcagacatgccacagtgctgattaccggcggaacaggcgtgggcaagaccaccttgctcaaggcgctgctggcgcaatgcgatgtgaacgagcgcatcgtcaccgtagaggaagttcgtgaactgggagaactggggcgtggcgatcatgtgtcgttggtaacgcgcgaggcgaatgtggagggcgtcggagccataagtctgacggacttggtcaaagcgacgttgcgaatgcgccccgaccgcgtggtgctgggcgaatgccgtggcgcggaaatcgtcgacctattgcgcgcgttcaattctggtcatcacggtggcatgaccactgtgcatgcggacggcgtgaaccgagtaccgtccaggctgatttcgcttggattactcgccggagtcagtccacaggcgttggccatgctggcggcaggcgctttcgacgcggtggtgcatttggagcgagtgaacggacagcggcgtatcacgcagatcggcgaactgcgtgtagcacatggtgaactggcaggaacaccgctggcggtatggaatggctgccatcctcctcggtatgccgccgaatgggggcacttcattgaacgatggggcatcgttcccgggccgagtggtggtgggtgatgatgtggtgtgctgttctggtggcgctcgccgtgctgatatggccggggaacaagtccgggaggctgtatcggctggcttaccgcgggcgtgcggtcgattccgcagccataaacgaacctcgatatgccggctcacctcgcgtgggcgttgcgcaggtgattacgtccgccatcgcgcgattgcgaggtggcggcacattggttgaagcattcgaggaacaatccagcagacgcttcgccactcagcgcattactgtggaacggctcataacggtgttcgaacagcggcgtctgcccgacgaatcaccagcgcaggtacttgaagctgcacgcggggtcaccgccgcagcggttttgagcgatgagctcggttgccaagcagtgccatgtctggaagcggtattgactgcttaccggcagatgaggctgatgcagaacctgcgatcgcaagcatgtgccgttcctaaagccactgtggggctgctgagcgcgcttccggccgtcactgtggcattgggcgagcttctgggagctagaccattggcgttcttgcttggatcgccacgcggtgtggtctgcttggtattagggggatgttgttatgctgccggcttggcatggatgcgggcattgttgaaaggcagcggattatgagtacggtgtgggtacacgccgcggcaggctgtgcggcgatcgctagttggctgtataaggctccgtcttgtcatgacagccgcttgccgggcgaggaaccggccgtagcgcatgattgcgggtcgtcatggaccatactcatattgcgtatgtcgcaggtgtccttgcgtcagggctcctcgattccccgggcgcttgacatggtgggcaaagccgtcggcggcgactgcggcgctcgcatgagcgaggtcgggagctccctggccagaggggttccctgggctgatgcgtggcatgccgctatggctgttcagcatgagggtgcgccagctgatagttcatccggaaaacgtaccagcagaacgcaacgagatcttggcctgctgcaatcggctttggaatcgtcatggacgcatggcgatatgcctggcgtgcgcctcgaatccgccattgaacagctggaccgtgacgagcgtgccgccatcgaacggaatgccgcgaagctgtcggtaaagctactgatgcctacagggctatgttttctgccggcattcgtgctggtaggagtcattccggcgattgcgtccttcatgatgtgaatataggcgtgaactgagtgcgcttagggtgaatcttgttgtattgctcggtattgcacttggctgcgtttggttatccacattggtggtggacgacacgtcggggtgtggataactcggcaagctagaaccacataccccgttttccctggtgcatgaagcgttgatagtccacagtggtatgcaccccgcgtcaacccggcgcgggggccaaccactcacacacgcatggggaaggtgcgaagccactgcgcagcttcccctccttaccgaaaggaacgccaatgaatacccctatccccgtcatcgtcgacgggcaggccggcatctttgcgcacagcaaggctcgtgtggccacgctgaacgccaaggcgaaagaacggctatgcctcatggacgcacgcatccgcaccctcatggctgagcccgaagaaggcgcggccactgcggaatacgcagtcgtactcgttgcggctacaggctttgcggcggtgctggtcgccatcctgaagtcggatgccatcaagacgttgctgaccaacatcatcaaacaggctctgaaagtcgggtgacagccatgaagaccatgacatgccggtggcggctcgccagactgccgccagacctatgcacggggtcggccaccgccgaattcgcaatcgtattgcccagcattatcgccatcgccgggctgatattggcaataggacgtgtggtcatcgtttccatggactgtcaaagtgccgcggcagcggctgcacgcgagtttgtggttaccggtgacgaatcatccgcgcgcagcatagctgcggacgttgccgggggaaagccccacgtcagcattgcccacgacggccaatcgacgagtgtgacggtcgaatgttcggtattgcccggtccgctggatgtaactccaacgcgggttaccggcaacgctacggcgataagccaataacggtcggctggctgggcggccgcaacagaaaggaactgcggtgcagggaatgcgttatgaggagggatcgggcacgatggccggagccatgctggttatggtggtgggcattgcgctcgcggtggcggcaagtgtgggcaacctcatgatctgccagaaccgagcgcgttccctcgccgaccttatcgcctttgacgccgcgtatgcgctgtggcatgcggatatcggtgatccatgtgcgctcgccgccaacatggctgaagcgaatggtgtagttttgggctcctgctccgtgcgggatgaagacgtgttggtaaccatcaaggtggaaaccatggtcctggtggcatcatccgtggagcggatggctcgggccggaccggtgagttgtacggaaggagacaattatcacaataatggaccgtaaagcaccgatactctggcgggcttctgggcctttggctaaggtgagagcatgagcgagagtgaacgcaacgagcgccgtcgcgtggtggccatggtgggcaaccccacttccgataaaggccgtggcgctaaggtggacgcgcaggtattgggtctgctggaggaagccggccgtgcccataacttcgacgtcatcgacatcaccggcacgagtttcgacgattccctgaaccaggcgcgtgaacgcgagcacgagtacgactatctcgtagtggtcggtggcgacggcatgatcgcacttggagcgaacgccgtgggctgcagtggcaagccgttgggcatcgtggccacggggtcgggcaacgatttcgcacgaggactgaagctgccggtcaaccgtatcgaaaccgcagtggaaggtatcgtcggtgctatcgtgcgcggatcacacatcgatgtggacatgggacgcgtgacctctttggacggcggctatgccgtggatccctccactggcgaggagtacgagtaccaggagagcaagtccgccgagcatccgattgaccggtactatgcgggcatgctgtcctgtggtcttgacgcgagcatcaacgaccgtgcgaatcattcgcatctgccgaccggcaccatgcgctactttgcggcggtgctggtggagctgacgcatatgaagcgttatggttaccacatcaaagccacattggcggacggtaccacggatgaacgagacatcatcacaccattgctgacgattgcgaattcgaggcatatcggtggcggcattgaggtctcgccgtactcctgcttctccgatggattgttggacctggtgtggatggaccacgtgccgaacttcggcgaatgcgcggtggccatttcgaatgcctataacggcaagctacttgcttcaaaggtgttcggctggaaacgtatccgtgaaatcgaagtcacgcgggcagcggaaggcgacgagccgccggtgctgatggcggacggcgaatatatcgggcatttgccatttagggtagtggccgaggactgcgcgttgcgcgtgctagtgccgccggccgtagccgcccgtgaggtggattcccgacaggaagtgctcgacgtcattgcccgagatggtcgcgatcccgtgaccggccagttcgcgtgacccgattatattggctcccctcattaggctgagccgtaaagcaaacagcccagtgggctgtttgtaggcgagggttcgacgatagtcgaaccagaagaaagtcagccgtaggctgtccgcaattgcggacgagctggccgcgaagcggactgaggggagtgcgggagagcggtaccagagccaatgcccgtcagacctcagacgacatagctttcgatatgcagcgtctgcgccatgacctctttgatggttcggtcgctgatgttcggatgcgagcgaatcagtgagataagccccacaatcagtgtgaagaacgtctcatggacgttggtgattggcaggccatgcatctgctcgaaatcacgtacggtggtctgggcaatgtagtcggcaatacggtccgccgcgcggtcaatgaacttgatatacagttcggcgttgccgtcttggatcatacggtttgagaaggggctctcgtcggcgatcagggagcggagtacatgcacgatgtcgtctaatgccttgttcacgttgcctgtttcgcgcgcttggttccactgcttcaacgtggtgaggatttcgtcgatgacgttatcgagtactgcgtcagctacggcttccttgtcttcgaagtagtggtagaacagcgaacgcgtcataccgacttcgcttgcgatgtcggaaacggtgattttggagaagcctttttccagacacaccttgcgcgcggcttgcacgatggcgtcgcgccgggcatcgccgcgggtgggacgtttctcgtcgagggtatcgctcatgggtgcctcctgaccacaaccgttattgacactatgttaatacaaagaaagcggttaataacaataaaaatgcggtaaccgttgtcaggtgaatgtcgttggaatataaagagttttcccgattcggcaactatgagcccggtttatcttgactttttatcggttaattctgagggcaaaggtaggttagtagctatggcacttgcactgtatcgtcgctatcgtccggacaccttcgaaggggtcatcggccaggaccaagtcacggtcccgctgatgcgcgccttggacgagggcaagctcacacatgcctatctgttctcagggccgcgaggctgcggcaaaaccagctccgcgcgtatcctggcccgttgcgtcaactgtgccaaagggccgacttcccacccctgcggcgaatgcgaaagctgcaaggacctggccaccggcggtccgggttccatcgacgtggtcgaaatcgatgcggcctcgcacaacggtgtggatgatgctcgagaattgcgagaacgcgctgggttcgcccctgcgcgcgaccgctataagattttcattctcgatgaggcccacatggtcacgcagcagggcttcaatgcgctgcttaaaatcgttgaagagccgcctgaacatgtgatgttcatcttcgccaccaccgaaccagacaaggtgatcggcaccatccgttcgcgcacccaccactatccgttccgtctggtgccgcaggaagtcatgggtccctacctggagacgatctgcgacaaggaaggcatcaagcccgagcccggtgtgctgaaactggcgatgcgcgccggtggcggctccatgcgagataccctgtccgtgcttgaccagctgatggttggttcggtcgaaggcgttatcacccatgatgccgctgtagccctgctcggcttcacgccggaggcactgatcggcgaggccgtggatgcggtaatcgatcacaacggcgaagccctgtacggcgttatccagaaagtcgtggtcggcggattcgatccgagacgattcgtcgaagacctactggctcgtgtgcgtgatctgctggtgcttacgttggccggggaccgtgcggaatccgtgctgtccgacacggctgaggccgaggatatggacgatctgcaccgccaagccaaggcgctgggactgggcgcactgaccgcaatggcagacatcatcaacactacgttgggtgccatgaccggagccatttctccgcgtatgcgcttggaactgctggccgcgcgattgttggccggcagtgaatcaggctttgcaacagccgctcccgcgccagcttcttctggtatgccgcctgcggctgcttcttcgacttcgactacgtcagccgcttccggtacgggtgccagtggttttgccggcgcatcgcggggcgggtttgccggagcctcacatggcggattctccggtgctgcacgcaaccagcaagcagccgcgcctcagagcaccgcttcccatgaatctgttggaggcaacggccctgtcaacggcccggtcagcgaccgacccgcgggctctctgtctgtgcaacctgctgtagcaactgctgctgccggtgccgctcctgccgccaatgccgggtggggcgcgcccgccgcgtcgccggccgtcccggctcaaccggtgacctcgcctgcggcatcggataatcggtccatcgacgagaagtgggatgcagccgtcgccgctttgccggaaaccattcgtgaatatgtgtcacgagacaaggtgccgaccgtaaaattcggccccaaccgtaagggtctgccttgcttgtcgatgacgttcgacaagtcgctgagccagcacgctttcgccttggccgtggataacagcggtaagaaggcggcggccgtggtgatggatgccgtgcgcaacgagttcggcgccaatgcggttattgcaccttctgcggtcgcggcgaatggcgagcgagtcgaatccgtcaaacgtatgagcccggagcaattggccaaggtcaagcagcagattgccatggccaaggctggattggccgcgtcgagtttgggcgcgagcctgggcattcatatggggagcgagacgaaagctccgaagccgactgcaacaggccaagccgaggacgcagacgacagccatcgagccggacaatccagtgcatccacggcagcgaagaactggagtgacgatgacccttgggccaagccggccgtaagcaacgcttcgccgcaatctgcagacgggttcgcacctaacgagcccgctgctacgcctgcgcccgaagagcatcacaagaagcatgttgcggttccggacatcagtgacggtgttgatccgtgggccgctccggctgctcctgttgcacccactgcgtccgttgcgtccgctggacccactggacagtccactgggcagccagccaccgcatcttccgttacggcagttgccggcgcgagcgacgatccatggaatcagacgcagtctcaggccgcggtctcaccggcgtcgcaaccggccgaagccgacccgtggaaccagccatatcagcagtctcctcacgatgatccgtggaatcaaccgcaggggaaccatgctcaggcggctccgcagccaggagacgacccgtggaatcagcctcagtcccagactccggcttcttcggttcctcagacagtgtcgggcaatatgtcgggcgatgacccgtggaaccagccccaatcggttccgcagccggctgccggcgatgacccgtggaatcaaccgcaggcagttccacaatcggctccgcaggccaccccgcacggtgacccgtggaatcaaccgcaacccgcacagccgaccccgaatgccgacccgtggaatagccagccccagccccagccgaaaccacaaccgcaagtcgcggccgaggatgacgaatactcgatgagcgaccagtcgctcggcgaggcgacggccatgaatctcgacgatctgaaaaagctattcgaggtcaaaaaagtcgagcaattcgcggcagatgatccgaagaaccccaagaacatccagcctgccaagaagcactcggatgaataatgaggacgaataacgaggaatacccatggcacttgcttatgacggcgcaatacaacgactgatcgacgctttcgggcggctgcccggcatcgggccgaagggcgcgcagcgtatcgccttctacatgctgtccgcgcccgaagatgaagcgcgcgatttggccgaggccatcgaagaggtcaaggccaagatccgcttctgtgatatttgcggcaacgtgtgcgaatccagcccctgcccggtatgcgccgacccgagacgcgaccgttcggtgatctgcgtggtcgaagagcccaaggatgtgatgagcatcgagcgcacgcgcgaataccacggcctataccatgtgctcggcggcgcaatcaacccaatggccaacgttggccctgccgacctgcgtattcccggtctgctcaaacgcttagaaggcgatgaggtcaaggaagtgattatggcgctcgacccgaatattgaaggcgaggccaccaccagctacttgacccagctattgcgacccgtaggtgtcaaggtcacccgacttgccagcggcctgccggtgggctccgacttggagtatgccgacgaaatcacgctgggcagggcactggccggtcggcgcgaggcctaagccagcgtatcattggcgctttcgcccttgcggcgcatccacggccagaatgcgccgtggcggatgatgcgcgcggccttgtggcgtcgtgccaaccagataatgaacagtcctgccgccagtatgcctagaccaacaccaagggcgatattgcgcgcgtcaagcacgtcattcggctcgggggccggcatcggaatcgccacgcggtgcccggagataagcagtcggtgcgtgttcacgccgtatggcgtacaggtcatcaaagtgacgcgatcctcacccggcacgatcttgagcttcgacgtgtcatccggcaaaatcaccgaaatgcggtccactttgtagcccaaagtttcgcccatgacttcgatgtagaagaagtcgccctctttcacctcgtccaaacgggtgaacatcagcgcttcaaccaacccgcggtgcccggtaatgaccgaatgggtggatttacctcccaccggcagcgacgtgccgtacaagtggccggcaccagaagccagtgcttcctcggaagtgccgtgataaaacggcagattgatggactgcttgggcaccttgattgtgcccatcacgccgttgccggtattaagcagtgactggtattccttgtctttctttgaggcggaatcctcgccgctggcttgggatcctccttgagcggcggcgaacggatcgacggcttcacccaagataggctggccggattcagcgagcttcttgttgtatgcgcgggccgccgtgagcttgtcttccgcctgcgggtaaggccagccagctacttctttggccgtggtggctgtggtggcggccaagttgcggtcggactcgaattgcaacgctagcgggaagcaggccacggcgattgcggcgatcagcagcacaatggtgatgatgcgcatcgcccacaggttgcgttgcaggcgtcggcgctcggccacgagatcgctgatatcgatgacttcgtcaaatggtgttggaacgaatgctgcgggctcgggccgcgctgaggaaacgttgtcatttgcagatgcgtcatccggcatggccgcgttgttttcccacattttctgtgaggcacgcttactcgtcgaacgtcgatgcagcaatgccatagtcgcctgttccttcgcttgatctgctcatgatttgcttatacaagacggccgggtccgtcttagtcgtgcatggcataggtgctgtcgcaaatggcaacaccgcacgcgccacactgcgaaacgttactccgcaccaagcctttcatgcaacatgccgacggggccatataggggcaatgtagggggcataagaagtctgaaaatgcgatacgaacaacgttgctacggctgtcagtgatgcggcttacttcggacaagccgttgagatgcaaggggatgcaaaggattgcaaagtatggcaacatgataagtcgcggcgtcggcaatatttggcagagctttcaaatagggggggtatgaatgcataaagagggaatatgttacctcgataaaagaggcgctattgctgttttcgtggatgtcggttcgtcgtcgagccgttggtttcgtaggcgtgaggggcgttcccgcgtattctgttttccgaccaaagaaatgaatcacgaagaacgcctgagcaaaagctcattcgccggattgccgaacgtcaaaggcgcggttgcagaggatgcgcggatcacggattcgccgctgcgttccgaattggctagtgtgatcagagaaaagatggcactgtctgggcatctctctttttaggtcaaggaaaagggtctggcgataggcggtgatgacgcccatcgtgttggtggcactgttgctgcaaaaaggaaaagtctagttcgtaatctagtgtccaacttccctaataggaatggtccaacttccacaacgaaaatagtccaacttccacaattagaatggtccaacttccgcaatagagtgatttataggttgatgtttcgacggtttgcgggagggcacatatggcagtggagagctcggagattcaacgtggcgagtaccttcctcgagtggctgatgggttgctgactcaggcattgcagtcttctggtgccgttcagattaaaggtccaaaatggtgtggcaagactgcaacggcagaaaggcagtcggcgagtcaggtcttcatgcaggacccggatcgcagtgctacgctgttggccttggctgatacaaagccttctctcatcctgcgaggtgaggagccgagactcattgatgaatggcagatggccccgcaattgtgggacgcggtgcgtttcgccatcgatcgagggcgcggtcgtggccgattcatcctaactggatcggcgactcctcaacaggaaccagctcattccggagtgggaagaattgcccgattaaccatgcgtaccatgtccttatttgaatcgcaggaatcgacgggcgttgtttcgttgggagagttgttcgatggcaaccatgatgtttcgggtttctccgatttcgatattgaaaacaccgcgtttgcgctatgccgcggtggctggcctgaagcagtagtcgaatctcgagtaaatgttgccttgcgcatggccgcggattatgtcgaagaactacttgattctgacatcaatcgtatggatggtataaagcgcaataaaacttggatgcgtctgattatgcgctcgtatgcgcgcaatatttcttctcaggcgtcgcaatccactatcgcggcggatatgcagggtgaaccgccttcggaaggtacactctccgattatttagatgcattgtcgcgagcttgcgtaactgaagatcttccagcttggaaccctcgtttacgttctaagactgcagtgagaacgagcccaaccagacacttcagcgacccgtcgatagcttgtgcggtactgcacgcgaccccggagaaactccttaatgatttcgagacctttggcttgctgtttgagtccatgtgtattcgcgatctgcgtgtgtatgctgatgcgcttggcggagatgtgttccattatcgggataagacgggattggaatctgatgcggtcattggcctgcatgatggacgatgggctctcattgaggtcaagctcggagaaaagcaggttgatattgcggcggcccatttgaaaaagttggctgacagaattgatcaagatcacgaaggccgtccgtcattcttgatggtgctgaccgctacggctgccgcttatcgccgggatgatggggtattggtagtgccgttggccacgcttgctccgtgagctcgtatcgtgcgtttgacccatcgttcccaacacaaaaggaaaaggcccgggctgcgggaccgggccttgaaaaggagagaggaagaagaaggtattcagttatggggtctgcggaaacctcgccggtttgctttcgtttgccggtaattgatagttaaccgctcgaatctcaaaggatggatgcggctgcctcaaagaaccaccggtgaaaacttgaatatttgctgaacaacgtaggccatgcccgtgtccacatgtcggcgcggggtcgcggggtgaacgcggcaacctttataatcgttgcgtttgcgtagaatattgagcaaactccccctaagagaagaacaaaggacagcagtggctctcatcgtgcagaagtacggcggttcgtcggtcgccgataccgaatcgatcaaacgtgtggccaagcgcgttgttgagacggaaaagaagggcaacaaggtggccgtggtggtctccgccatgggcgacaccaccgatgaccttatcgatcaggcgctgagcatcgactccaacccgcccgagcgcgagatggacatgctgatgaccgcaggcgagcgaatttccatgagcctgctggccatggccattcacgccgaaggcagccgtgcccactccttcaccggtcagcaggccggcttcttcaccgacgcccgttacggcgcggcccacatcaaggccgtgagaccggaccgcgtgaagaacgcgctctcattgggagacatcgccatcgttgccggcttccagggcatcaacgccaagggtgacgccaccacgctcggccgcggtggttcggatacctccgcagtggcgcttgccgtggcgctcggtgccgatatctgcgagatctacactgacgtggacggtatcttcaccgccgacccgcgtatcgtgccttccgcccgccgcattccgtccatcgattacgagtccattctggagatggcgtcctgcggctccaaggtgctggcactgcgctgtgtggaatacgctcagcgtttcaacatgccgctgcacgtgcgttcctcgttctcccgtcgccccggcacattggtggtgcccgacggcattgacccgcgtacgctgccgaacctcgactgagcgcggctacagcgaacgataatcgtaagtaatttcaagcaagacaaggcaagacatgactgaagaagaagcgaaatccatgggcgacctgttccctgacctgggccccgaggcaccggtgatttccggcattgcccacgatcgttccgaggcgctggccaccgtgcgtggcgtgccgaacgagccgggtatggccgccaaggtgttcaccgagctggccaccgccggcgtgaacgtggacatgatcgtgcaggccggcgcatccgtcggcactgcggacatctccttcaccgtgcccgaatcggccgtcaagcaggttcagaacacactgctcgacaagcaggaagtgctgggctaccactccttcgatgtggacaccaacgtaggcaaggtggccgtggtgggcgttggcatgaagacccatgccggtctggccgccaagttcttccaggccctgagcgatgagggcatcaacgtgctgatgatttctacctccgagattcgtatcgccgcgctcgtgccgctcgatcagctcaacgacgccgtcaaggcgctgcacaccgcatacggtctcgatgccgatcaaatcgaagccgtggtgtacggcggtactggccgctgagccactgagccgcgtttttgcggtatatacgacgaaagccctccttgcggagggctttctcagtttcggactcagtttcaactacttcttggtgatgtagccgagagccttgagcatttcggcgcattcaagggcaccgccggctgcaccacgcagggtgttgtgggccagacccacgaacttccaatcgaagatggaatcctcacgcagacggccgatggaaacgcccatgccaccctcgtagtccacgtcgagcttgacctgcgggcggtcatcctcggtgaggtactggatgaagtgcttcggtgcgtgcggcagctccagctcggaagccttggacgtgtagttcaccagacggtcgatgagctcttccttggtggccttcttgccgaagttcaggaacacggtggcggtgtggccgttgagcacgggcacgcggatgcactgggaagtgatcttgaggtcgccgtcgaacggcacgatctcgcccttggcggcgtccacatggccgaacaccttgagcggttccttctcagactttgcttcctcaccggagatgaacgggatgatgttgcccaccatctcgggccagtccttgaaggtcttgcccgcgccggaaatcgcctggtaggtgctcacaaccacctcgcgcggctcgaattccttccacgcggccagcgccggcgtgtaggcctgaatcgagcagttcggcttgacggcgataaaaccacgagtggtgcccaggcgcttgcgctggtgctcgatcacctcgaagtgctccgggttgatctccggcaccaccatcggcacgtccggggtccaacggtgggcgctgttgttggagaccaccggggtctcggtcttggcataacgctcttcaatggcgcgaatctggtccttcggcatgtttaccgcagagaacatgaaatcaacgccagaggccacggactcggcatcgtcgccatcgacgaccaccatgttcttgacatattcgggcatcggggtttccatcttccaacggtcgccgacagcctcggcatacgtcttgccggcgctgtgcgcggaagcggcaagcgtgaccacctcgaaccacgggtgattctcaagcagcgtgataaaacgctgaccgaccataccggtggcaccaaggatgccgaccttcaatttttcggacatgatgacctctatgacctctgggtttcgatggattacttacgtcggacggccgtcatgcgggtggccgtaaaacaatgcaattgtacgaaacacgcggaacaacggcagtggtcttcccagatggtggctgcccaatgaagcgaaggcgatgttctacactggtagccatgtctatcgcatcagtagaggcccaaaaacagctcgaccgtatcgtggctctcggctacccggatgtggcggatatttccgccgccgcattccgctcgctggcccgacctctgatcggggcgctcgagcattccgatttgggatcgaacatcctgctggtgcccacgcgtgaactggtttcgcctgagtcgctgattgcacgaacctccatcaatcgcatggcaggcttcaccaccatgccgccgcgtgacatcgccagcttcctgcttcaagacggcttcatgccgccggaaggcccgttctatctggtcgtcaatccgcacaccggcacgtgctatgtcaatcgcgagccggatgtggcccgcaaacttattgactccgatgagcgcctgccgctcaccctcgaggaaggcttggccatcgccacccagcacccggagtggctgctggaaaagaacggcttcaatctgctcggctcacgctccgcagacggacgcgtgccgagcatctggatgagccagaacgcaccgcgactgggagccgtctggcccaattcccgccatacttggctgggcaacgcgtattgcacggcccgtcgcggggtgagcctgtttaagtaggtttagcgcgcggccttgatcagcgaacggatgatggctataaagccaaggctcatcgcgccggccaccacggcgaacacctgcgggcggcgcagctcgttgcgtgcgctgaccgctccggtaacgcaatgatcctcgaaccagacgcgcagctcgttgctggagtagcggccgaccagattaccccatgtgagcatgcgggtcacatagcccgccggattgctctcatggaattcaaacaggcgaatgccgcggtaccgcgacttgggaccatagcattcgaacccgcacgtgggtgcatagcccagatcgatatcatgcacatgaccaacgaaagagttcttatggtcatgcccgcagaacagcgcgaaatagccgccagcctcgcgcaaggcatccacctcgcccacattctcgtccgcgcagccgatcgcctcgccgagccgcgagccggggcggcagacctcatggttgagcacatagcaacgcccggcgtgcgtgcgcgcgccttccacggcgttcggcgtccatgcgggcacttccttcagacaatcgtagaattcctgcggcggaatgtgctggaaggcgatggccggcacgggcttgccgtcgccattgcgctcgcccaactcggtttggacggaccccagccattcgatggccttgggggtgggggtgccgtacccgtcggcgtcggccaggtcgagtcctcgcggattgaccacatacgccgggtattgggcgtcgttttcttcgggtttgccggcataatcgcctgaattgaccatcataacggacatggccacgcggccggaaccatcggaggactcgacgggcagcgcgaacgtgccgggctcgagactgtcgtcggggttcaggcagccggggtattcgcggtagatgtcatcctgttcgtcggccagaatgccgcattggaagtcgtggttgccgtaggtggcggcaaagggcacgccggcctcgacgaccggaccaaggaaaccggagaacgtgcggcggaccttttcgcgggtctcaatcatgagttcgtcgagggtcgccggcgtctcgtgtgcggggctggccttgccggattgcgttgaatatacgagggtggaaaccgtctcgggcgtggggctggtctcaacggaatcgcctacttcggaagtcgtgatcacgtcggtcgaatcggcgccggcagcggcgacggcgttcgtcacggtatcggggtcaagcagcgcggctggtacaggcttgccggcttcggtgagacgatcggccacgcgatcggatgttttgcgaattacggggtgacgcttgatcccgcggattttggcctcgatctcggtgaccgcgcgcacgcgagcgcccggctcttcgccgcggcggcgcaggaacgtgtcgatgtaggcgggatcatagccgcggatctggtcgccggtgaacaccacaagatccggatcggcttcgcggatggcctcgcggatgaggcggatggtgtcgggcaacacatcggggccgtcctgtacgtcggccatttgcagcacgcggaagctgccgtcttcgcggaatcgcaagctcgtcatagctcttcagtctatgttgccgggcggcggatcgcccgcgcgttcacaggactggcacagcaagggacggggcagggcggggtgccgcagccgtgttgttgcttgatggtgccgcgattttgtcatgcagcgtcggtggagatccagacagcgtccctatgctgacgttctgagaccattggcgtcgttactgattcatagaatggcccggcgccgacgctcaaagaggctagcgtcggcggtgggccaatatttgtcgcgttgccgatggttgtgggcctcgtagcgtcggtagtgtgccatagcctggcaatttgccgacgataagctttcccagagtcggtatttcgccataagttggtccgctgacgacgctgagccgtttggctgtcggtgcagtaccaatatttggcccgccgccgacgtatggagggccatctggtggggtatcgcaggcggggtgttgtgccggagtcaaagcgtggcccggcgccgacgctgagtgccctcatgtcagccaggtgcataagcaaatgccacgatacggcatttcccgcgggtttgcccgaaccggcctgtaggatgttacgtgcgtattgacaaatccgcgtggcccggcgccgccctggcacaacgccgcagtcgcgtccgcaagagggcccgcgcaataaccagtaaaggaggaacaatgggtcagggtcaatcatccgtttttgatctcgcggcagtggctgcggcgtccaatggggggaacaacgacccgctgctgcctccggcgcgattcatcggcgatccgcagaagccgagtcgtatgccgtacaacaagtacaccgcctacgacaagcagatcccgtttgattacccggagcgtacgtggccgggcaagcgactgcagcgcgcgccgcgctggtgctccgtcgatcttcgcgacggcaatcaggccctcgtcaacccgatggattccgagcgcaagctgcgtttctggaacctgctcgtctccatgggattcaaggagatcgaggtgggcttcccgtccgcttccgagaccgatttcgacttcatccgtatgctcatcgagcgtgagctgattccggacgacgtgaccatcgtggtactcacccagtgccgcgagcacctcatccgccgcacttacgaggcgctcaagggtgccaagcgcgccatcgtgcacttctacaactccgtgtctgtgttgcagcgcgaggtcgtgttccgcaagaacaaggaggagatcaagaagctcgccaccgacgccgccgaactgtgcaaggacctcgagaacgaggccaagggcatcgacctgtactacgagtactcgccggaatccttcaccggcaccgagccggagtacgccgtcgaggtgtgcaacgccgtgatcggtgttatcaagccgactcccgagcacccgatgatcatcaacctgcccgccaccgtggaaatgaccacgccgaacgtgttcgccgacgaagtggagtacgtctccacccacctcgacgaccgtgactccgtggtgctctccctccacccgcacaacgacgaaggcatgggcgtggccgccaccgagctggccgtgctggccggcgccgaccgcgtggaaggctgcctgctgggcaacggcgagcgtaccggcaacgtcgacttggtcacgctgggcctcaactggctcacccaaggcatcgacccgcagcttgacctgtccaacgtgcccgagattcgcaagacggttgagtactgcaaccagatcaagatttccgagcgtcacccgtacgccggcaacttcgtgttcactgcgttctccggctcgcatcaggacgccatcaagaagggtctcgaggctcgtcaggtggccgccgagcgtgctggcgccgatctcgacagcttcgtgtggcttgtgccgtacctgccgatcgacccgaaggacatcggccgtacgtacgaagccatcattcgcgtcaactcgcagtccggcaagggcggcatggcctacctgctcaagaccaaccacaatcttgacctgcccaagcgtctgcagatcgaattcgacaagatcgtgcagaactacgctgacacgaccaagaaggaagtcaaggacgaggatatctggcgtctgttcaaggacgagtacctgccggtcgaacagtccggcatgaccgccgccggtgtggttgtgggcgatactcatgacgcctcgctcgtgccgtggggccgcttgaagctgctcaaggtggccgtcagctccggtgaggatggctccgacaccgtgctcaaggctcgtctgctcgaccgcggcgtgaacgtcggggtcgatgcgcccgtggagcgcgaggtctccggcatcggcaacggtccgatcgccgctttcctcaacgccatttccaactttggcgttgacgcctcgattatggattacgcggagcacaccatgtccgtcggcaccgacgccatggccgcctcgtacgtggaatgccaggtcggcgaggccgatgacgcgcagatcgtgtggggcgtcggcatcgattcgtcgattaccactagcgccctgaagtcgattatctccgccatcaaccgttcccagcgcaagcgctgagcgctaacagaacaaaaacaaggctccctctgattgcatcagagggagccttgttgtctgtgttttacttactactgagtgacgccgttggtgctggtgttcccgccggtgcctccggaattaccattatcgttgccggtattgttcccgttgtcaccgccggtattgttgccggcgttgccatctccgccggtagtggtgccgggataattcgggcactcggtggaatagctcggattggcgaggcactgctgggcgaactcctgagcctgctgttgcttcttggcttcctcttcggccgccttctgctgtgcgtcctgctcagcctgcttctgcgcgtcttcggtggactgcttgttggtgttgttggacaggccgctgctctgtcccttgcccaagccccaagtgccgtcggagccgccgatcttgccgttgtctttagcggtcgggaactgctccgcctcggtgccttgcaaggcctgagccatgaactcctggaacaggtgggcggggtatccagtggaagagacgccgtatccggagaaggctggcaccacttgcggattgcccttatcgtccggattccagatagcccacacattcatcatgctgggggtgtaccccacgaacgacgaagccatttcgtcgttggcggtaccggacttgccggcgacgggccggcccaacatgctggatgtgccggccgccgtaccgtacgtggtggtgccctgcatggccttctgtaccaaagcgcagtcgttggcatcgaacaccttggtgccgttgctgggcgcgttgtacatgtccttattgttggaatcaagcactttggacaccatgtgcaaggtgttcttcacgccattgttggcgatggtcgaatggccttgcgccaaatcccacacggtcagggcgttgatgcccagcacgttgtacatggagttttcatcgatatcgccctgaatgcccgcttcatgggcgattgcggccgtgcgcttcggcgtcagatgctcattgacgttcatgaacaccgtgttcaccgagttggcggtggcctgatacagattgatgttgccccagttgttctccagagcgttgttcacctcttgatccaagccggtgaagtgctggtgggaattgccgttgaacaacgtatcgaagctgacgccggattgcgcggcccccagcaaagcgaacggcttcatagtcgaacccggttcgaatacggcctgatcggcattgttgagctgcttggacagataatctgaaccggcgtatacggacaatacttcaccggtcttcgggtccagcgctatgccgccgatttgcagggattcaggcatgtcgtccagacgggtgtcgccgatggactgcataagatcctgcttgctcttgtcgatggtggtgatgatcttgtatccgccagtatccaaatcctctttggtaaaggccttggactgcaccagctcgcggcgcaccatatccagcagataaccgttcggccccgcgtattcgttctgctgcgccaccgcggcggtctgcgggaacttggcatcagtgtgctgcttggcagtgatgtaaccatcctcctgcatgatgttcagcacacgcttgaagcgcgatttggccatatcggcgttatcggccggatcccacgtggacggtgacggaataatgccggcgatcatcgccgcctcagacagcgtcagatccttggcgtccttattgaagtatgccttggccgctgcctggataccgtaggagttgcggcccagatagatggtgttcatgtaattgcacagcacctcgtccttggattcggtctgcgcgattttgatggccatgatggcctcgcgcgccttgcccacataggatgtggtttcgcccatgtaataccgctcggcatactgctgagtgatggtggaaccaccttggcgcgtgcccttggtcacattattaatgaatgcgcgggcgatgcccttcagatcaaggcctttatccgtgtagaacgtacggttttcggacgccacaatcgcgttgccgatgtagtccggcagcccctcgcaagagatgatttcacgattctgttccgcgtaggagccgatcgcggtggtgccgtccgcgtaatacacggtggttttctcggccaacgcgaacttttcgggttgcgggacctcggtggtggtgtacaggtatgcgaatactgcgataccggccagcaagcccagtccaatcagggagaagaagatgcccagcacccatttcagtacacggtgcttgccttttcctgtgttctttttcttcctgttcggggctcgatggctattggaagccttgtggcttgcgtggcgggaacggctctcctggggcgtataggggccctcctgtgcggagtggccggctctgctttgcgcggtgcgcggttgcctcagagcggggccattgcctcccgaatgtgcacgacgagtataagaagccatggtgtccaccgtaactgttggccttgaacaatcgtttgacgtgagcgtaaccacacgcatttatgccggtattttttccggaattcttacaattgggcacgcttcttgatgttgcatgaatattgcctgaatgcgctggttggtctgccgtgcgacccggcgcgcacgtttcgtgtcgctgcgctggtccatacgtctccatagacttatccccagcctccacgcggcgctatgtcacccaactcccccagggcaggaatgcagcaagggtaagtggcctctgacgggtgtgtggaggttttctttatgtgcggatttggctgtgagctggcactagcgtggtcccctgtccggggcgcggccgtacagtcgaacgtatgaatgacgcacagacccctagaattcgcgacccgcatgcggcggtcaatctggtcggctcaggcgcagcgcagcctgactcgtcgtcgaacgttgttgacccattggctgcgctcggcccggtctccggttcagatgcatcggcatccacatcaggctccttacgggatttcaggccgctggacatggacgatgcggatggggcatctgatatcgaccgtggcttggcccggcttgacccgcttaccgtgcgcccgcgaatctccagccgcgtactgtgcgtggtattcggtctgctcctgatcgctatcggcttcggcgtgtggtgggggtgcgtgtttaccgaaaacggacaatcgtacgacgaactggtctggaaaaacctgcacaacgatgtaccgtcctgggccaccggcgtgatgaacgccgtcgcacaatcctggctggttatcgctgtcagctgcacaattgccgcaatcggcattattacggcgctgattcgacgccgctggtggttggccgggcaaatcgccgtgttcgccgtggtctgcttggccgtcacccgtatcaagggtctgttgccgcgtccgttcatcatcaacactgaatctcctgccgctaattccgcgccttccggtcacacgatgctggccgcagcctgtgcggtgattctgctgcttaccgtgcctcgtgcggttcgagctttggcgggcgtcatcggcgtggtttgggcggtgaccgtcggtgtctccgtgatatacggacaatggcatcgcccttcggatgtggcgatgtccatcctgctggtggcgggattggccctgctcgctctggcagttacgcgcaagtccggcatggacgagccgggtcgccgcgtctcctcagtgagcgtgcaaatcgtcggcagcgtgctgattaccggggggctgctgttgctcgcctacagcggttatgtgatctggcaggtggtgccggggctcaatgtcagcgccagctgggcggttcagggggcgaatgtcagcgctgttgtgggcattgcgggtgtggccatgctcgcattcggactgttgctggccctgcgtcagattactgcagcgcccttaagccggctgggtctgatcggcgctccgccggcaccgcccaaacggtaaaacatggggtgcgaacggccgaatttgcccggcacaacggcggaatttggcagttggacatgattcatgagtattatgacgccagaaacgtcgtgtgtttcgcgcaatacataaggagtgggtatggctaccaaactggtgattgtggagtctccgaccaaggcccacaagatcggtgactacctgggcaaggggtacaccgtcatggcgtcggtcggccatatccgagacctcgcgcagcccagccaggtgcccgcggcagacaaggccaagttcggcaagttcggcgtggacgtcaacgacgggttcaagccgtattacattgtcgacggcgacaagaagcgtacggtcagcgaactcaaatcggccctgaagaacgccgatgaactctatctggcgactgatgaggatcgcgagggcgaggccatcgcgtggcacttggtgcagaccttgaaacccgaggtgccggtcaagcgcatggtgttccacgagatcaccaagaacgccatcaacgcctccctgaacaacacgcgcgatgtggatggcaatatggtcgacgcacaggagacccgccgcatcctcgaccgtctgtacggctatgagctgtcgccggtgctgtggcgcaaggtgggcccaggcctgtccgccggccgcgtgcagtccgtggccacccgcctgatcgtggaacgcgagcgcgaacgcatggcgttcaagcgcgcaccgtactgggatatcgtcgccacgctgtccgcgcctgacgcgctgggggagcgtgccgaattctccgcccgcatgatcgcgctcggcggcaagcgactcgccggctccaaggatttcggtgccgacggccagctgaccccggacgggttcgcggcgaacgttcgccagcttgatgaggctggtgccaccgccgtggcttcggcgctgaagaccgccgatttcactgtgatgtcgatggaaaccaagccgtaccgccgccgcccgcagccgccgttcaccacctcgaccctgcagcagaccgccggcaatcgcctcggcatgggtgctcgcgccgtgatgcgcgcggcccaaagcctgtacgagaacggctacatcacctatatgcgaaccgattcggtgacgctgtcgcaggagggcatcaccgccgcccgcaacgccgtctcctaccatttcggcgacaagttcctctccgccgagcccaagcagtacgccaccaaaaccgctggcgcgcaggaagcccacgagtgtattcgcccggcgggctcgcgcttccacgacccggacgagctggcttccaaacttcccggcgaccagctgcgcctatacacgctgatctggcagcgcacgcttgcctgccagatggctgacgccaccggttccaccgccaccgtgcgcctgtctgcgccggccggccccaccgagggcgaggccgtgttccaggcgtccggcaccgtcatcgaattccccggctttatgaaggccacgggggaggggcgcaagcccaaggccgccgctcccggcgctggggctggctcggaccaggctgctgccgccggcaagacggacgccaaggccgtcaggggtgacgcctccgaatccaacacctccctgccgccgatgagcgtcggccagcaggtcgaggcaagcgacatcgaaccggacggccatgaaacccagccgccggcccgctacaccgaggccacgctggtcaagacgctggaagccaaggagatcggtcgcccgtccacttacgcgagcattatctccacaatcatggatcgcggttacgtatacgagcgtggccgtgcgctgatccccagctggctcgccttctccgtgaccaagttgctcgagacgaacttccccaagctggtcgactaccagttcaccgccgagatggaaaacggccttgaccgcatcgcccacggcgaggaatccggccgcgactggctcacccacttctacttcggttccggcgagggcgctgcccgcaacgccgacgaggcgcacgaaggcctgcaacagcaggtcgcgcagctcggcgagatcgacgcgcgcgccatcaacaccatcgacatcggcgacggcctgcacgtgcgcgtcggccgttacggcccgtatctggaagacatggagcatctggacgccgaaggcaacccgaagcgtgcgtctctgccggacaccatcgcgccggatgagctgacggtggccgtggcccgcgatttgatcgacaaccactccggtggaccgcgcgagctgggcgttgatccggtatccggcggtaccgtcgaggtgcgcaatgggcgtttcggcccgtatgtggcgttggtgccgccggctgaggcttcggctggcgctgctggcgatactgctggtgcttctgcggccaagaagggttcgaagaaggccgcggccgccgccgcgtcgcgcccgaagatggcctcgttgttcaagacgatgagccctgaatcgctgtcgctggaagacgcgctaaagctgctgagcctgccgcgcgaagtgggcacatacgaggaaaccaacgccgaaaccggcgaggtatccgaatgcacggtggccgccaacaacggtcgctacggcccctacctgaccaagacgggtgccgacggcaagtcggagacccgctcgctggcctcggaagacgagatcttcacggtcgatatcgacaaggccaaagaactgttctcgcagcccaagtacggccgcgggcgtggccgtggtgccgccaagccgccgctgcgtgatttgggcaaggacccgaacaccggcaagaacgtgaccatcaaggacggccgtttcggcgcgtacatcaccgatggcgagaccaaccgtacggtgccgcgtcagtacacgcctgaatccatcacccctgatgacgccttccgactgctcgccgaaaagcgtgcggctggtccctccacccgtggccgtcgcggtgctgggcgtgctggtggcgccaaggccgttgccggcaagggcaagaagggcggtacctcggctgcggtttcggcgcaggaggccaagcgcgccgaacgccgtgccgaagtcaagaagttggcgaacaagggctggtccaaccagcgcatcgccgaaaaactcggttccacccccgccactgtgaaaaaggacgtcgactggctgaccgccaacgaggactacgagcgccccgccgtaattcccaagcgtggctgagcggaattattgctctacttgcgtttcaaggggctgatttctcgttttgagaatatctacttccgcttcaaggggctggtcatctgctgaaccacgagtatgaacggctccgcgccaacgtcattccgccgttttggaacgttgtctacttgggcaacagcccctcgaaacggaagtagaccttcagaaaagaccaaatcagccccttgaaacggaggtagagctggtttaactgcctgttgggcgcaactctgcgcctaacgctaaggtcaatagcatgaacggtctgtttgtttcgtttgaaggtgtcgatggcgtgggcaagaccacgcaagtcgagcggctgcgtgcgtatcttgaggctcaggggcgtaccgtggtcgttacccgtgagccgggaggcactgcgttaggcaaggccattcgccaactgctgttgcacggtgtggatgggggcgccgtcgacatcgcaccgcgcgccgaggcgctgctattcgctgcagaccgagcccagcacgttgccgaaaccatccgcccggcattggagcgcggtgaagtggtgatcaccgaccgctatttagactcttccttggcctatcaggccggtggccgcgaactcacgccagaagagattcgatccttaagcatgtgggccaccaacaacctgctgcccgaccgcacgtatttgctggatatggacccagccctgtcccaccatcgcctcgaacacgcggaagaccgtatggaatcggccggtgatgacttccagtcccgcacccgccaggccttcttggacttggccgccgccgagccgaatcgtttccgcgttatcgatgcgagccagagcattgaagcggtatgggctgccatcgaatccgacatcaaggagctcgcatgagcgtatgggattcactagtcggccaaaagccggtaatcgacatgctcagtcgtatcgcgcagggcgacccgagccagatcacccagtcgtggctgatctgtggacctcccggatcgggccgttccaacatggctcgtgcgtttgcggcggcgctggaaagcccggatcacggcatgagcgctgagcccacgcgcgtcacccagcaggtgcttgccggcacgcatccggatgtcacggtgctgaccacgaacaaggtgactattggtatcgatcaggtgcgtgagatcatcactacctccgagcagatgcccgccaccgcaccgtggcgcatcatcatcatcgaagacgtggatcgcatgcttgagcgcaccaccaacgtgctcttgaaagagattgaggagccggccgagcattgcatctggctactgtgcgcgcccagcgcccaggacgtgctgcccaccatccgctcgcgcacacgcatcgtgaacctcgccgtgccctccacccaggcggtggccggattcctgacctccaccaccaatgtcgagccaaaagtggcgcagcgtgcggcccgactcgccgaaggccatatcggcatcgccaagttgtacgccaccgacgaacgggttatgtccgaccgcgatgaacttgtggtcggtgtgctgaatctggcccgtgcctcggatgcagtgttgttggccggcaatcttatcgacaatgccaaggcccaggccgaggcggacgcgaaccgcatcaccgccggtcaggaagcggaattccgccgcatcaacggactggcaccgagcgaccgcatcccgccgaaactgcgtggcgcattcaaccagattgccaagaaagacgatgtgaagcgtttggtcacccgccgtacgcgcgacgtattggatcgtgcgctgaactccatcgcctccatctaccgagatgtggcggtgctgcagaacaatgcggaggattcggtgggcctcatcaacctggagaaccgctcgtcgatcaccgaattgtcggtgcggttgaaccgggccggtgccgtgacccgtctggacgaagtggcccacgcccgcaagcgcctagccggcaacggcaacccgctactggtattcgagtccctcttctgcgccctgatcccataacccgacgcaactagcccccctctgatgagtgggggctgtcgagcgtagcgagactgggggagagaccccgtaacgcacagcccccagtacgtcacacatatgagcgatactgggacgtatgaagatttccgccgatttcaccgtcatcccggacgatttcgccaaggccgcggcccctgaatatttcaatggtggcgtgccggtcgtctccttcccgttctacatcgatgatgtgaaccccgaggcccgctacctgcactgggagttcgtggacccggattcgattccggtctgcggcttcgagtggattcactggtccgtggccaatctgccgattgatgcgctgatgtacgacttcaatgattcgcatgcgttggccatcccgccggacttctcccgtcagctgccggccatgattcccgagaccgtgcaggggcgcaactcctcggcctccaagttcttgggccgcagcactgacccggcggtgatcatgcggtacaacggtccgcagccgccggacaaggatcatgagtactacctgcaggtgtgggccaccaagaagccgttgcccggcttgaatcagggcttctggctcaacgagctgttgcacgcgctgcgcaacagcggtgaagtgcccgacaccgacggcatcttcctgaccggcaaggcgtgagccacatgagcccccgcaggcgggggctgtcagcatcactgactgggggtgggtcagtacaaaaccaccttcagtccgacttcgtcgtccagctcccgccagtgggagcgtgactacaacaaagaaaggacaccatcacactatggcctgcaccacgattctggtaggcaaagacgcgagctatgacggctcgaccatcatcgcccgcaacgaggattccgcgaacggcgagttcaacccgaagcgcttcatcgtcgtgaagccggaggaacagccgcgcgaatacaagtcggtgatctcccacctgaccatcaccctgccggacgacccgctgcagtacaccgccgtgccgaacgcggacctcaaggaaggtatttggggcgaggccggcgtcaacgaggcgaacgtggcgatgagcgccaccgaaaccctgaccaccaacgagcgcgtgctcggcgccgacccgttcgtggaatacacgccggccaagggcgatgagcccgaggtgcccggcggcatcggcgaagaggacttcctgaccatcgtgctgccgtatgtcaagaccgcacgcgagggcgtccagcgcctcggcgcgctgcttgaggaattcggcacctacgagatgaacggcgtcgccttctccgactccaacgaaatctggtggctggaaactgtgggcggccatcactggattgccaagcgagtgccggacgaggcctacgtgaccatgccgaaccagctcggtatcgacgaattcgaccttgaggacgccctgggtgaccaggaagcacacatgtgttccgaagaccttgccgaattcatcgaaaccaaccatttggacctcgcggtggagaacactaccccgttcaacccgcgcgatgccttcggctcccactccgactccgaccacgtgtacaacaccccgcgcgcctggtacatgcagcgcttcctcaacccgtacgacgaggtgtgggacggcccggacgccgaccacaaacccacctccgacgacatcccgtgggcccgtcagcctgagcgcaaggtgaccatcgaggatatcaagtacgtgctgagctcccactaccagggcaccccgttcgatccgtacggccagctgggcgatgagcgcacccgccacatgtaccgcacgatcggcatcaaccgccagagccagctcgcggtgatgcagatccgcccgtaccgcccgcaggcctcccgcgccatccagtggatggcatacggctccaacccgttcaacacgctggtaccgttcttcccgaacgtggacaccacgcccgcctaccttgaggacaccaccacccgcgtgacgtccgagaacttctactgggccaaccgcatcatcgccgccctgtgcgatggcgccttccgctccacgtccaacgccgttgagcgctaccaggagaagaccggtgcgatgggccaccgcttggtcgccgccaccgacgagcagatcgcccgtctgggcttgacggccgccgaggaagccgcgcagtccgccgctgaagaggaatttgaggccgacaacgtggatggcgatgtgcagccgatgaccccggacgagaccatcgccgcgctgcgtaaccccgaggtgcgcgagattctcgccgccgccaaccagaccatggccgaccagctcaaggaggaaaccgaaaagctgcttgactccgtgctgtacactcgcagcatggaaatgaagaacggcttccacatgtccgacttttagtccgtattgagctcccctccctgaggggctgagccgtttagaaaacagcccagtgggctgtttttaggcgaagaggcggcgactgccgccccaccaccccgccccatcacacaaacacagaaaggctttatatgaccaccatcgaagacttcaccagccagtacggtctggtccagaagatcgacgcattcggctacatgaagtacctggccgagaaccctgacgccccgcgcaagcacggcaaggtggtgctcgtcaccgccgatacgccgctcaaggcatcgcgcggagaaggcaagaccaccacgaccatcgccctgatcgacgccctgaacaagcgcggcattgatgcgaccgccgtgctgcgtcagccgagcatgggcatcaccgcagccggttccaagggcggtgcctccggcggcggcaaggcttccctgacccaccccgagctcatcgactggggtctgtgcggcgaaatgggcgccatcgaggcggcccagaacctgctcgtctccttcgccgagaaggccatcgatgacggcaagctcgacacgattctcgtgccgcgtgtctccgaggtgccgagccgctccctgcgctccaccgccgtggactacggcaagggcaacgtgccggagaaggtcgtgctcacgccgacctgcgagctcatgcagattgtggtgctctcccgctcgatggacgagatttccgagcgcgtgtccaagatgatcgccggcaccaaggacggcaaggccgtgaccttcggcgaattcgtggacctgtggcgtatcactggcattctggccgacgcggtcaagccggccaagaccgagaccgtaaacggctccccggtctacgtgcacggtggcccgttcgccaacgtgtccatcggcattccgacgctggtctccgtggaaatggcctgcgccctgcatgacgtggtcatcgtcgaggccggttacggcaccgacgccggcgcccagaagtggctggacatcgcctgccgcgaatacggcgcgcagtggccgtccgccgccatcgtggtgacccgtgcctccacctggcgcgacgatcccgagctggcctggcgctacccgttccacgtgcagcgcctggagaacctggacattccgaccttcccgctcatcaacctgtgggaaggcgaggacgatcaggttccgtccctgaaggccaccgccgacgagctgggcttccgcacgccgatcatcggcaacctgttccgcgacggcggcgaggcgctggccccgcagcttgacggtttcgtcgacgcgttgcagaacggctccatgccggccgaaccgcactcgcacaagggcatggccctgaccgagaacgccaagtgggtggccgagaacgcctacggcgtaccggccgagcgcgtgatttacaagccgggcttcaccgagtccgtgtccgaggccatggaactgtgccagagcgcaggcatctcgctggacgatctggcgttcgtggcggtcaagtccccggcgaccatgaccgacaacgaccgtgcccccgaagaagagcgcaccgtgaccctgaagaaggttgaggtgcatgccggtgccggtctggtccacgtcaacctgaccaccagcctcaccacccccatgcccaagatcgtgtgatgacaggcatgaggtgaggtaactcgcttttgaggggcggattttcggttttccggaggtctatctgcgtttcgaggggctcttcgattgcgaaatccggagtatgaccattgaaattgcaatgtttatactccggttttcttgttttaaaagccccttgaaacgctagtagagcttctgaatgttggaaatcagccccttgaaacgtagaaagcccgccaccggcgggctttctacatctgagcttccctctttgaggggagctgtcagcgaagctgactgaggggagccagcatacgcaaactagaagttgctaccctgagccgttaaacggaaagcccaccgggctttccgtaggcgatgcgagcagctatgctgcgaggggaatggtggcaactagaagttgccaccattccagccccagtcggtggtggcggtgtaacggatgtaggtgcggtcctcgggaataccgagcgtggagttcagcgcggccataatgctctcggtcagcttttcccaagcagagcccggcacagagcggccgaacacgttgacttccacataggcggcgggctggtcatcgctaccaccgaagtaaatcggcatattgtcctcgaacgggcacattagccagccctcggacttgcccggcacggcggtaatcgccttgccataggcagccttcaacgcctcgcgctgctcaggggtggtgggcacggacacatgagtgtgaataacgggcataattcctccttgattcggttcgcttccagtctagcctcagcggttgctgttgaacatggcatgcggatgtaggaagctgcttgcagaacggaccggggcaaggccaatttggggagattattggcctttccagccaatatatgttccgcagtcagcccaatagtgttgaatacccttgtgagaaaactgattgaacaactgatgaagttcggcattgtgggcgtcatcgcctttgttatcgactggggtattctcaacctattggttggcatattccacatgcacaacgtgctggctgccaccgtctctttcatcatctcgctgattttcaactatctggcgagcatgaaattcgtattcaagcatcgtgatgacatggcgcgctggatggagattcttatcttcgtggcgggcgctgtagtcggtctgttcatgaatgacgcgattatctggatttccacttatggcatgaaccatgatgcctatgtatcgcagcatgccgaatatctgttgcgcaccaatatcggcaagttggtggccactgccgtggtaatgatctggaacttcttgattcgcaagtggctgctcgacgatacgcacaccaatgcgatgaaccgtctgaagtccgctgaaaatcgactgaatgccgaggagcttgaagccaagtggcagaacagcttctcccacaagctcggcatctggtccctggaacacacgcccaaaggctggccgaagtagcgttttgacgtataagccccctcgtcagagggggcttagcttttgtctcacacactcacttcagtcaaggtcggctgctcggtggagcccttgatctgcttgaagccaatcagcgcaatcaccagcgagaccagtgccaaagtggtcaccaccatgaagccgccatgcgagcccatgcggtcgatgaactggccggcaatcgccgaaccggcggaggagccgatagaattcatcgcacccatccacgccatgccttcggtcaggcgggaaggcggcaccaagtgcagcatgagctggttgccgttaatccacgtcggagcctggcacacgccgatgatcaggtagatgatcataatcacccacagatgcttggcgaacaggaacgtgctgatgccgatgttcaccacggccaggcagaagtagaagcgcttccacagggcaatcgaccagttcttcgcgccgtacaccaaggcgcccatcaacgagctgatggagaagcaggcgaatacaaagcccgtgtactgcttcatattcgactcggtggcgaatgcgatgatcgagatgcctgtagccgactggaacgcgcccaagccgaaccaggtgacgcataccgcaatcagacccggtccccagatggacgccttcttgccggaacgcgcatcggcgaccgcctgctcaatggcggcgttaatcgtggcctcatcggtcacgccttcgcgctcaagacggcggcgagtctcctcggctgcggtctccaccttcaacgcttcggctcgagccgcctcgcgctcacggtattccttgcgggaaatgccctcagcgcgggccagctgagtctgtgacggtggctcagtggtcagctcggtcaagaacatcagcgcgcccaccaccacgcacatgccggtgaacgagaatgccagcagaccggagatcacggccagtgtggaagccagtggattgccgattacccacatgcattcgtccagcacgccgcacagggagagcgcacggttggtacgctcctgatcgcccttcaggattttggtccagcgcgcgcggctcatcgcgccccacggcggaatagctgccaggaacggcgtcaaacagtacagcacccattccggcgcacgattggtgatggatgtggtcagcgcgacggcggcgacaatccacaccagaatcgttggaatcgaaacctgccgctggccgaacttgtcggtcagcttgccgagcagcggcgtggccacggccagtgcaatcgcctgaatggcggtgagcatacctgccagcgagtagttgccgtagtaatgctgcacggaaatggtgatggtcatgcccaccatcgggaacggcatgcaggcaatcaccgaaccgatggaataacgagcggtatgaggtatgcgcagcaactccgcatacccaccaaaaactttgtgacccacttccttgatgccagccataatggtgttcgagttggacaggttgttggacataacagcactacgctcctttccgctcccgattggatgttccccgctgacgtggcgttgccggcgaagccctcatcgaatgatgtgttgtccatggtcgcgcaaagtttgcgttggatttccctattcgcatatttgcgtcacggatactctaatcgttggttagggcgcgacacgcggtagattggagatattaagacaacgttctcatgttcttcggcgaacatcgcaagatgcccgtaggaataaaaagaaaggcggctcatgagcgcaaccaccatccacttcgttcgccacggcaaggtctacaaccctgaccatctgctctatgagcggctgcccgacttccatctctccgatcttggccggcgtatggcacaggccaccgccgcctatctggccaatagccctcagaccaatacgatttccgcggtgtattcgtctcccctggaccgcacgcgcgagaccgccgacgcgattcttgacgcgttgaatcccgtgcgcgaggcccgaggcgaagccccgctcatgctcaccgccgatgagcgagtgattgaggccggcaacgagttccgcggcaagcgtatcggccatggcgaaggcgcgctgtggaagaacggcaattggaaactggtcaccaacctgtacaagccgagttggggcgaatcctatcagcacattgcgcagcgcatggatgatttcgcacgcgagaaggtcgcccaacaccccggcgaacagattgtggtggtcagccacgaatcgccgattttcagttatcgccattatctggagaccggccaccccgagcactggatgttcctgcggcacacggcgctcgcctccgtgacctcggtgacgtacgacaacgaaaccggccgtgtgatgtcaatcacgtatgtcgacccagcagccaacgtcaagtaacggcacactggtgaatagctgagctacaatctgggctcccctcagagggagccaatgggacgcactacaatcaagtggtgaacgcagaggagcatgaatgaccattgaactcaatcgtgaggcaatcgcacggatcgcggcattgccgggggtagctgaggccgctgaagccggctcggcgctaattagcctgtggccgctgaccgaagccatgcagatggacaatgacgccaagtatgcggagaacctgcaggtgcgtgtcacgcacgcgttcgcacgcattctcaccggtcaggatgttacgatgcctgacgccgaattcgtctacgagggggccgatgagattcctggccgtccgcaaagcatcgtagacacgctgcttgctgccaatgacgcctacgatacgatggccggttactcggaatccggcgatgtgcagctgattttcgatgccgccgaagctttaggtgttgactgggattcgcatgtcgaggccgcagtccgtgagacggttgtctccgtggaggctcaggttgaggccgatgccgaggctggcggacgtttggcggcttccggcgagccggctgatgtggccgtccgtttcgccaccgcgctcgccgtatgcgatgcgctgctgaacgtggtgagcgggcatgccgagacggttggcttggttggtccggctgttgctgatgccgctgatgttgctgacgaggcccgggccaccgccatcgtaacgttgccgattctgctgtacgtcaacgaattacgtgagcagtgctcgattccgcgcatctgcctgaccgaccagcagattcttgatctgattgatacgcgtgccaatgccggtgacaccctgaccgccaccgccgaatacattgccccgctggccggtgccgaatggaccaagcaccgcgacgatgtgctctggaacccggacgaagccaagaagaaggccaaggaagaagacgaaaagcgcaacaaggaggccttggccgccaagtttgcgcacattaaagatgaccctggcaaagaaaccgtggagttgtgagaatcaaggcagcttagcccgcctgatcggttctcttacccctgctcgcgattcctccgtgccaaggaaatcgtctatgtggtgaagaacatcgcttacgcaacggaagaagaaacacttatgggcaatggcgtcaatctgcgcacgctcaccaatgacggcggtagcgcggtaatcagcgattacggggcgcatctgctgcgctgggccccggcggggcagccggatgtaatctggacgccccgcacatggcatttcgaagctggtcagccggttggcgggggagtgccggtgtgcttcccctggttcgggccggggtttgtgcatggcgggcagactgcgaagcgaccgattcatgggttcgcacgattgcgccagtgggcgctggacgaaggggcgtttaccggtgcccgtgtgcggtatgtgctggattccgaacgactgacgactggcgaagtgccatggatcgaggatgaacccaacgtgcgtttccatgccgcatacgaggtgtgtgccagcgatacgctgacgatgacgctgaccgttaccaacacgggaggtgagccgatgtcgtatgaggcggcgctgcactcgtatctgcatgtcggcgatgtgctcggcgcgcggctggtcggtttgcggggtgcaacatatctggatgccacggaagccggattcccgccaaaactacaagaacagccatcggtgatgttcggcgatcagccggtggaccgtgtgtattattccgatgctgcactggaattgcaggaccatgtgctgggtcgtgtgattcgcatcggcaagaccggctcgccgcagacggtggtgtggaatcccggagagcagggcggcaacgccattgcccatgccaagacgggtgaatggcgtggctttgtggccgtggaggcagcggcgtgccgagaccgtatcgttgcccttagtccgggtgaatcgtatatgctttcgcagtccattgccgtgatgccgttggggtagttggctgaatacagtgccgagaatacagtgccgagaatgatgaagccctactcgcgttgagtagggcttcatcattggttgcggggaacttcttcaacggaagttcaccgatatcggttactggccttgccggggtttctgggcattgtcgccggcgggagccgtgtgctcagaaggtgttgcggattcgtcgccggcgttttgaggcatcggcggaacctggccgtactgtggggccggtacctgaccgtaatcaggtgcgggtgcagccggctggccatagtcgggggtcggcatggccggctggacgtaagccagggccggctggttgaagccgggtgcgggcgcgttcggagcggcgaaattcgggggtacaggcgtgctgtatggtgcgccgtaagcaccctgaggcatgggggttgccgccgcgccatcgtcaaaacgtgcgccctccggcttgctgggaagagccatgaacacgatatagacaacgcagccggccagcgtaatcaacgcaccaatgaccgccgcgccaagaccgccggcggccatgctgccataaccatagtcataactgccaaggctcctgaacccgccgtacagtgccgcaccaccgccgataatcatgatgataaggccgataaccatcgcgatatagaaaatggcaacccaccagccaggcttgttcgtgtcatgcagacggcggacggaaagtgccagggtggggattagggtcaccagaccccaaatggtggcgaggaagccaagcttttcatctgtggcggtgttgaggatgtccagcactatattgatgccgaaagcggccagcacccaccaccagaattcactgcgggacgcgcggcccttgaacaccgtgtacttcttccagaagcgcaggaaggcttcttggaaggagcatccgtagtaaggcttatccagcggcacagtggcagtgggcgcggcgtattggccgtaagacggcggaaccgggccgtaaggattgccatcgggggccggtgtgccgtacgccggtgcggattgaccgtaggtgttggcgtcgggcgcgggctgaccgtaggttggtacggcctggccataagagttcgcggtcggagcaggctgaccgtatgccggctgtccgtaagcgggctgcgccggctgtgagggctgcgccggggccggtgcgccatactgcggtacgggattaggtgtgggcgtaccgttggcctcaggctgctgaggcaaaggcacattgttgggatcagacattgattcccctttcataagacctatgtgtcacatcatattcttccattgcatgagtggaaaactcaacaattgcgccaaataatgtccaaagttgtggtgaatgcactggaaagaatcgatggttatcaaatcgatatcagttgagggtgaacgttatcgatcggttgtgtaacctgttgcatgaatattgcgcacagttgcggggcggaactggaaagcagacgaagcttttggcgctatgcataaagcaacatacagagatgtagggaatgccatgaaccacgaatacacggatgccgccgttgagcagcgcgaatcgcacgaagacgaatctcaagactgggatctgctgttcgtgggcctggcctgctgattctcgtttgctgttttcttttcttttgattttgcttttaaaagaaaagcaaatggcaggcaaaagagatttcgttggaaaatggccgttttgggatggtgttggcccgaaacatcaataacgaagcaaaagagcgaggagcgctgctctccgcgtccggcgcgcgcggcacaataggggattatgactgatgctgaaaacaccaaacccgaactgcccaagaacgttcgtgttcgcttctgcccgtcgccgaccggaaccccgcatgtcggcatgattcgtaccgccctgttcaactgggcggaagctcgcgccaccggcggcacgctgatcttccgtatcgaagacaccgacgccgtgcgcgactccgaagaaagctacaaccagatcctcgaatccctgcgttggctgggtatcgactgggacgagggcatcgatgtgggtggccctcacggcccgtaccgccagtccgagcgtaccgccatctacaaggatgttgccgccaagctgctcgaagccggctacgcctacgagtccttctccactcctgaggaaatcaaggagcgcaaccttgccgccggccgtccggccgagttcggctacgatggctacgaccgcaacctgaccgatgaacagaaggccgccttccgcgccgagggccgcaagcctgcgctacgtatcaagatgcctgatgaagacatcgcctttgacgatctgattcgtggcaccatcgagttcaaggccggctccgtgccggactacgtgatcgtgcgcccgaacggcgacccactgtacacgctgaccaacccggtcgacgacgcgatgatggaagtcaacgtcgtgctgcgcggcgaggacctcctgagctccaccccgcgccagatcgtgctttaccgttaccttatggaactcggcatcgccaaggagatgccgctgttcggccacatgccgtacgtgatgggccagggcaacaagaagctctccaagcgcgacccagagtccaacctgttcaaccaccgcgacaatggcttcatccgcgagggcctgctcaactacctggccctgctcggctggtccattgcaccggaccgcgacgtgttctccatggacgagatgaccgagaagttcgacgtgcgcgacgtcaaggccaacccggcccgcttcgacatcgacaaggccatctccatcaacgccgagcacatccgtatgcttgagcccgaggacttcctgcgccgctcggtgccgtacctgcaccgcgacggtgtggtttccgccgacaactgggatgccctgaccgaccgtgagcgtgaggtgctgaccgccgccgctccgctggttcagccgcgcgtgcgcctgctgggtgaggttgccggcatggtcggctccctgctctccaccgagggctacttggagccggctgacgacgccaagaagcagctgaaggattctgccggcgaggtgctggacaaggccatcgccgcactcgaggctgtggatgaggctgactggaagaccgacaacctgcatgagaccctgaacaaggctctggttgaggagggcggctacaagccgcgcctcgctttcggtccggtgcgtgtggccatgtctggtcgtcgcgtgagcccgccgctgttcgagtccatggagatcgtcggcaagccggtttccctcgctcgcctgaagggcctgcgcgagcacctgtgagctaaggttccttccgtgctcggctgagctgtaaggacactcaaggtgggcgtctgcatgtgcagatgcccaccttttcttgtattcagtgatgagctggaacagctggaaagtcttaccgctgcgccgcatgccagtgagaatatgtacgaggttgaacatggctggtttgtgcagtgaggtcacgaaacgtgccttgtaggtggtttcgccttcatgcgtccatgaaacggttgataggtaaccgggcggcggtctttgacgtgacattgcattacaagcatcgcgacgcgctcgctgtcgcaagggaacataagcgcctcatttggttcttgaaggctgatttgccggctatgaatgtgcaaggcaaagatcattgcctcatctgcaatttcatcagtgcattagatggtaattcatcagtagtgcttactgataatccgtcagtagagttcatgcaaattcatcagtagtggcagcgtagcacttgaaatcgttgaaattccgcgcgacacgccgtaagttgcgtaagggtgaatacttgcgtatatttatcactcgttgcgcggttcaccgagcagccggttgaaaaactgaatatgcccccatcgtctagcggtctaggactacgccctctcacggcgccaacaccggttcaaatccggttgggggtacgacgaacaactccttggagttgctacgccaagccaaattgggatgtggtgtaattggcaacacagctgattctggttcagccattcttggttcgagtccaggcatcccagccaatgaccctcgcggaatgcgagggttttttgttttcagggaagtagccgcttgaaaagcgacttccctgcatatgagtgcgcataagagcgctaagagcgcatacgtgtgtatgaaagtacgagaacgaaggagatcgaagtatgtccgctgggcagcaggctgtaccggcaaacaacgccaacaatgcaagcaatgaaggcgctcagaagaagcacatgtctaaggcggccgtcgccattatcgccgtggtggtcgtggccattatcgtcgtggccggtgtgttcggcttccgcgcctactccgatgctcagtacaacaatgcagtcgccgcttgcgccgccgcttccgaaaatgtgcgcaacgccactaatgactacaacaacttggtcaatggcgatgcttccgaagctgctgcgctcaccaagaaggatgtaaaggatgcctccacgctggacgccctcaacaaggaactgagcgtggaactgccggtatacgaaggctgcgtagctgacgacactgccggcttcaagtccgctactgcgaagctcaacgagcaggctgattggtacaaggcttatactcaatcgctgcagaaggctgtggatgccgtgaacgcttccaagaagtaagcgagcacagcctcaccattgtcgtcaaagccgtcttgcggttgcgcaaggcggcttttgctattttgctcaatcggcttgctgctgtaatgctgctgcattgattgcgtcgaatgcaggtaaattcgtcttactttttttgcgcagtttttccctgcgcgtgtcgcgatgatgcgaatatagatgtgaaggttaacaacgtagtcgtttattgggttttgtgatttcactcacgttgtaattcaatgtcaaatatgtggcgattctccgtatttgctgagattgctattaagaatagcttcttgtaaagtgtcttatcgtaattgcgaatgcgtattcttcaatgaagaaggcatctgcttcacctcgaagaagagattaaggaaaatatagttaatgaaaaagaagaagactatatcggctgcgctggcaacagcgttagccttaacctgcatgggcagcgggggaggtactgcgttcgcagtgcccctgtctgatgctgacttgcagactttggcaagtcagattcagcaaatcaacgatacttctgattctgcaactgcttccgagactccttccgcacaagccgatgcggttgaaggctggactattgattccaacatcgctcagggcggcgaaatcctggagatggcaaacggttggctgcacctcaagtccactgcctctaacggtaatgcggcagcgaaccccagctccagcaacaactggccggcagtagccgtatggggcacagattacgacttctccaaggccggctccttccacgccaccatcaaatccccgcaggaaggctccgccaaccgcttcggcttctacctgggctacaacgacccgggcagcggcctgttcatcggctacgattcgggcggctggttctggcagacctacaccggtggcggtagcggcagctggtacagcggtgctcgtatcgctgctccgagcgccaacgaagagcacgacattcgggtctcctggaccgacgccaaggtcgccacactgaccgtggatggccagaaggcattcgatgtcgattactccgcaatgacgaacctctccaacaagcttgccatcaaggccggctcctggaaggagctgaacgaggtcaccgacgtgtacatcaaggacttcccggaggttgtcgaagccgccaagcacgcggtttccggcaaggttgtggacgctggaggcgctgccattgaaggcgcaacagtgcgtttggataagaccaaggtgaagaccggtgcagatggcaccttctccttcgccgacattgaagaaggcgaacacacgctttcgattgccaaggaaggctatgaggacgtctcccagcaggtgacggtctccggcgcggatcttgccatcgatcccatcaccctgaacaaaaccgttcaggtcgcctccgaaacgctgaagaccgagaagatggaagttcagattaagaagaacttcccctctgtgctgcagtacacgatgaccgacggcaaggtgatgtacggccagtccaaggatgtgcgcaccgttgaaatcaacggcaccaacatcgaactgggcgatgacgacgtgaccttcaagaaggtttccgacaccgaggccacctacacgctgaaggtcaaggatgaggccaagaagattgacgcggtgatcaccgttcagatcacggtcaaggccaaccagctgcacctcaacgtcaccaagatcaagaacaacctgtccgaaggcattcctgagggcaacggtgtggaggagaacgccatccagacgctgtccttcccgaaccagagtctcgtttccgtgcgttccagccaggaaaatgcccaattcactggtgctcgtatgtcttccaacacgcagaagcctggcgataccaacttcgcagtgaccgaagatactaacgtcaccgatagcgactacacctacggcttcatctccggtgctggcctgagtgccggcctgtggagcaactccgagcacgatggcacctatgtggcggctcctgtgcgcggcggcagccagaacacgcgtgtctacgccaccacccagcagactggtgacgccacctccctgggcctggccagcgctccgtggtactaccaccgcacggtcaccgattccaagggcaagaagtacaccgtggccgaaaccgctctgccgcagatggccgtggccatcgccggcgacgagaacgaagacggtgccgtcaactggcaggatggcgcaatcgcctaccgcgacatcatgaacaacccgtacaagtccgaggaagttcccgaactggtggcatggcgtatcgccatgaacttcggctcccaggcgcagaacccgttcctcaccacgcttgacaacgtcaagaaggtggccttgaacaccgacggcctcggccagtccgtgctgctcaagggctacggcaatgaaggccacgactccggccacccggactacggcgatatcggccagcgtctcggcggcgccgacgacatgaacaccatgatggaagagggctccaagtatggcgctcgcttcggtgtgcacgtcaacgcctccgaaatgtatccggaagccaaggccttcagcgaggacatggtgcgccgcaactctgcaggcggcctgagctacggctggaactggcttgatcagggtgtcggcatcgacggcatctacgatctggcatccggttctcgtgtaagccgtttcgctgacctcagcaaggaagtcggcgacaacatggacttcatctacctcgatgtgtggggcaacctgacttcttccggttcggaagattcttgggaaacccgcaagatgagcaagatgatcaacgacaacggctggcgtatgaccaccgaatggggttccggcaacgagtacgactccaccttccagcactgggcagctgatctgacctacggcggctacacctccaagggcgagaactccgaagtgatgcgcttcctgcgcaaccaccagaaggacagctgggttggcgactacccgcaatacggcggcgctgccaacgccccgctgctcggcggctacaacatgaaggacttcgaaggctggcagggccgcaacgactatgccgcctacatcaagaacctgtacacccatgatgtgtccactaagttcatccagcacttcaaggtgacccgctgggtcaacaacccgctgctgaccgccgacaatggcaatgccgctgccgtgtccgacccgaacacgaacaacggcaacgagcagattaccctgaaggattccaacggcaacgttgtagtagtctcccgtggttccaacgacacctctagcgcagcctaccgccagcgcaccatcaccttcaacggcgtgatggtggcttccggtgctgtctccgcaggcgatggttcctccactggtgacgagtcctacctgctgccgtggctgtgggattcctccaccggcaagctggtcaaggattccgaacagaagctctaccactggaataccaagggtggcaccaccacttggaccctgccggacagctggaagaacctctccagtgtgaaggtgtaccagctcaccgatcagggtaagaccaacgagcagaccgttgccgtctccggcggcaaggtgacgctcaccgctgatgccgaaaccccgtacgtggtgtacaagggcgaagccaagcagatccaggtcaactggagcgaaggcatgcatgtggtagacgccggcttcaacggcggctccaacaccctcaccgacaactggaccgtcagcggctccggcaaggccgaagttgaaggcgacaacaacgccatgctgcgcctgaccggcaaggtcgatgtctcccagcgtctgaccgatctcaaggctggccagaagtacgcgctgtatgttggcgtcgacaaccgctccaccggcgatgcatccgtcaccgtaaccagcggcggcaaggtgctggccaccaactccaccggcaagtccatcgccaagaactacatcaaggcatacggccacaacacgaacagcaatacggaaaatggctccagctacttccagaacatgtacgtgttcttcaccgcgcctgagaacggcgatgccacggtaaccctgtctcacaagagcaccgacggagcacacacctacttcgacgatgtgcgcatcgtggagaaccagtactccggcatcacctatgagaaggacggcacgctgaagtccctcaccaacggattcgaaaacaacgcccagggcatctggccgttcgtggtctccggttccgaaggcgttgaggacaaccgcatccacctctccgagctgcatgctccgttcacgcaggccggttgggatgtcaagaagatggacgatgtgctcgatggcacttggtctgtgaaggttaacggcctgacccagaagggcacgctggtctaccagacgatcccgcagaacgtgaagttcgaggcgggtgccaagtacaaggtgagcttcgactaccagtccggttccgatgacatctacgccatcgctgtgggccagggtgaatactctgccggcagcgtgaagctgaccaacctgaagaaggctctgggtgagaccggcaaggccgagttcgagctgaccggtggcgtcaacggcgattcctggttcggtatttactcgaccgcaaccgcacctgatctgcagggttccaccggcaatgcacaggacttcggcggatacaaggacttcgtgctcgacaacctgaagatcgagcgcatcgagtcccagacccgcaccaaggccgaagcgcaggacaaggtcaaggaaatccgcggcaagtacgattccaagcgtgctgagctctccgatgccgcatggcagcagtatcaggacaccttggtcaaggctcgcgtgctcatcaacaagaatggcgcaaccgctgaggacttcaccaaggcatacgacattctcgtggccctcgacgagtacatgaagaccgctcccggcaacgagagcagcgacaagtacgacgtggcagctgacggctccgatgagctgggtggctacaccgtggccacgggcagcgaagagcctaccgcaggcctgccgagcgaaggcccggccggtctggcacaggatggcaacgacagcacccactggcacaccagctggagcaagaacgcagtcggcaacggcaccgcatggtatcagttcaacctcaacaaaccgaccaccatcaacggcctgcgctacctgccgcgttccggaggtatgaacgccaacggcaagatcaagggctacaagatcacgctcactctggcggatggcaccaccaaggatgtcgtcaccgatgctgagttctccaccaccaccatgtggcagaaggccagcttcgacgccgtcgagaatgtgaccgccgtacgcttgaccgtcctgtcttccgcaggccagagcgactcccaggccaacaagttcgcatccgctgccgaactgcgtttgaccacggaccgcgaggttgaggaagagactgtcgctccggacaagaccgacctcaacgacaccatcgccaaggctaacggtcttaaggaatccgactacacggctgaaagctggactgctctggtcaaggcccgcgaagctgcacaggccgtggcggataacgataaggccaccgcttacgatgtggctctggcgctgacgaacctcgaatccgctatcgctggtctcgagaagaccggtgaggagcctggcccaggcccggttgaggtgaacaagaccgacctgcagactgcagtgaacaaggcaagcaagctcgagaaggccgattacacgaccaactcgtgggaagctttcgccgaggcactgaaggctgcacagcaggtgctcgacaacaagaacgccacccagcaggatgtggataccgcactgagcgctcttcaggacgccatctccaagctggaagctaccgccgagccgaagccgaatccggaaccgggcgtggtggacaaggctgctctgaacgcgaccatcaacaaggccgccgccatcaacctgggtctctacaccgacgactccgccaacgctctgcgcgccgcgctgaagaaggcccgtgaggtctccgacaacagcaacgccacgcagaagcaggtcgacgcagctcgtgaggctctcgagaaggcaattgccggcttggtgaagcgtaccgctgccaagggtgatggcaatgtcgtctccaacacgggtgccaatgtcgtcacgattgctgtggccggattgctgctggccggtgccggcgccgcaatcgcctaccgccgcaatcgcgagcagatgtgatcatgaaaccgtaaggttcgcgaccacataaggagcactccttattatctcggccggtgccggtcagcaatgcccagcgccggccgtttttgtatgaatcagtgttttccggtcacccagcgggcatcggaatgcacatgggggatcatcatcacaatgaccgcaatcagacagacgatcatcaccatcaaaataacgtcctcatgaccgcgcgtctgcagcgtggctccagtcaaagcaccgagcgccaaagccagcattacaatcgcgcgccggccaagtttggactgctcatgaccatgcgccgaagtgtcagcgataatcccagttaacgtcatcgtcaacacagtcgtgggcaaatctggcaccgaaagcttacgagcagtggaattctgaatgcccatagccggtgcgagcagcacaatcagcagaataatatgcaaatcaatatgccgagcagttgggaagttcagactgggctgtgccgtgcgggcgatggctgaagcatcagtgccacccatcgacggttcaggcgcaaactgattgagcagataaatgccgacgagcgcagctgccacaaaagccagctggattgacgtggacaccagcagatggcgcgcgcggttggcgccaaagtaatgaataatgcgtccgccgatgaacgcaccaatcatgaacgtggccagcgtgagcgccgaagtccaccagacgaagccctgcgcgtgggcgaatgcaaaaccaaggaacacaatgttgccggtcacattggccacaaatacatgaccgagtgccaagtaacttaacgcatccaccagtccggcgacaaacgtgagaataaccagagctggggaaagcagaccgtaccgatcatccttgcggggaatcagtgtgcgtcctgcttcggcaaggtgtgaggtcatggtgggagaggctttcctttgctgtttggcggtattcaatagctggcgcgcggccttgcacattatgaagtgtgtgccggacggtatatgtcaatgagtctgcgctcgcatgcggagtgcgtgcaacagttcgctatgagttcacctgcgattcgctgaacgcgcatagttcggtaacgcgatttcgctatatctggtcgtaataccgatgaggctaggaaaaggaatgattatgcagtcagataacagccatcatgaagcacatcagaacgacctgaactacagcagtgagtaccagtacgatatgtatatgtatgccgagtacggcatcgagtggtgattgagagccccgagtgagaattggactcacgacctcttccttaccaaggaagtgctctaccactgagctatcggggcgataatgtgcgcacggcttagggccgttgaacggcttgcacaacaatacgcgcaatcgcgtattacgcaaatcgacgggtgtacgaggaagtattcgggtgctctaagttgtacacatgagcgcaatattggctattttgcgctcatgtggcattcggatgtgccacgtaatcgcattttcgtgtttttatgcgctgttgtggcacgaaaattgtgggaattcggtcgtctcggaatatgtgccatgccacgccactgcaaaaacagtgaatgtgcacgattgtgcacatatttggaccgctgcgtatatgcatgtgggtgcggataacaaaagggttttgacaaaaaccaaaaccctgatggcggaggatacgagattcgaactcgtgaggctgttacaccaacacgctttccaagcgtgcgccatagaccactaggcgaatcctccatgcactgcagtgcttgctagaagtaagctccgtaggcaactcgaataagctaccacagctttcggataaatgcacattcagtgccggctgcggcgtgtcgctttgtggacaaggaccaccaatgagtgcctgcgctgatgtgcaggtcgttcgtacggcgtgtgcaacaggtgatctcaccgggggatgaaccagtgcaaataaaagcgactcaaggcaagtcagcaaacccgaggcaaaccagaatgaatatgcgcatgccatcgcgtgaattattgccagcctcttgccgtgatgcaacatagtgattttaggctatgaaccttggtgaaacagttggtcatgcaatatgagggatggggagtggccagtcgcggggagttcataattcgggaagtctcccatctgtgagcgggacaatatcgaatattgagacaatctgcggtaataattgatcgaaaaacagtgcctaatacctcttaaatcctaaaaaatcaagactgttcctcaaaaaagtttttctttatattgagtagttggtttttgattacttagccgcgcagagagagggataggcatggttcgtcgcgcccaggctgctcttcggtccgttgaacacaccagcgtgaggcagctgcgagttctggctgcgattgtatttctgttcgccatggtcatcgccactgtggctcctgcagtcacggctccgatggccttcgccgacagcagcaccagctcgtccagttcatcaagctcgtccagcgttgactacgccacctgggccgaagtctccaaggcgatggacaagcagctgaacagcggtcttaagacgtacaaggatggcaacaccgctggcgccacctccgatttcatgggcgcgtacaacaagatttacgtggcctccaacttcaccgcggtcgtgcacgacaccattggcgcggacaagcagctcgcccaacagcaggcattccaaagcgttcagaatctttcctacacgcctagcaacgacgatcaactggctcagcagattgatgcgttgaccgccgatcttgacgccacggcccagcagctcgacgccaacgccgatctcgccaagccgaaggcgtacgccgaagcgctgcaggcgcagctggccaaagagcgcaaggagctcgacgccaagaaaaagaagaacccgggcaagggcaatcgttcatggaccgacgtggccaacgaaatgaccccgattctcgacaatgcatacaaagcttacgaaaagggtgatggtgccaagggcgccacgctcgtgaacaacgcgtactaccagtattacgagaagctcggcttcgaaaagaacgtgatgaacgccatcagcggcaaccgcgtctcgcaggtggaataccagttcaagatgtgccgcaagtccatgaacgccggcgcatccctgaaagacaccaagaagctgatcgacgacctcaaggccatgctgatcaaggacgccggcattcttgacggtggtgccgccgataaggaagacggtttcaccaagctggtcaccagctcctccggccaggcgttcctcgtgcttatccgtgagggtcttgaagctctgctggtggttgcagccatcgtcgcctacttggtcaagtccgataacaagcgcttcgtcaagtggatttacttgggtgtgctcgtcggtctgctcggcgccggcttggtggctgtgatcttcgtgttcgccttcggcggctccggcccgattcaggagatcatggaaggcacctgcgcactgatcgccatgggcatgctgctgtggacgagtaactggatgctgaacaagtccagcgtggaagcgtggaaccgttacattcgcaagaagaccgaggctgctgtggctgatgccgaagccgccgcaagtgccgacaacgtgacgttgaaaaccgtggtctcgctggctatgctgagcttcctcgccgtgttccgtgaaggcgctgaaaccgtgatcttctacgagtccatctacacgatgagccgcgatactcgcggtatgtggatcggtggtctgaccgccgcagtggtgcttgtcggcatcttcctgctcttccgcttcacctccgtgaagattccgattggtccgttcttcctggtcacttcgattctgatgtctgtgctggtggtggtgttcgccggcggcggcgtccactcgctgatcgagggcgacttgctgcccgccttctacctgaacggtgtgccgacgaacgattggcttggcctctacccgtacgtcgaatgcctagtggcgcaggccatcgcagccgttgcggttatcgcgctgttcgtggtcggcttcatcaagcagcgcaagctgaaggcgcaggctactgccgaggtcccggccgtgaaggcgtagcccgtctagctcgtccgtttcctcccataactgcagacaactgacagacttgcggcacggcctcggatcgatgccaattcctccagcccacgccgcacttatctcataactgaataattgcaattatctaagcgtgaatcctaattcaccagagatagagaaaaggaataacaatgatgaagaacaagaaactggccgctctgctcggcctgctgctcgccggttccatgaccgtgtccatggctgcctgcggttccaccaactccgcatccgacactaaggctgactcctcctcccagtcttccgactcctcttcctccgattcttcctccgattccggcgccggtttcgaagaggttccggttggcccgtccggtactgctgaagagcaggatcaggacgccggcccgctgaccgtgggcgctgtgtacttccagccgatcgatatggagccgtcttccatgggcctgaaggctgctgacgcttccttccacctcgaggccgacatccatgccaaccagaagggcaccgagctcggctacggcaagggcgacttcgtgccggatctgaccgtgaactacaccatcatcgataagtccaccggcaaggaagtcgagggcggcaccgccacctccggtaccttcatgcagatgaacgcttccgatggcccgcactacggcgccaacgtcaagctcgacaaggctggcacctaccagctgaagctctccatcgaatccccggcctccaagggttggatgctgcacgttgacccggagaccggcgtcaagggccacttctggaccgagccgatcgaggtcaccttcgacaactgggattacactcctcgccagtggtgattgactaagcagaaagccccctcgtcagagggggctttacgccgctttagggagataattcttaggacggtctaaaactcccctcagtccgcttcgcggacagctcccctcagagaggggagcctaaggtgaacagagaaaggacgcgaatgcttgaacaattcgtggcagtgatgccgggcactttgccccccgcattgctggtgatgagcctgagcgtgatgctcacggtcggcgaggggcgagataagccgataagctcgcattggcgtctcatcggcctgatcgtcggtctgatcgccgccatcgtattcgccggcctgcgcgcctcggccgtgatcaatcagcgcacgttcgtcaactacccggtgttgtggtgcgcgatcattgccgacatcctgaccatcgtcgtggtggtgttcgcacgccgcatcaccaccaattggcagcagcacaaggtgttcatgcacatcgctaacgccgtggccgccatcgacatcgcactcaccctgttctacgcgctgccggacgtgattctgcagctcaccatctgggtggaaccaggggagaccgcattcacttcggccatgctgctgcgcgctcttggtttcctgcttggcgtggccatgtccattattgtggccgccatcttccgcacgatgcgcaccactgccgtgcgctgggcgttcaccgtggccgtcgcggccatgatggtgattctgctgattcaacacttcactggtcttgcccagattctgcaggcgcgaggcttcccgatgaaccatacgatgttcgtggcgctggcttggtccatcaaccagaactccacgatgattatggcgcaggcgctggtgttcctgattcccgccgtggcctccatcgtggccggtttccgtatgaaaacccatgatgtgccgggagccaacgaggccacgttgcgccggcataaggtattccgccgccacgccatcgccgctgccgtgtggagccttatcgcagccatcggcgtcacagcaaccctgaccgtgggcgttgccgcgacccatcagaccatcaccctttcgccgccggaagcctactcgctcaaggacggcgtggccaccatccccttcagccaggtcgaggacggccacctgcaccgcttcgaatacaaggccaaggacggcaccgtcatgcgcttcatcatcatccgaaagaacggtggcgcgtacggcatcggcctggacgcctgcgagaactgcggcgacgctggctactacgagaaggacggcaagatcatctgcaagaagtgcgaggtggccatcaacctggcgaccatcggcttcaagggtggctgcaacccgataccattcccgtacaagaccggccacggcaagatcaccattcaaactacggatctggacgcgctgagcgcccacttccggtgagtcaggcaggagacaagaatcatgttctttctgtgcatgattactcgctcgttcacccgacagctgcgccggcgcctgcttatcgcgctgaccgtatgcctgtcggcgaccgtgtccgtatcgatgctgggcgtcgtgttcgacgtgggcgacaagctcaacgccgagctgtccacctacggttcgaacatcaccgtgcagcccaaggcggatgcggtcgtttccgacctgtacaacaccgagtcgggcggcgcgacgtccaccagcgacccgaccgcttttctgaaggagtcggacgcggccaagatcaagacgatcttctggtcgttcaacatcaccagcttcgcgccgcagctcaacatccacgccacggtgaacggtaccaacgtgccggtcgtcggcacgtggttcaacaagaacctcaagatctccaccggcgagactaccgtcgtgggcgtggaaggcatgcgctcgtggtggcagctggacggcaagtggcccaaagacgattccgaccagggcgtgatcggcaagacgctggcctccgaactcggcgtgaccaccggcgacaccatcaccctcaacaaaaccaccgcctcaggcaagaagaacgagcagaaaatcaagctcaccggtgtctacgattccggcgacgaggacaacggctcgctctacatcgcctcctccacggcccaggtactcgccgacctgcccgattcggtcgacaaaatcgaggtcaaggccctgaccacgccggagaacgacctggcccgtaaggccgccgcgaacccggccgcgctgagccaggaggaatgggagacctggtactgcaccgcctacccgagctcgatcgcctatcagatcgaagaggtgattccgggcgcggtggccaagcaggtgcgtcaggtggccgcgttgcagggcaatgtgctgcaaaagacgcaggccgtgatgattctgatgaccgtgctgagcctgatcgccgcagccgtggccgtggccaacctgatggtcgcctcgatcggcgaacggtcgggcgagctggcgttgctcaaggcgctcggtgccaccgatgccgcggtatcccgcctgatgctggccgaaacggcggcaatctcgctgctgggcgcgattgtgggcgcgctgctcggttccggcgtggcccagctgataggccgggtggtgttcggttccggcattacgatgcggccgatggtgttcgtgctggtgttcgtgctgctggctgtcaccgtgctgctggcgtccgcctcatcgattcgttcgattctgaatctcaagcccgcggaggtgctccatggtcgctgagtttatctacgtaggtgtggaaggagggaaccgatgaccaacaccggtatgttcttcagaatgctgttcagcgccgtgttccgtcggcgttcgcgcgcggtgatggctgtggtggcgtcgctggtcggcgcagccacactgttctgtctggcgatgatctgcctcgctgtgccgcagcagatgaacgaggagatgcgtgcgtacggcgcgaacctgattgtcacgcccaccgaatcgaccaatgctgacggcaaggccggcatcgacaaggcgatggtgcagcacaccactgaaatggtcaaggccaagggttccgcgaaatacgccacctaccgctacgagaacgtgcgcgtcaacgcctcgccgtacgttatggccggcgtgaatgcggcgcaggtcaagaacctcaaccatcactgggtggtcgacggctcgtggccgaccgacggcaaggtgctggtcggacgcgacatcgccgacgccatcggcctgagaatcggctccgccatcaccatcggctaccgtgcatccgataacgccagcaccaacggcacttcgtcgaactcctcgatcgaccagcaaaccaaagacggccgtgtctccagtgacatcatggacacctccggtaccgaattccgcgtggccggcatcgtggacaccggcggcagcgaagactcgatcatctacgccaccaacgccgacgtcaacaagctcaccggcatcacgcgcggcgtggacgtcatcgagtattcggccggcgccagcgacctcgcaggcctggtgtccagcatcaacgacatgacctccatgcacgtcaaggcacagcaggtcaccaagatcaccgcctccgacacccgcatcatcaccatgctgcagacgctgttctggatcgtctcgctggtggtgctggtgctgacgctcgtcggcgtcggcaccacaatcagctcgatcgtctcgcagcgacgcaacgagattggcctgcgcaaggccctcggtgctagctcgcgtgccatcggcaccgagttctacatcgaatcgtcgctctacggcctgattggcggcctcatcggcaccgcaatcggctacggactcgccagttggctgtgcgtggcggtgttcgaacgctccatcgtattcaactggtggctggccctgatttccgtgctgttcagcgcgctggtcgccatcgtcgcctccatcccgcccgtccaccgcgccacccgcatcgaccccgccgtcgtgcttcgcgaagaataaagaaagagaaacgtcatgctacttgaactcgaccacatctcgaagatctacggcgacctgcgtgccgtggacgacctcaatctgaccgtgccggaaggcgaatggctcgccatcgtcggctcctccggctcaggcaagaccacgctgatgaacatgattggctgcatggacacgccctccaagggctccgtgaagctggaaggccgcaagctggaggacctgaacgccacgcagctggccgacgtgcgcaagaacctcatcggactggtgttccagaagttctatctggtgccgcacctgaccgccgtggaaaacgtgatggtggcccagtactaccattcggtggtcgatgagaagcaggccatggaggcgctggaaaaggtcggcctgaaggaccgcgcccaccacctgcccggccagctctccggcggcgagcagcagcgcgtgtgcgtggcccgcgcgctgatcaacgacccgaagctgattctggccgatgagcccaccggcaacctcgacgagaagaacgagaaaatcgtgctcgacctgttccgcaagctgcacgagcagggcaccacgattatcgtggtcacccacgatgcgctggtcgccagctgcgcgcagcgcgagatcatgctcaaccatggcgtgctcgtcggtgagaagtggaatgacgaggatgcgcgcaaggcctacgaggcggccggcggcaagcccgcctccacgggtgcacaggtcgagggcgcgcagaacggcgagaccgccattggtttcactgaccccaccaaggccgcgaaaaccggcggcgaggagtagggccgtcaggggcatcgagcagtatgtgaggaatacatggcaagctgatggtctctcccccagtcagcttcgctgacagcccccctcgtcagaggggggcttaaggagcgtgaatatgaccgaaaagagtacgttgaagaaatccgcgacattggcggcggccggactggtcgtggctggcgcgctgctggccggatgcggcgaatccaaggccgcgccgatggacgatgcgtacgccggcaactcgggcgagaccgagaagtcgcaggaagagcagtcgcaatcccagtcgaacggctccgatagctccgacggctccgattccagctcgtcgcacaacgacccgtccaccaccacgtccgacaagaaggacaccggcaactacaaggacggcaactactcgatcaacggccagtacggcccggtaggcgaggattccatcgacgtccatctgaccatcaaggacggcaacgtcgagaccgtcaatatcattgggcacccgttcaccacgatttccaagaaccatcaggacgacttcgccaaagccattaacggcgtggtggacggcaaacctctgaagggtctcaaagtggacaaggtcgccggcgccagctggacctccgacgccttcaacaaagccctcgaagtcgcccgccaggaggcttcgattcaggagtaagaccgctacttcagcaatgctggccacagcagatcggccatgcgcgaggcccaggcggtgtcgtcgtccattgctttgccctcgatggcctcatacgccaccaaagatccgataatcgtggacaacagcaacttctcgtcaacgtcctcgcgaaacacgccctgcgcgactccctgcttgaggaacgcccccacacgctccagccacggggtcaccacttggtcgacgatgtgctggaagaactcggcctcgctggacaatacaatgcccacgcgcttgacgtcgatgtcgttgtcgcgcacccaatcgaccaatcgctgcaatagttgcgtgaaatgctcacgcgtggggctgggcactgggtcggaatccgggatggccagatacatcgcgctgatctcgtgcagcagctcgtcggcattatgatatcggcggtaaatcgtggttttggccacaccggagcgccgggccacctcctcgatggtcacgccgctgatgccgcggtccaccgcaatctgcagcgtggctcgcatgagcttgcgatccgtcgcctcgcgcgtgcgctcaccgcgcggtgtcgccgtcgtgtctgtcatctccgtcatctcttctcttcgaaatatgctcccgtacgctcccgctggcgagagctggctggcaaagccagactgagggtggtaagtccatgccgtttgtaggcaactcccggataatacctactagctcagcactttagtgctctcgacttgggctacataccactggttgaaccgcaccagtggcttcctgagcaacagcccaagcaacagtagcggcggcacgaatgccagcagcattccggcggcccgccagtaatccatgtcgtagatgccggcgatggccgcacgcatcatcgtcaccgcatgggtgagcggcaagagcggactgactttggcgatgaagtcgggcaacatctgcaccgggtaggcagcgttcgcacccgaaatctgcacgatgagcataagcacgccgattgccttacccacattgccgaaactcaccaccatcgtataggtgaagaacgagaacaccagcgaggccagccatccagacaacataaacagcagcggatgcacggcctgcacgcgcaggaacagcaaatcgccaccgagcgacaccgtggattgcagcagcgcaatcagcgcgaacaccccgtaatgcccaaggaagagccgatgcggccgcggatcgcccaatgctttgcgcgtccggcgagacacggtggttttcagcgtcaccaccatcagcagcgcgcccacccacagcggcagcagcgtgtagaacggtgccatcgacgaaccgaaattcgccaccgggaatacggccttgcgcctgagctgcaccggtgcggccaacgtactggccagcgtttcgggatcattgcccagcacctctttgaccatgcccatatcgccactgtttagtgcgtcgctcagtgtgctgttgaacgaagccagttcggcgccggcggaacgcagtttgccggacaccttgtccaaggtagtgcgagcgtcgctgagcatatcgctggcgtcgtcggaagtccctttcaggtcgccgagcgtggagtccaactgggtggcgccggaactcagtatgccggaggcgtcagcgacggtggacgacagggagtcgatttgcggtttcaccgtggccgagaaatctgacttgatattggcaatactgttctgcgcttgatcagccagattcttgacctgcgcatgctgatcctgcgcgtcctgattgccttggcgaatatcggtcgccgccgtattcagcgcttgccgcagcctgttttgtcgtgcgattgaacggtcaatcgccgtgatgatggatgagtcgttgcccagtatgccggccaacgtgttgcgaatttcagtgtatttctccgtctgcttgccaatggccgtggcttgacggtccaattcgtcggcgaccgtggtggcaccatcattcgcgtcggaatacagcttgtctatggaatcggacaccgcgccgaaactggaggcgctcgcgtccagtgcgctgctcatcgcgtcagcggtggtgcccagggctccggccacgtcggtgacttcctgtttggcgctggcaagatccttgccgccttgtttggcggcagaggaaacctgagtgattagtgagttcgaggtgtcgagcaaggcgccggccgtatcggtcaatgcgctgtatgtgccaagcagatccgcagtatcgtcaagctgtgtggcgaaattggcgatgttggcgttgaaggtattcagttgctctttggcctcgggcttggacagctgatcggccagcgaagacgcgatttccagcccggccgaagtgatggtcttagcgaacgtggtgttgatttccgccgcaacctcatccgtgccctcgttgagcagattcggtgccagcgcgttcttcttctcgttgcggtaataggtcagttcggcatgctgcacgtcgtcggagaagaaggtcatcatgtctttgctgaacgacttcggaattacgatggccgcgtagtatttgccggatcgtgcgccctcgacggcatcggctttggacgtgatcgtccaatcgagctgactgttggcgcgcagcgcgttcaccacctgatcgccgaccgtgactttcaccgggatcaggtcggaacgatacccctcatccacattcgccaccgcgaatttcaggttcttcatattcgagaacgggtcccagcatgcggccacgttgaaccaggtgaacaggccgggaatcatcaccaagccgatcacgatgatgatggagaccacgttgctggtcaggcgtttgatgtcgccggtaaacagtttccacatggtgttcatcgtgcgtgcctgccttccttggtcggcggaatagtggggatgattgcggtaacagcggcgctcgggtccgcttcttcgtggcgttcggcggaggtgtcgcgacgcttggccttatgcccgtacagcatggcgcggatcgactcgtcggagaggctgccgagctcggtttggcggcggatggaatcgcgcatgaattccacgaccatcaggaagcccatgatgatgagcacccatgccagccatgtgcccatgactacgattttctcgctggtggtcagcgcaaacacgataatgagcgcggccggcaccacgaatccggcaataagcgcacccagcagcagccggggataacggtaggcgaatttggcggcccgacgttcgatggcatgacggtattcgtcgtggtcggccagtgctgcaatggcctgagtgacacggtattcgctgccgggcagatgcaccggctcgccgataatcatgtcgctttccttgatttcccgcgcgaacaggcggttgagattggccagtttcggccgggcgccgaggccaagcgcaaaggccagaaccacgaaaaccagcaatttgccgatataggcgaaccagaggccgtcgtagaagccgccgatggtttcacgcatcgcgtcaatcgaataggtgaacggcagcagcgggtagatggcgcggaagaacgcgggcatcatttcaatcgggtacaggccggaggcgcccggcacctgcagaatgaccagcgccacgcatacgcctttgcccacgtgcatgaacgtggtggagagggcgaaaatcaccgacatatacaccagtgaggtgatgacgcaggtgagcagaaacactggggcgctcgcgcattgaatgccgatgacaagatcgccgatggccgtgaccaggccttggacggcagccagcgtggccagtagcaggaagcgaccgagatagccttgggttggtgtgagatcgtcgatgccctcatcatcggtttcgagtttgggaatgaccacgagcacgaacgcgcccacccacaaagacagggtggtgaacagcggtgccatgccggaaccataggaggcgaccggatagacggcctgttcgctgataacagtgggggagagcatgaagtcggcgattgtggcggcatccagtttgccgtcggtgccgatcagggaactgagtgaactggagatgctcagggctttgatgtcggtgaccagcgtatcgagcttggtttgtacgccggccagcgccttatcggtgtcgcgcagcgcggtcaccgtggtggaggctgctttgtcgagttggtcgagggtatgcttcgactgatcgatgagtgagccttgcgacgtgatgccggtcgacagagtgctggcggtcgagctgagggcgttgagaccggtgttgagctgaggaatggcgccggaggtgatggtgccgcgagcggtattggcctcgcgcaccgtggtttgggtggcggtattgagatgctgcgccaatccggcggtgtctgtggaggcattgccgatagtggtgttcaggctatcgaggttgcccagtgcgccggcaagctcgctattgcggctttccagtgtggcaatggcggattgcagcggttctcgattggcgttcggcagccctttgagttggtcgatgatgtcggcgttcgcttggttgatgtcttccgccgtattgatcagtccgcctacctgctgattggcggcgctgatggttccggttaccgtgcccacgctttggttggcctgtgctgcggcttggctcagcaggcttgagccttggtcaagcgcttcggacgtggaggtgacgaagccgttcagactggtctgggtagtgccgatcagggtggagacgccggccagaccttctgcagtgtcgatgccaagtgtgcgcgcgtcgtccagcgcctgacgtgcggtgcgtgtctgctctggggtgtcggtgagtttggtggtgagcttggcgatggtgctgcgtgtgtgctgcacatcgtcggaggccttggcaagggccgtgagggccttggctttggtggtgtcttcggtactgatggctttgccgtcaaccgtattgatgacttcggtaagtacttcggatacggtggagacgaatgtggaattgaccgtgcggtccacagtggacgcgccgacgtcggtgactttgggggcgatggcgctggctttttcgttgacgtaatactccagagtgggccgactcttgccgccggtcaccacgccggcgagatcgtcggaaaagtctttgggaatgatgatggctgcgtatgccttgccggattccacttggtccatggcctcggcttcggtgacgaaggtccagccgagctggtcgttgcttctcatctgcttgacgatttgatcgccgaggttctgcttgccgatgagcgcgttgtcggtgccgtcgtcattgttggcgatggcgacggtgatgcctttggtattgccgtacgggtcccagaagccgacgatgttgtaccacgaatacagtggcgggatgaacaccatgccgaacaggatcacccatgcggccggcaccttgaacaggcgcaggaagtcgcgtctgaggaccttgaagatattgcccactgatacctccggagcttggtgttgcttggttgctacgttttccgtagcgatacgttaatcgtagcgctacgtttgtagtagcgtaatacggctgccggagattaatggggtgattgatgatgtttttggcggaataacgctgctgcccagcggcttatcgtgtgtcgctgggcagagcgaaaggcgttctggaacttattgacaagatttctggatggtttttggacgtttcctgaacgcgatggataggctcggtgctcggcaatgtagacagacatgtaccgaccgcccatcaagttcagcaaaaccgcaatcgggtgatagggtgaggggacgctatgtggggaggaaaccatggttgaattcaaggacgatggcacggccactacccccggcaagctgcgggagaaccgtgacgccgagtccgcagtcgtggccgatctggtggccgtcgaactggacgacgccggcttgaacctgaacgccaagcgattaccgattctggcgcgcatctatggcgcggtcgtgctgctggacggactcgccacattgccgattatggtgatttccatcctctatgccgtgcgcgagattctggatggtcatgtgcacgtcgatgcgatgagcctgaccttcatcctgtccgcgattcatgcggtggtgctggtagtcagtgccgcatgcctgattgtgctcggcgtgatgctgctgcgcaatcatcgccggtatgccgcgcgctggacctacgtgctgatgccgttgacgttggccgacggcatgctgtcgctggccctgaccggccttggcttcaacctgctgctgccgctgattcagatgattattctcgtcgtgatttcggtgaccgccgatccctccctgagcgaggaacgccgtctgcggcgcgcgctcaggcgtatggacgatcgcgatgattatgaatcggctgtggcggccggcatgctaggccgcgaccagtccggcaagggctatattgcgctggactttttcaatatcttctggctgtttaccatcgcttcggtgggtggcctgattgtggagacgatctaccatatggcgctgtataacggtgaacttcaggaccgcgctggtttgctgtggggcccgttctcgccgatttacggctgtggtgcggtattggtaaccgtgtgcctgaatcgtctgtggaaggcgaatccgttcttgattttctgcgcttcggcggtgatcggcggcgcgttcgaatattgcaccagctggttcatggaagcggcgtttggtattaccgcgtgggattacaccggccgttggctgtccatcgacggacgtacttcgggccaattcatgttcttctggggactgattggtgtggtgtgggtcaagtggctgttaccgcgactgctggctctgattaatcgcattccatggaaagtgcggtattcgctgactgcgatatgcacggtgctgatggtgatcgacattgccttcacgctgatggccttggattgctggtatgggcgcatggccggccagccgcaggattcaccggtcgcgatgtggttcagcgaacgctacagcgacgcttacatggccaatcgcttccagaccatgcatatcgacccttccaaggccgggcgtatgtgaatggccggcaagtaattacgcttcgcgggcagaaggtgcgtagaacctaagacagccctcgcgtgtgggtggtaagcgggatacactttcaagcgttgaaggaatgattccctccgctgatgcgctgttttgtgacgcgcgtgatgacgatgggacaatcaaacgaaaggcaaggcacatggccgaagctacagcaaacattggtgtgattggactggccacgatgggctccaatctggcgcgtaatctggcgcaccatggcaacacggtggcgttgttcaaccgccactactcgcgtaccgagaagctcatgaacgagcatggcaccgaaggcaacttcgtgccggccgaaacgctcgaggaattcgccgcgtccctgaagcgtccgcgtaccgccatcatcatggtcaaggccggtgctccgaccgacgcgaccatcgcgcagctggaagaggtgttcgaaccgggcgacatcatcgtcgacggtggcaactccttcttcaaggacaccatcaagcgtgagaaggaagtacgtgccaagggcttccacttcgtgggttgcggcgtgtccggtggtgaggaaggcgcgctcaacggcccgtctctgatgcccggtggcactgcggaatcctggaagaccttgggcccgattcttcagtccatcgccgccaaggtgaacggcgaaccgtgcgtgacccacatcggcaccgatggtgccggccactttgtcaagatggtgcacaacggcatcgagtatgccgatatgcaggtgattggtgaggcgtatgacattctgcgccgtggactcggcatggatgccgaggagattggcgacgtgttcgctgaatggaacaagggcgaccttgactcctacctgatcgagatcaccgctgagattctgcaccacaaggatgccgagaccggcaagccgttcgtggacgtggtcgtggatcatgccggcatgaagggtactggtacgtggaccgtgcagactggtctggaatgtggttctcctgtggctgccatcggtgaagccgtgttcgctcgtgcactgtcttcgcacggtgagctgcgtgaagacgctcagaaggaaggtctggctggaccgaacaagaccatcgatctggccggagaagacaaggccgcgttcgtcgaggacgtgcgcaaggctctgttcgcttccaaggtcgtggcctatgctcagggcctgaacgagattcaggacggtgccaaggaatacggctgggatatcaacctgtccgaagtggcccgcatttggcgtggcggctgcattattcgcgcccagttcctgctcgaccgcatcaccgaggccttcaggggcgataacccgccggcttccctgctgttcgatccgtacttcgagaagatcatcggcgaatcgcaggatgcatggcgtcgcgtgatcgttcgcgcggtggaggccggcatcccgaccccggtgttctccagctccctggcgtactacgatggtctgcgctccaagcgcctgcctaccgctctgacccagtcccagcgtgacttcttcggtgcccacacctacggtcgcgtagacaagcctggcgtgttccacacgctgtgggctgaagaaggcaagcctgaaatcgaggcgtagcctcgtgatttcaggtttaggacagccctgtgggctgtccggccttcttcaggctcggcgatagccgagctgagaaaacagcaagtccgagattgaggcgtagccatagacgaattaagccccctcatcagagggggcttaattcactcacaactcggtgacggtttcttcggtggagaaccagatgaactcgtccactccgttggcgtaggaggacgggtaatccggtttgttgggctgctcgaagacatgggccagcgattcggctttgccggcaccggcggcgaagaaccacgtatggcgtgaacgcgcgatgagcggcgcggtcaatgaaacacgcagcggcggcatcttgggggagtggttcacacccacggtgagcctatcagtaaccttgacctcatcatgaccagggaacagcgacgcatagtgaccgtccggtcccatgccgagaatcatcagatcgattaccggttccggccccaattcattcaccaactcgcgctcatagtcgctcgcgacatcgtccagcaacgcatcattcgcggcatcggcggcggcgcgaacggaagcatcatcgctgtcggcctgatccatcacatcggcgatgtcatcggctgaacgggtatcggccgccatctcatgaatattcgactcaggcagcttgccatctgccaccagctggtcaagcagcaggcgacgggcctccaaagcattgcgatcggtgtcgtaagccggcacaaaacgttcgtcgctccaccagaaatgcacgcgcgaccaatcaatcgcgtcagccagcggatcgttcagcaccaagcccagcggctgcgcggccgaaccgccagacagcgccacatccacacgcgtgcgatgcgtgccatcaggcaatcgttcggcgagcaaatcgagtagcgccaagacaaaacgttgcgcgccagcctgaatcatcagatctttattcggatacacaatgagttttcgagttgccatgtatggtccttgtatggggtatgtgtcgtactttgcaatgtggattgtgttgtcagttgacaacacaatccacattgtgcgacatcgcatatgtcactttattactccgcgggcatgagcttcggcatcgcatgaggtaggaaacgatgagcaacggcgttggcatggctcggccacaattgccgaactcattccaacgccgctgtggcaacgggttctaccgacttcagtgacgaatcagatcccagccttcgttgatgacctcggcgtagatctcatcgggatcgatgcgacgcagttcctcggtcaggcagtcctcgatggtgcgcatcggcacggacacttcctgcggagtctggccgggcagcgagatcagcgcttggtcctcatacgggcgttccagcgagatcacaccgtcctcacgggtcaggtacacgccggtcacggcctgcgcgtcgggcacgaactcagtttcgactggtacgccgagtttcagacgcagccatgcgcacagcatttccataggcaggaagtcggccttgccggtcaccttcgcggcggtgatgggcaggtgcggcggctgatcgagcatcgaggcgagcattgcgcgccagacggtcagtcgtgtccaggacaagtcgatatcttccggtgtccaattgcggcgcaaacgctcaatcgtggcctccggattattggagtgcaacgcgtcggtgatgcgactgcgggccatcgcacccatcagatccttggccgggttcgacggcggtgtggtcggccaccacgccactacaggcgcatccggcacaagcagcgggataaccagcgtatccgggtggttgataaggccaccgcgcggacgcaagacgatgatctcaccggcaccggcgtccgcgccgaatcgcacttgggcgttcaggttggaatcgttcggatcgttcgggccgtcggtcaaatcgacggccggattatcgcgactcgcgctcacctcggcggccacttcggccgcgttcggttcgccttcgccggactgatcggcaggattggtatccggtactacggcaatcacgcggcacgggtgctcacggctggccgagttcgcgatttccagcgcatgctctaggtccgcgtcctcggtggcgatgagcagcgtcagcacgcggccggtcgccgattcgccgcgctcctcgtgcagctgttcgattttgtgcgcaatctcgcgggtgcgggtgttcggcatatcgatgatcatggcatcctccagtggcggccgtcgcgcgccagcatttcgtcggcctgtgccggaccccacgtaccggcgcggtaggcctgcggctggccaagcgtggaccagaattgttcaatcggatcgaggatctcccagctgaggttcacctcttcggtggtcgggaacaacggcggatcaccgagcagcacgtccagaatcagtcgctcataggcttccggcgagttctcggtgaaggagcggccgtagctgaagtccatgttcacgtcacggacctccatggtggagccgcccggcaccttggctccgaagcgcatggtgacgccctcgtcgggctgcacgcgaatcacgatggcgttcttgccgagttcgcgcacggcggtctgctcgaacggcagatgcggggcgcgcttgaacaccacggcgatttcggttacacgcttgccgaggcgcttgccgcaacgcaggtagaacggcacgccagcccagcggcgggtgtcgatatcgaggcggatggcggcgtacgtttcagtggtgctcttggggtcgatgcctttttcctccaagtagccgatcacttcgtgcgagccctgccagcccttggcgtactggccgcgcgcggtgttggcggcgaggtccttgggcaggcgcacggcggaaagcaccttggtcttttcggcggtcaggtccttggcggtgaagctcaccggctcctccatggcggtcagagccatgagctgaagcaggtggttctggatgacgtcgcgtgcggcgccgatgccgtcgtaatagccggcgcggccgccgatgccgatgtcctcggccatcgtgatctgcacgtggtccacatagttggcgttccagatcggctcgtacatggcgttggcgaaacgcagggccagcaggttctgcacggtttccttgccgaggtagtggtcgatgcggaacacggagctcgggtcgaacacttcggataccacgctgtcgagttccttggcgctggccagatcatggccgaacggcttctcgatgatcacgcggcgccatgcgccctcggacgagcgcgacaggccggaggcggccagctgcttggcgacctgtgggaatgcgcgcggcggcaccgacatgtagaaggcatggttaccctgcgtgccgcggtcgcggtcaagctcctgcacggtggcgctcagacgctcgaaggcctccgggtcgtcgaacgtaccctgcacgaagcggatgccggcggccagattgcgccaagtcgactccttgaacggcgtacggcaatgcgcctggacggcggccttgacgaattcgatgaaccgttcctgtgtccagtcgcggcgggcgaaaccggtcagaccgaagctcggcggcagtaggccacggttcgccaggtcgtagacggctggcagtagtttcttttgtgccagatcgcccgtgacaccgaaaatgacgaggctgcatgggccggcgatacggggcagtctgaggtcgcgcgagtcgcgcaggggattgctccaattgggggattcactcataatgtacaagggtagtcgccggcggctatctatcgctagaggcgatatgcgatttgggctgcgatttgggccacattgcgtgtgctgtgccgtgcgttgggccaatcgcgtacgcaaacgtgtacgcaacgccgtagttgaaatatcccaaaacggtgtgtattttagaagagttgcccctttagctcaacggttagagcagcgtccttttaagtcgtgggttgtgggttcgaatcccacagggggcacaacaaatcctcggaatcgcaatggttccaaggatttttttgtttcgaccagcctggctcctagagtggtgtcccatgtcatgcaccacgattcttgtcggcaaaaatgccagttacgacggttccaccatcatcgcccgcgatgacgattcgggctcgggccgttacgatcccaagcgcttcgtcgctgtcgcccccgacgaccagccgcgccactaccgcagcgtgctgagccatgtcgaaatcgaactaccggacaatccttgccggtacaccatcgcaccgaacgtgctgaataatcgtggcattctggccgaagccggtgccaacgaacacaacgtggcgatgagcgccaccgaaaccatcgctgtcaacgagcgcgtgctcggtgcggacccgatggtcgagttgcggccggctgtcggcgaaccggacagcaccgattatcaggccgagcagcccggcggtatcggtgaggaagacatcatcacccttgtgctgccgtatgtcaccaccgcgcgcgagggcgtcgcgcggttgggcgaactgctcgaaacctacggcacctacgaatcgaacggcgtgattatttcggatgtggacgagatctggtacgtcgagaccatcggcggccaccattggatcgcccgccgagtgcccgatgactgctatgccacgatccccaaccagctcggcatcgacgacttcgacctcgccgatgcgttcggcgagcagcgcgaatacctatgcagcgccgacctgcgcgagttcatggccacgcatcacctcgaccgcacaatgggaacgccggtctcttccaacggccgtcacgcgcatagcgccggattcggaacaaccgttgcccttcccacccgtttcaacccgcgcaaggccttcggcaccgcgacgccgaaggaccatatctacaacacgccgcgtgcctggtacatgcaacgccgcctcaaccccagcgaggactgggattcgccggccgcccgctacacgcccgaatccgacgacatcccgtggtgccgcgtgccggaagacaaggtgagcctcgaagacgttgatttcctgctgtcctcgcacttcgaaggtacgccgtacgacccgtacggcacgaccggcacggcggaatcgcgccaccgttaccgtccgatcggcgtgaaccgcaccggccatatggtggcgattcaggtccgtccgtatgtgccggcggccaatcgcacggtgatgtgggtatcgttcggctctggtccgttcaccgccgccgcgccgttctacgcgaacgtcaacgacacgcctgcctacctgcgcgacaccacgcccgaagtctccaccggcaacctgtattggacgaaccgcctgatcgccgtcgtggccgacgcacactggtatgagacgaaccggttcatcgaagggtatgccgagggcgtgcgcgcgttcggacaccggctcatcgagcgcacggatgagcagttgcttgctcgaagcgatgccgaatcgacggatacgaatgcatggccgctcgatggcggccacggcgatgagaaggatgtgcagggcgtggcggatgtgctcgaagcggccaacgacgagatggccgactacctgcgcgagcacacaaccaagctgctgaacgatgtgctatacacctccagcaacctgatgcacaacagcttcgcgatgtccgaccgttgggccgagtagcaaaacctcgactggggaggtaatagggatgccctgctgataacgcgtcagcagggcaaaaccacaatccgaatcagttaaagccgacgatgcgtttggcgatgagatagccgttgcgcacgatccagcggccggttttgccgggcagattgagcgcgcgggacatcagctgcgagcgcacatccttgccgatggccggcgaataggcgtcaatcgcatcccacagctcggttttcttaacgtagttggccggatcgcgcgagagaatcaggaacgtcgaggtaacgcacgattcgatcgccaggaagtgaatcatgtaccggtacagcccctccggcaccgtaccgcgttcgggcgtggcctcggtcatcagccgattgacgagccgcaactggtccacacgcttaatcatcacgtcggtctgcacgctctgaccctcgcgcccgatgaagtagtggtagaacggcacatcgaggtactggatgcgcttcacccacgggaacggctggtacgagtaatagaaatcgacgtagaacgtgtgctccggcagcttcagcccggaatcgcgcaccacctgcgtgcggaaggtgagcgcatgcatgatgatgtactgcgccagaccgaacttgcccaggtcatcccagccgagcacgcggccggcctccattacacggcggaagttcactacggtcttgtgacgcttggccaccttgtcatacacgtaattggtcaccagcatgtcaatcggttcgtcggtgtcatgctgtgcacgcaacgtggccagaaccgtgtcgatggcctgcgggtcgacccaatcatccgcatccaccactttgacgtacatgccggtcgccgccgcgataccggtgttcaccgcgccgccgtggcccttgttctcctgatgaatcgcgcgcacggcgcccggattggtgcgttccagcttgcgcgcgtactccagcgtgccgtctttcgaaccgtcgtccacaatcagcacctcgaggtcgctgatgtcgcttgccgaaagcagcgagttcacgcaacggtcaaggtaggactccatattgtatgcggggatcacaaaggtgagcgtctttgccgtgctggccatgaaagtcttacgtcctcacatatttagtcgttatgttcagtttcctgttcaaaccgtagcacttcgcctcccgactcggcagagtgttgcgtaacctgtgcccctgaacgcatgttctgcaaccctgaatcttccccggtggcgtgctcgggatccgattgggcagaactcgtctggtctgaatccgggctgccggaatcggactcgcgcttggctcggcgctcggcctccttccgcgccttggcgccctcaaagaacaactggggcttggagtcaagccggctcaggccatgccaggccaaatccacaatgtatgcagccagctgctccttgctcacctttggccggtcggcccagtactgcccggtgaatacggtcatgcccaccagcatctgcgcgtagtacggcacgcccttggcagacagcttctgccgtttgaatgtttcggaaagaatgtcttcaacgcgtacggcgatgtctcccatcagcgagctgaatgagccggacgggtcggtgctcggcgagtcgcgtaccagtacctggaacccctcggcattctcttcgatataggtgaggagcgcaagcgccgtgcgttccacaatctggcgcgggtgcacggtcggatcgtcgagcgcggcggtcagcgtaccggtcagcgcgcgcatctcacgatccacaatgacggcatacaggccctctttgccgccgaaatgctcatacacaatcggcttggagactttggcgtgcgcggcgatttcctccacgcttaccgcttcgaagcctttggcggcgaatagcgagcgtccgacttcaatcagctgctcgcggcgctgcagcgacgtcatacgtgaagaatgtgccatgcggttcagcttaagtcgccgggtggaattgtcggcctgagactgccgaattcgtaggggattccatctgcgggctagacttgacaggtatggatatgaatactgtgctcgccgttcttggcgtgattgtggcggcggttatcgtaatcgccctgagcatctggttgggcaagtcccgcaagcgcgatttggatcgtgcgatgggcaaggttgcccccgacaacaagaagacccgcgacgccaaggccgccgccgacgctcggctggccgccgaagccgaggaagctaaggctgcgactgccgccgagccggccaagtcagccgaatcggccaaagccgagcctgcgccagccgcgcaggccgaacccgaaccggcagctgcgcccaagcccgagtcccaacctgcctccaagcccactcccgccaaacctgaaacccccgaatcggtcggctctcgactgacccgactcaaggcaaaacttgccaagtccggcaacccgttcggcaaggccctgttcgacatcctcgccaaagacaatctctccgaggccgattgggaagacgtcgaagacacactgctgcttgccgacgtcggtgcggatgcttccgcccaactggtcgatgacctgagaaccgacgcccgcatcactggtaaagccgacccagccgaagtacgcgccacgctcaaggagaagctgctcgatctggtcggtcgagatacggaccgccgcctcaatgccgaaaagccgggtgccgccaagcccagcgtcatcatcatggtcggcgtcaacggcaccggcaagaccaccactgccggcaaactggctcgactgttcgtggccgaaaacaagcaggtcatgatgggcgcggccgacaccttccgcgcggccgccgccgaccagctcgaaacctggggcgcacgcgtcaatgtgcccgtcgtccgctccgacaaggacggtgccgacccggcatccgtcgcctttgaggcatccgccaaggccaaggaagcgaacgcggacgtgctcatcatcgatactgccggccgactgcagaacaagtcgaacctgatggacgagctcggcaagattcgccgtgttaccgaaaagaacctgccggtggatgaagtgctgcttgtgctcgacgccaccaccggccaaaacggcatggcccaggccaaggtgttcgccgaagccatcggcattaccggtgtggtgctctccaagcttgacggttccgccaagggcggcatcgtggtcagcgtgcagaaggagctcggcgtgccggtcaagctcgtcggtcttggtgaaggtccggacgatttggcacctttcgatcccgaaggtttcgtggacggcattctcgcgtagacggtcgagttcttctcagtctcgctttgctcgacagctcccctcagcgaggggagccctgcgtccgtccacgttgtgggcgcgggaaacgcccgcaacgcaccaaacctagccccgaagcatattcgaaacatgattcggggctttcccatatccgttggaatcatgccggaatcagcccatccgatgccaacctaactgtcaggtgcgcttaacaatcgcgtaacttgccgtaacgaaaccaaaacgagaccggcttttactgacgaactgttagcccccacaagggggacggcattgtagagacaaagtcgacgccggccgcgcaaagcccccggtgccctgaacgaaagagagggaggtagacatgggagcgattgattccggtaacaccgcatggatcctgacatccgcgtccttggttttcctcatgacgcctggtgtggcgttcttctacggcggtatggttcgtgccaaggccgtcctgaacatgctgatgcttgaggcggccgccctgtcggtcaccatgattgtctggaccctgtggggttggtcgattgcttacgccggttccgacatcggaggcatcttcggcgacccggccagcggcttcctgctgaaggactccatggtcgcccaggacggcgtgttcaccgccaccggtctgaacggcaacaactacccggtttccgtggacgtcgccttccaggtcgctttcgcgatgattaccgtcggcctgatctgcggcgccattgccgagcgtgtgaagtacagcacctggatgattttcgtggcgctgtgggtcaccttcgactacgctcctatggcccacatggtctggaacggtggtctgctgtctgctgacggcgccatctccaaggccatcggcgcggccgcccacgatttcgcaggtggtactgtcgtccacatcaacgccgcagtcgccgccctgatcatcgtgctcatcatcggcaagcgtaagggcttcggcacgcagccgttccgcccgcacaacgtgccgttcgtgatgctcggcgccttcctgctgtggttcggctggttcggcttcaacgctggttccgccttcgccgccaacggtactgctggttacgcttgggtttccacctccgccgccaccgcagccgcaatgctctcttggggcttcaccgagaagattcgctccggtcactacaccgccatgggtgccgcctcgggtatggtcgccggcctggtcgccatcaccccggccgccgatgtggtttccccgctgtgggccatcgtgatgggtgccatcgctggtgtcctgacctgcctggcctgcggtctcaagttcaagttcggctacgatgactccctcgacgttgtcggcgtgcatggcgttggtggtttcaccggcaccatcctcatcggcttcttcggtgaaggcaccggtctgctggctggtggcgactggaagcagctcgtcgttcagctggtcatcgctctcgtcgccatcctctactccgcagtgatcaccgcgatcatcgccttcgctctggagaagaccatcggttggcgcgtcaccgaagctcaggaagtcggcggcatcgatcttgccgaccagggcgaacgtgcttacgattttgctggtactgccagctccgttctcaaggaggtgaagtgaaatgaagctgatcaccgctatcattcagccccataagctcgacgatgtcaaggaggccctcgcggccgccggcgtgcacggtctgaccgtgtccgaggccaacggctacggccgccagcgcggccacaccgaggtctaccgtggcgctgaatacactgtggacctgattccgaagattcgcgttgaagtgctgtccgatgacgcggatgctgaaacgctggtcggtgtgatcatcaagtccgccggcaccggcaccatcggtgacggcaaggtgtgggtcgctccgctggactccgtggcccgcgtgcgtaccggtgagaccggttccgccgcgatctgataacacagacgtccatgcttagaaggggatggactgcataggaaaggtccccgcacgccgcgaattgacgccgtgcggggactttttttggcaatgaaagatgaagcaatgacttcagcagtagatggcttgaaacaacgattcatggatatgagccagccggatgacgacggcgtctaccggaatggtgcgaccaagcgcaaagcccgcacggaactggccatgcaatgcctcactgagctgtggaatgcggcctgcaaggatgtctctttccccgtgcccgactccggcatcggcttcgccgcggtaggctcgctggcacgtggccaactgggccccagctccgacctcgacctggtcatcatctacgagcctcgcacgttgaacgaccagcagctcaacgagttggccaacaaactctggtacccgctatgggacagcggtctggacctcgaccactccatccgcacgcgcgcccaatgcgaggaagtcaccgaccatgaccttcccgccgccatgggctggctggacgtgaagcccatcgccggcgacaccgctctgatcaccaccaccgccacgtccatcctcgaacgctggcgcaaggccgcccgcaagcgcctgcccgaactgctcgactccgccaaagcccgactcgacgaattcggccggctccaatacgtcaatcagcccgacatcaaagaggcccgtggggggttgcgcgattcggtgctcgtctccgcgctcgccgcctcatggctggccgaccgcccgcacggcatttacgacgaagctgtggaacgtctgctcgacgtacgcgactgcatccatctggtggccggcaaggataccaacctgatgctgacgccctatcaggccaaagtggctgccatgcttggccttgccgatccgacttggcccgaaaacgagcgtgccgcctactcgatcgacgatctgcagacactgcttgcccgtatcggtcggcgcatctccttctcgcttgattccaccgcatcccgcgccgaacattcgctgacccacgaaaagccgcgattcgcgttcttccagatgttctctcagcgctctggtggcaagcgcgaagccccgcaattcgacgtggtggctcccggcgtggccaagcacgaaggcgaattggtgttggcgcccggtgccgagcctgccaaggatgccaagctggcgttgcgtatggccgtggcggccggcgaattcggtcttcccatcaacccgtctaccttggttaatctgaagcgctgcccgattcacgacaaccagtgggatgacgaatcgcgcgagctgtttatccgtctgcttgcgtgcggatcgaatcttatggaagtgtgggagagcatcgatttcgtggacattccgggtcgatggatgccggaatggctcggcgtccgcaaccgtccgtccgcctcggccgcccaccggtacaccatcgatcggcatatggtggaggtcacgtcgcgtctgggtcgtgagacaccgtccggtggacggtacgatgacgatcatttcaaggcattgctgttggccggtattacccatgacatcggcaagcgcgcgttcgtggccgatcacgccgccgagggtgcccgccatgtgccggtgattctcaagcgtatgggctacgcgccggacatcgtcgactgggctaccgtgctggtgcgtgagcatttgacgctatccgaatttgccacgggtaaggacccctatgatccggccgtggcggaggagttggccgaccgcttgcaccacgacaagatgctgctggatatgctgttcgacctgacccgggccgacggctcctcgctcggtgccaccgccggtgagaccatcaccaagcaatacggctggtccaagtggcgcgaacaaatcgtccgcggcatgtattccgccgcccgcgccgctatgtaaacggaatcgcccagcgcttcgcgcggccgatacctacctcatccatgcgtccgagcgcacgcgtagtccgttggacagaccgcgcccacccatgagcaccacgttgaacgcggcccagagtacggcggtacgcatcaggtcgctcgtcagcgccggcgtcaccatattggccagtatgagtatgagcgtcacatacaccacggcggtcagcgtgcatgtgacggccagatagcggtagtcgcgcgcgccgataagaatgccgtcgattgccatcatccagccttgcagtgggaagaagatgcccatcgtcaccatgcccacggcgatcagcgtctgaatatgtggcgtaggggagaagaagtgcccggcgaacaggccgactaccgcaaaagccgtgccgattaccgcgccggtgaccagtcccgcacgcccggtcgcccgcgtcagccgccgcgcctgctgcacgctgccagcgcccagcgctgtggccaccagcgtctggccggcgatgcccacggaatccagcatgttcatcgcaaaattccaagaggagttcacggcctggaacccggccaacacggcagtacccatgcgcgcggcacaggcgaccgtagtcaccatggccgcacgaatcgccaatgtgcgaatgaacaatggcagtccgtcgcccccggctgccgcaataccggccaaacgaggccgcagactcgcaccatccgcccgggaccacagaatggcggggattaccaggaacagccccatgaaccactgagctaccagcgtcgccactccggagccggcaatgccccaattcagcacaataacgaacaacacatcaagcaccgtgttcaccaccgcgccgcccaccgcagcgatcagcgtgatacgaaccttctgcaatcctcggaaaatgccgttcgccgcatataccatcagcatgcctggcgcacccagcacgattgcgcgcgtataggtcacggcttgttccaatacttcgccctgaccgcccagtgcccggcataatggctcggcagccgcgaacaatcccaatcccagtacggtgccgatgctcaaggccagccacaggccatcaatgcctgcctgcagtccctcgcgacgacgacccgctcccagcagatgtgccacctgcgcagtggtcgagtaggccaggaatatgcatagtccgactgccgtgaggatgatggtggagccgattgacaggccggccaacgccgcatccccgatatggccgacgatggctgtgtcgataaggatgaaggtcggttcggcgatgagctggccgaaggtcggcagggccagcgccatgatccggcggttggtggagcgggcgtcggtcgggccgttgctgacgtttgtgtttgcgccggcatgcggggtgccgaagccatcgcggcgtgtagtatcgccggaactggtggctttggcgtcggaagagtctatgggcacgctcacacgcatatcacgcctgactgcgttgcgcaagcacctgttgtgggcgcggaatgttatccccagactatccaccaagttatccccagtatgtggataacttagtggattatccccagaattatccccaaaatgtggataacttatttttctatccacattttgctttctgcgtgtcgtggcgctgactcataggtgaataaggaatgaaccgatgcgggcaaccgtttcgtttccatacgatatcgttcacctgccacgccacatcctatacttggaggctatgccagaaggaagtgaacactcgtatcagaatgggttcggcggtggcctggatcgtggcgatcgtggcgaccgcgcgggccggggcggcacgcagacgtcggcggcggccggcgacccgattttcgaccgcgtgcccccgcatgatgacgacgcggaaatggccgtgctcggcggcatgctgatgagtaaggatgccatcggcgaggtctcgcagaccattgacgtcaccgatttctaccagcccaagcatcagacgatctataacgcgatcatcgatctgttttccgccagtcagccggtggacgtggtgctcgtggccaaccagctgttggcggatggcaacctcgacaaggtcggcggcgcggactatctgcacagccttgtcgcatccgtaccgaccgccgctaatgccatgtactacgcggagatcgtccatcagcgggccattttgcgcaatgtgatcgccgccggcaccaaaatcgcccagctcggttattccgccgagggatcgcaggctgaggatgtggttaacctcgcccagtccgagatctacgagatgtcgatgggcaaggtgcgtcaggactatgccgccatcggcccggtggtccacgacgcgctcgaccagctggacaaactgcagcaaggcctcgtcaacaagggcgtgccgaccggcttccgcgacatcgacgacgtgacccagggcctgcagcccggacagatggtcgtcgtcgcaggacgtccggccatgggtaagtccacgctcggcatcgacttcgcccgcgccgccgcgttgcaccacaacatgacttccgtggtcttcagcttggagatgagcaaggtggagctcgctcagcgtattatctccgccgaaaccaatattccgatggccgccctgcgccgcgccgacgacatcacccccgaacgctggaacaccctgaaccagttctggaccaagatgcagaacgcgccactgttcattgacgacagcccgaacatgagcctcatggagatccgtgcgaaatgccgtcgtctgaagcagaccaacgatctgaaactcgtagtcatcgactacctgcagctgatgacctcgggcaaggccgtggaatcccgccagcaagaggtgtccgaattctcccgtgccctgaagctcttggccaaggaactcgaagtgccggtcgtggccctttcccagctgaaccgtggcccggaaatgcgtaacgacaagaagccgcagctctccgatttgcgtgaatccggctcaatcgaacaggacgccgacgtggtgttcctggtccaccgccctgacttctacgacaaggaagaccgccccggcgaggccgatatcatcatggccaagcaccgtaacggcccgaccgaaaccttccacctcgccttcctcggtgccacgtccaaattcaaagacatgccgcaggactacaacgccaatcagggggtgtgatgatggcaagcaacgtttcacgcgatgtttcgcaagaccaatcgtccgtggtgcagacctgcaaaccgtggtatgcgttcgccaccgtggccgcaggccgcttcgtgcggtttgcatcccgcgtcaccaaacatggcggttcggctttgcccggcaaagtcgtagaaaagattgaccccggcttcctgacccgtacgctcgggcagttgccgcttggcgtggtattggtgtccggcacgaacggcaagaccaccaccacccgcatggtcgcctcgatgctctccgatctggggctgaaggtgttcaccaatccgaccggctcgaacttcgtgcgcggcgtggtctccgcactgcttaccgaagtcacgctcggcggcaaattggacgcggacatcgccgtgctcgagctcgatgaggcgtacgccgtccacttcgtcaagcaggtcaagccccgttatgcattgctgctgaacgtgatgcgcgatcagcttgaccgattcggtgaaatcgacaccacggccaaactgctcagccatgtggctgcggcgactaccggcactgtggtactgaaccgcgaggacccgcgtatcgccgcgctcgccgcgaaggccccggctggcaccaccgtgcgatacttcggcctcgccgacgatttgcgccactatttcccgtccgatgacgacatggccacgaccgtgtcggtggaaggtgcggccgggccgctcccctcagccagaactcctctcagtccgcgaagcgaactgagaggagcttccacaggcacggcagaacttcccgccgacgtgacacttaccgccgtgggcgaccacaaggccaccttccagatggacggtcagggctacgccaccgacgtcaagcttgaaggcgtctacaacctgtacaacgcggccgccgcgctcgctgtggtacgtgcggtgatgcaagacaatgccgccgcatccaaggccaccgccgcagccaacgcctgcgccgtgtccgccgacgagcttatcgctgccgtttcccgcgtcacgccggctttcggccgtggcgaggtcatcgacgtcaacggttccccggtcgaactgctgctggtcaagaacccgatgggcttccgcctctcgctcgccagcttcgacccggccaacgcggacaccatgatcgccatcaacgacgaatatgccgacggccgcgacatgagctggctgtgggacgtggacttcacttccctgcgcgcgtccggtgtcgccatggtctccggcgtgcgtgcctgggacatggcattgcgcctggggtatgaccaagtgccagtcgccgatacgaacaccgacctcgaacaggccgtcaccgcattcgtcaacgccaatcccggcacacgcaagcacatctactgcacctacaccgccatgctcaaaacccgcgccgtactgggccgcatcaccgaagtacgggacgcgggcgtgggcaagtaactatcctctagcgcccgcgcgccacctcccgcctgcgggaggacatggtgaggaataagacgcttcccgtcagcgggaagacatcgacaaggagaacgtgacatggccagaacaattgatgtggtgtccctgtatcccaaagacatgaacatctacggcgattccggcaacgtgctgactatccgccgccgtctggaactgtacggttatgaaccggtcgtccaccagtacaatcaaggcgacgactggcccgaccaggtggaccttattctgggaggcggcggccaagacaccggccagaagaaaatcatcgacgacttctaccatcgcgccgacctgttgcgttcgcttgccgcagacggtacgccgatgctgatgatctgcggcctgtaccagctgttcggcgagtactttgaaaccgtggacggcacccgtctggacggcatcggcgttatcggtgcttataccgtgggccagaacgtgcgtatgatcggcaatcttgttgagcattccgaccagttcggcgatgtgattggctacgagaaccactccggccagaccttcctgcgcgaaggcgttcagccactcggcaccgtcaatcaggacggccgaggcaacaatggcgaagaccataccgagggcgcgcgcgtgcacaacgtgatcggcacctacatgcacggctcgttgctgcctaaaaaccccgccatcagcgatttccttatcgaaactgccgtgactcgtcgttacggtacgttcgatacgtccgatcagacccccgaacaagccaaggagctcgcccggctcgatcaagtagccaccaacgcgcgcaaggctgccgccgaacgtcctcggtgaattctcggtgagtcctcggtaagtaccaatcagcgaaaaatcagtcgaaatcagtctgagggtctagtacattgccctgttgtttgcgctaggcttggtggtacgagacatggcaccaggccatgtcggacctcgaaggaggggtatcatggctgattttgatcttctgggtgatggcctgcgcaaggtcctgctggcgggcatcggagcccttgccaccggatacgagaagagcagcgagctcgtcgacgaactcgtcaagaagggtgagattacggtcgagcagggcaaggcgctgaacaccgagctcaagcgcaaggtgagcgagacggtggatgacgccaagaaggccgccgccgaagccggcgacaaagctgctgccgcagccgacaccagtgccgccgacaagcccgctgacgagggcaaggccgagtgaccaagcccacacgcgctacgccggaatcagggtcgaccccgctttccagcagggtcgaccctattctgacgcctgcgaaagccgaacgtgaggcggcggcgaaccggtccgtcgacacgtcggacacgctcaagcagaccgttaccaaggcgactccgagcgtatccgacgaaacgctggcactgttcggacgcaggaacgatttcgccacgcgctaccatctgacgcgtcgtggcaagatcaaacgactggggcagatcaccagaatcgtcgagcaattcgacgtgctgcacggcctgactccggtcaaaatgcgcctcatgttcgaggcgctcggccccacgttcgtcaaagtgggccagattctgtcgatgcgctccgagattctgccgcaaagcttctgcgacgaactcgccaaactgcgcgccgacgccgacccgatgccgtattccacggtgttggatgtgcttgccgccgaatacgggcgtcccgccgacgaggtgttcgcgcatatcgaccccaagccgttgggctctgcttcactggcgcaagtgcatcgcgccacgctgaaaaccggcgaagatgtggccattaaagtgcagcgcccgggtgtgcgcgaaaccatggcccaggacgtctccatcatgcgctccatagccaaggccgccactaaggtgattcgcacctcacagatcgtggacctgaagggcgtggtcgaggagctgtgggacaccttcgaatcggagactgactttctgatcgaggcccgcaatctcgccgaattcaagcgtttcgccgcccgattcaaatacatggactgcccgacggcgtacaccgaactgtgcaccgagcatgtggtggtcatggagtacatcgacggcatctccgtctcccatccgggccggctcgtcgatgctggttatgacttgaaggagatcggcaccaagctcgtcgacaattacgccacgcagattctcgacgacggcttcttccacgctgacccacatcccggcaatatcatcatccggggcggccagatcgtacttatcgacctcggtatgaccggtcggctcgaccagcgcacccgtgcagtcctcaaagaaatgattttcgccgtcgccaaacaggattcgcccgctctggccgaggggctgctgcgatttgccggcaccgaggccgatccggaggactacccagcactgctggctgatctggacgtgatcgtcaaggaattcggcaccgtggatctggccgaactggacattgccgccttcctgaccgcactgacgcagatggccggccgccacaacatcgaggtgcccagtacggtgaccaccgtcggccgcgcgttggttacgctcgaaggcttgctggacgagttcattcctgatgtgaatatgatcgaaatcatttccgaccatatcgccacgtcgaaatcgctgaagaacgccaccaaagacgagatcaagtcgctgggcgttgagggacatcaggctttgcatgccacgctcggcaccatgaccgaactcaagaccgtggcccgtatgctgacccgtggtcagttgcgcgtcaacatggaactggtcggcttcgaagagccgttccagctgctttcggatatggtgaatcgtctgacgatggccctgattgtggtcggtttgttcgttggctcgtcgattgtctactacgccggcatgaagccgattatcttcggcattccggtcatcggcttcatgggctacgtcgtggccttcgccctcggcgtatggatcgtcatcgacatctacttaaaggggcgcaaaaccaagaagcggtagggcatcgattgatatcagtccagcgggagggtggattcgcgctggataaggtggcagggtacgtagtcgacaccgtgatgcgggttgccgtcgatggcatcgaccaagtatcgtgccgcacgccgtccgatggtttcggtttcgttgtcgatcgacgtcagtgcgggcctcgagctggaggtcagtaccgaccagttatcgtggccgatgacggcgacgtcatccgggatgcgcagtccctgctgcttgagcacgtcaatgcagccgcgggccaactgatcgttctggcagaccactgcatcgaacttgaccccttggtcgagcagcaggcgggtggcggcgcggccccagccttcgtcccatttgccgtaacgaattgggccggcgggttcaatacctaattcggagagtgcctcgagcgcgcccttggtgcggtcggtggcagcggtataggtttcgtcgccgccgataatggcgatgtgccggcggccacacgagatgagatggttgatggccatgcggccggcgtccacgttgtcgcaagtgaccgagcagtctttggggtcggtggaggggccgtagacgtagaccagtggcacgccccagtcatggccaagcgtgggcctggggttggtctcgcactgcacgatgagcagtccgtcgaccttgagggacagcagtttctcgacatgctgacgttccaaggcggcgtcgccacgagcgttggccaacaatactgaggtcgattgggctcgcaactcgttctccgcgccgataagaatcggtgtggagaaacgaccctgcagatcggaggtgaccaggccgatagtgccggtggtgccgcgggctagggattgggcgagtttgttgggagagtagttgagttgcttggcggcatccagtacacgctgcttggtttcttcgctgatacggggtttgttgtgcagtgccttggatgcagtggccgtcgagactccggccaatgccgccacatcctcaagtcgcgctgcccgtccggttgctggctgggtcatcatgcctcgattccttggtccttcagcagtatatagcgcattgttttgcgatgaaatacctcatacggtgtggtgcgccattgcatctgggaataattgtagcttcaatgcgaaaactttcgcaaacatctttttttcggcgtggcgtagtcagggaaattgttcaagtgcaaggtaagtgaaagaaagcgttacttccatgttcgcttttgtttgatttgctcgacacgccggaataatcattgatattaagccaattcaagcacgttattcatagtcgaatcacagtctcgaacccgtttgatgtgagaaaaaacgcgaaaatgcgaaagcgcttttgcaaaaacttccatgtttgtttatattgagaaaaggctttcgcagtgttacctgctccgggcaaaggagcgagcagggcgaaaccaaggaggcggaccgtccgccaccgcctctcatagttgagcggatatatagagaaagaagcgaacatggtgtctttcaataaactgacccgtactcttgctggcatcgctgccgccgcgttgatcgttccgctggccgcctgtggtggctccggcaatggtggcactgccaccgccgaaggtatcccggccaagggcaccgacgatggtaccgagatcaccctgtggacccgttcccctctggagcgtcaggccaagaacgtggtcgaggcttacaacaagagccacaagaaccaggtcaagctcgagatcatcccgaacgacgatatggaaggcaaggtcggcggcgcttcgcagaccgactccctgcctgacatcctcgccggcgacgtggtccgtattccgtactgggcttccgagggcatcttcaccgacatcaccaagcaaatcgatggcctggacaacaaggccgacctgcagcagggccacatcgaagccggtactgttgacggcgccgagtacaccctgccgttcatcactgacgtttccgtgatggtctggaacaagaacctgtacaaggaagccggtctggacccggagcagggtccgaagagcatcgaccagttcgtcgagcaggccaagaaggtcgccgccctcaacaaggatggcgtcgcaggctcctacctcgccggtcagtccggtggtgctctggtcttcgacctcttcccgtccgtgtgggctgacggcgaatccgtcatgaacaaggatggctccgaggccaccctggacaacgactccatgaagggcgtcttggacgcttacaaggagctggccaacaccaccaacggcctgggtgcaggctccaaggaagagaccggcgccacctggaccgctccgttcgcgaacggcaagatcggcgttatgccttacccgaacacctccaccactgctctgttcgatgctgagaaggacggcggcttcgaggtcggcgttgctccgatcccgggcaccaaggaaggcaagacctccacgttcctcggcggcgatgccatgggtatctccaaggactccaagcacgttgctcaggcctggaacttcctctactggctgatgcagtctgacgctcagaaggaagtcttcgctgaccaaggcgacaccgcctccaacatccagaccctgaagaccgcttacaaagacgctgacccacgcatccagaccatcaactccgtgattatcgacggcaacggccagaccccgaagtccccggccttcaacgaagccttcaacgccgctggctccccgtggcagctgctcgtgcagaacgccgtgtggggttccggtgacctcaaggccgacaacaaggccgtcaccgacgtcctgtctgcccagtgattcggtggtgatgctcctcaccatcactcatcaaatcacagcaataactgaataacaactgaacagattgagccggtccctcccttgtgagggcaggagccggctcaaccacataatcgaacttctatcttcttcttcattccttttcttccttcatcactacataccttatgaatgcggtgtgttggcggggcttcggagtcctccttcctcgaagccctgacatcggattgcattcggattccgtgattaccatttcacagtaatttcccaaaggagagagaaacatgtcgagtgtttccaagagcgccggggctgtgcccgtgcataagtccaaggcgaaggcggcgcagaccaggcgaggtctgctgtacgcacttccggactggctgatgattatcgtcctgttcttcgtgccgattgttctactggtcgtcatggcctgctctcgttggagcctgctgggtggcaaccgcggcgtgaacttcccggacaacttcgtcaaggtgttcgagaacaaattgttctggccctcgatttggttcacgctcgagtacaccgtgatcgtcacgatcttcctgttggtccttggcctgggcatggccatgattgtgcaggagagctcgaagtggaacaacgtgctgcgtacctgcttcctgctgccgtccgcgacgggcctggcgtccgcgtccctgctgttctacgccctgtattccccgcaggtgggccctgtcaccaagattctgagctcgttgggcctgatgcaggagggtggttcggtgctggccaccggccagtcggccctgtgggccacgattatcgtgattgtttggcgtttctcgggctactacatgctgctgatgatgatcggtctgcaggccatccccggtgatctgtacgaggcggcccgcatggacggcgccggttcctggcgtatcttccgctccatcaccctgccgctgatgaagccgaccatcgtgatgtgcctggtctactgcgtgaccggctcgatcctcgcgttcgatcagttcttcattctgaccaagggtggtccgaacaactccaccatgaccgtggtgcagctcatctacaacttcgccttcgattccaagaaggatctgggtatggccgcggcgctctcgctgatcgtgctggtggccttggtcatcatcaactccatccagatgcgcggcatgcgcgacaacaccaagtgagaaaggggaggtaacacattatgactaccccattgtggaagcgtatcatcgcccggatccttgaggccctgctggccatcatcttcatcagcccgctggtctgggtcatcatctgctcgttcagcccgcaggccggttcggcccagtccaagggctggggcgtggccaactacctgaccctgttcggttatcaggaaggtctgcccaagtacctgttcaactcggtaatcgtgactctggtcgcggtcgtgttctccgtggtcgtctgtacgctggccggctactcgttctcccgcttcgactacccgggccgcaacctcggcttcatggtcaccctgtcgatcctgatggtaccgtacgcctcgctgctgatcccgctgatggtctggtacaagcagatcggcctgaacgacagcctgctgggcgtgggcctggtcatcaccctgttccagctgcctatgagcacgttcatcatgcgtaacgcatttgacgcgattcccaaggacatggaggaggccgccatggtcgacggctgcaacagcctccaggccttgttcaagatcctggtgccggtggtcaagccttcgatggttacggttggcctgctcgccttcctcgaggcatggaacaacttcatgattccgctgtacttgagctcttcgtccaagtccacgctgccgctggcgatggtgaacatgcgtcagcagaccatgggcgtcatcgattacggtgccaccgaggccggcgtcgtgatcctgctgattccctgcgccatcctgttcctcgcactccagaagtactacgtcaagggctttatggccggagctgtcaagggctgacggctcgtgccgccggcccttggctgggagcccggtgggctcccagcaagctccgtgctgagacgcgacagcgtcgaagccaatactgagcccggctgaaaccggtccttaattgcagggccggaggcggtgtggtcaagggccttaaaaaaaggacaatcatgaacgttacaatcacttccccgttctggaagcggcgtcgcgaccagatcgtcgaatccgtcatcccctaccagtggggcgtgatgaacgacgagatcgacaccacggtgcccgacgacccagccggcaaccagctggctgacaacaagagccatgcggttgccaacctgaaggttgccgccggcgaattggacgacgagttccatggcatggtcttccaagactccgacgtctacaagtggcttgaggaagccgcctacgcattggcataccacccggatcccgagctcaaggcgctgtgcgaccgcacggtcgatctcatcgcccgcgcccagcagtcggacggctatttggacaccccgtaccagatcaagtccggcgtatgggccgaccgcccgcgcttcagcctgattcagcagagccacgagatgtacgtgatgggtcactacatcgaggccgccgtcgcctaccatcaggtgaccggcaacgagcaggcccttgaagtcgccaaaaagatggccgactgcctggatgccaacttcggccccgaagaaggcaagatccacggcgccgatggtcatcctgagatcgagctcgccctcgccaagctgtatgaagagaccggtgagaagcgttatctgacgctttcccagtatctcatcgacgtgcgcggtcaggatccgcagttctacgccaagcagctcaaggcgatgaacggcgacaacatcttccatgatctcggcttctacaagcccacctacttccaggctgccgagcccgtacgcgaccagcagaccgcggacggccacgccgtgcgcgtcggttacctgtgcaccggcgtggctcacgtgggccgactactcggcgatcaggggctgatcgacactgccaagcgtttctggaagaacatcgtcacccgtcgcatgtatgtcaccggtgcgatcggctccacccatgtgggcgaatcgttcacctacgattacgacctgccgaacgacacgatgtacggcgagacctgcgcttccgtggccatgagcatgttcgcccagcagatgctcgacctcgagcccaagggcgaatacgccgatgtgctggagaaggaactgttcaatggttccatcgccggcatctcgcttgacggcaagcagtactactacgtcaacgcactggagactactcccgacggactggacaacccggatcgtcaccacgtgctctcccaccgtgtcgactggttcggctgcgcatgctgcccggccaacatcgcccgactcatcgcttcagtggaccgttacatctacaccgagcgcgacggcggcaagaccgtgctgagccaccagttcatcgccaacaaggccgattttgcttccggccttacggtcgaacagcgttcggacttcccgtgggacagtcacgtggaatacacggtgagcctgcccgccagcgctgcggacagctcggtccgatttggactgcgcatccccggctggtccttgggctcctacacgctgaccgtgaacggcaagcccgcagtgggttcgctggaagacggcttcgtataccttgtggtcaacgccggcgatacgttggagattgcgctcgagctcgacatgtccgtcaagttcgtgcgcgccaactcccgcgtgcgctccgacgccggccaggtggccgttatgcgcggtccgctggtctactgcgccgaacaggtcgataaccccggtgatctgtggaactatcgtctggccgatggcgtcaccggtgcggatgccgctgtggctttccaggccgacttgctgggtggcgtcgataccgttgatttgccggcagtgcgcgagcacgccgacgaggatgacgcgccgctgtacgtggatgccgacgaaccgcgtgcgggcgaacccgcgacgctgcgcttggtgccgtactactcgtgggccaaccgcgagataggcgagatgcgtgtcttccagcgtcgataaatatcggcgatatgccggcctgcgcgcaactggccggcaaaaaatacttatgccgccatcgtctgtaataagtcgatgacggcataggccggatgtcagtatcgattggagccgaaaacacatccggggaatgaggtctcctgtgcggggtaatacccgtgcaggagattattttttaattatatgctcctgctgtgagagctgtcggcggagtcgactgagggcggtcataagcggtaccgtgtaagccaccctcagtctcgctttgcgagccagctcccgccagcgggagcctgttggttcctgattcagcgaggctgaatcgttgcgccgtaggtactgcgacacggcgaaacgcagcaatgctctaatgcgaaaataaatgcgaaagctgagaaattaccgggtttttgttgtataagatggttgatatcactgagggaaagttgtgaaaccgtattcgctcggttatgatgtggaatcagcttcggtgaattgctccaaccgggatatccatggcggatatcacaccagatttactgaagacactcattccggtgaacccaataaccaataaaggaaactgatggagaacgggctctgcggcccagcatccacagaagaagtcctggtcgcatagacgcgacgtagcctgagcgaagacgcgaaagaccggggcggagaggtccaagcaggaatgcatcaatcaacacgaaagcggtggcttgcgtcaatcggcgcggttgcagcggtcgccacactggccaccggcggtgcagtcaccgcgcaggcagccgatacgcccgtcatcaagaatgcggatgtggcatatccgtcgttcaagggatctgatgatccgatgaagacggcggcgaacaacaccacatataaccctgccgccagctatctgcaggagacattcgataacgacgtgaagaacctggccggcaccgacaccgaccatgacttctggatcgataagattctcacccgtactggtgcacagccaactggtaaaggcacgaacgacaagggttcttactcgtatgaaggctccgacggcaacaactacctgttcacccgtggtcgcgccgcctacatgtacacgcacacgcctaatcggctcggttttgtgggtaacaccgcctactgggatgagaccaacagggatggctttaccgttaccgtaaacgctgacggtgcaaaccagacccttaacgaagacgcctcccagcgcaagcagacaccgagctacttcacctccctgttccagaccggtggcaagagcctcaagatcaaggaagttaagtacatcacctacaacaacgtgatggttgcgaacctcaccgtggaaagcacgcaggaccgcgatgtcacactgaccacggcctcgccgttcgccgccgagggtgctgatggtgccaccgaacttactggccgcgtgaacgtcaagaacaacctgacgaccatctatccgcgcttctccgccaacaaccaggacggttccaactggatcgtcagcggtggcaaactcaccagcacgttgagcctcaaggccaacgaaccgcagaccgtcaagattcagctcggcctgatcgccaacgaactgcctgactccaccaaggaatatgaggcccgttacaccggcgactttaaggatgctgccgcctcctacaaggattccgtgaccacctacaacaagtggtgggtcgataacgctccctatgtggacactccggaagacaacatcgataagaccgtggtctaccgctggtggctgagtcgtttcaacatgctcgacgccaacatacctggcaacaccttccagtacccgacctccatcgagggtgtgctcggctacaacaaccagatcgtgctcacctccggcatgttcatgatggacaccaagtggttccgcaaccccgagtactcctacggcacctggctttccgccggcgataccgccaagaagagcaaggcgggctattactactaccacgacaatccgggcgacccggccaactggaaccatagctacacgcagtacatcacgcgcgccggctgggactcctacaaggtgcacggcggtccgtccaccgtggccgagaagctggccgaccagggtgccgaggacgtgcaaggtctactcgcttccaagagcgagccggacaacaacgacaaccagaacaacaatgacaacagcttgattgactggtcctggtggtcgatgaccggtaacgatgccgacgccgtttccttctctgagccgggtcgctccggccagcgcatggatcgcgccgatggttccgccaatatgtgggccaacgctaacgcggctgctcaggcatacaaggctgctggcgataccgccaacgccgagaagatgcaggccatcgccgacaagatccagaaagaagtcaccactgaactgtgggacaagtccgacaacctgctcaagcacaggtggctgaacgacggtgctttcgccaagtacaaggagatcaataactactacccgtactccgaaggcctgatgcctaccggcaacgaagattacaacaaggctctgcgcctgttcgaggattccaacgagttcccgatcttcccgttcttcaccgccaaccaagcggacaaggccgcgttgaacttccccggttccaacaacttctccatcattaatgcgcagccgctgctgcaggtctactcggccggtattcgcaactacgatgcagccaagaatggctacatcaccaatgagcagttcaagaagctgctgtactgggtggcgttcgcgcactaccagggcggcgataacaactaccctgatcagaacgagttctggaacgaggacaacaacaacgtcggcgatgtgaacggtgacggcgtgatcaacaacctcgacaagaaccttgacgccgcacagaacggcggcaagatcacctaccgctcctggatccaccacacccagctcggcaccacgaactggacgatggtcgaggacgtagccggtatggtgccgcgcgaggacaacaagattgagctaaacccgatcgaaatccccggttggaactacttcacggtaaacaacctgcgctaccacgatcaggatgtctccatcgtatgggacaaggacggcagccactacggtggtcctgctggctacagcctgtacgtgggcggcaagctcgccttcacctccgacaagctggcgcacctcatctatgacccggctgcgggaacggtcgaggtcaaggacgattccagtgcccaggttaccgtcggcgccgaagccgtcaagaacgtgaaggccgccaatcaggttaccttcaatgccgatcagcgcgtgaccgacctgttcgccaagtccggcaccaacgtcgactccgcctccaagtccaccacgaacgtggccaaggacgcggacgtgaccggtaccacctacgccgagaaggacaccaactacccggccaagaacgcggtggacggcaagaccgtgatggaatcgttctggggtaccaagggctctgagaacaagaccgacacgctcaatatcaagttcaaggacggcaagcagaagatcgacgacatccgcttgtacttctaccagagctcgtccagccagaccatctccggctatgccgagcccgccaactacaagttggagtaccagaaggatgacggcacatgggccccgattgcggatcaggtgcgcaccccgaactacgcgggcgcgaactacaaccgtatccagttcactccggtggagaccacgaccatccgcgtcaccttcacgccgcaggccggcatggccgtcggtgtcaaggagatcgaagcctacaacaccggtatcaaggctgacggcacttccgagaaccagactccgcaggtggatgcttacgtgtcttccagcacctcatctggtgccaagctcgtcggtacggtgaaggatgacggtctgcccgcagaaggcgacgtcaccaccacatggtcccaggtctccggtccggaaggcggtactgcgaagttcgtggacgcctccgctgccagcaccaccgtcaccttcaacaaggagggtgactacgtcctgaagctcaccgcttccgatggcgagaaggaaggctccaaggaaatcaccgttcacggcatcccctctgacggtaccgtgaacgtagccccgcagtcgagcgcctctgccagctacaccaacggctaccagccgaaggacaacgccaagaaggtcatcgacggtcaggtggtatacgccaacacgccgaacgagacctggaacaactggggcgactccactggtgtggagccgtggctgcaactgaagtgggccggcaaggtgccgctgaagaaggccaaggtcttcttctggaccgatggcggtggcgtgccgatggtctcatcttggaagctccagtacgctgacgctgacggtaactggcaggatgtgaaactggctgacggccagtcctacacggtcaaccggaacgaaggcaacgaagtgaagttcgccgacgccgtcgaaaccgacaagctgcgcgtggtcttcccgaagggcgccatcgtgggtgcttccgagttcgaggcgtacgccatcgagccggtgagcgtggacgaagtcaaccgactggtgcagaccggttccaaggctgatgatctgaagctgccatccaccgtgagcgccgtatacaccgacggttctcgccgtgacctcgccgtcgcgtggggtaaggtgaccgacgctcagctggccgccgatgccgtattcgatgtcaagggcaccgtcgccggtgcgctgaacggtacggttgcacacatcgcggctcgttccgataccgcatcgcagaccgtgggtaatgcgcagccggttgagcagaccgtctaccagaacgccaagtccatcgacctgcccgccacggttccggtgaagttcccgaacggatacaacgacgaccgcaaggtcacgtggaaggatgccgacatcaaggccatcgacctgaccaaggttggtgactacgaggtggctggtaccgtcgacgacggttcatcttccgcagctgccaagctcactgtccacgtggttgccgacccgaacggttcctccactccggagcctgagcctgagccgttggtcggttggattgaaggcaaggcgaccaggaccaccatttcgcctgattccgaggcgacctggtcactggccgaaggcaagctcaacgacggcgtagtcgtcgatgatacttggccgaccacggatgatcagaacgtcaacgacaaggtctggggttcttggggcaaggcaaaggacggcatgtacgcccagtacgacttcggtcagtccgtgaccattgaccagagccgcgcccagttctgggccaacttcgctgagactgacgattcgaagggtggtctggaagtcccggacgcttggaagattcagtacctcgccgaggatggttcttggaaggacgtcgagcccaccgaggattacaccgtcgtgcgtaattcgccggcttctcgtgcggataccgatgccaagggttggagcgctgtgaccttcaagccggtcaccaccaagtcgctgcgactcgtgctcactccgtacaccggcagcagcaccttcggggccgccgtggccgagtggggcgtgcatggtattgacggcaccgagcctgaacctaccccggtcgacaagaccgcgctcaagtcggctcttgacgcagccaacggcctcgatgcaagctgctacaccgccgcttcatgggctgagttccagcaaatcattgacgctgcccaggctgtgtacgacgatgtcaatgccaccgaagaacaggtcgccgagcaagtgaccaagctcgaggacggccagaaggcgctcgttgcgctcgccaccgacgtggagaagtccacgttgcaggcggccatcgacacggccaaggccgaggccgcttccggcaagtacacggataagagtgtcgaggccttgaacaaggccatcgaggctgcggaagatgtgctcaagggcgatgaggccggtgaggtcactcaggccgccgtccaggaagcgttcgcttcgctgaacaaggccgtcaaggccttggaagagaagcccgccgccgaaacggtgaagaaggagtctctcaaggcttccatcgagcaggccaagaaggctgacaagtcgaagtacaccgagaaggcatggcaggctctgcagagccagattgccgccgctcagaaggtgtacgacgacaaggacgccaagcaggccgacgtcgatgccgcacaggatgctctcgacaaggcgttctgggccacgaagccggagcagaagcccggctcccagcagcccggcgtggccgacggcaagcagaacgacaacaagggcagcctgaccaacacgggtgtggctgtgctcggtgtcggaattctcgctgtgctgttcgccgccgcgggtgtgaccatcctgaagcgccgccagtccggtgctcacggttcggcccgccactctgcctgacccgcaacggagtcattctgccgagtgagccccctcacagagggggctctagccttttccttctacccatcattactcttttcactcactcaatgaggagcactatgagtttccatatatccgcgcaatcggttcgcgcggtggccggtggactcgtcgccgcagcgacattgctgccaggccttgccctcgcgccgaccgcaatggccgcagattcagccaccgctgacaacgcgcccagcgttgccggtcacgcgtataacgaactgccgtataacaatcctgatgttactgtcacccaaatcgacaatagctcactgcccagctacatgcgcaaccccatcgggcagaacgagggtattgacaccccgaacgatctttcgcagaactactactctgcggatgcgtccgcgctgagctatgacggcaaactcttcgttttcactggtcacgatgaggcttcgcctgactacggctccttcaatatgaaggattggggcgtatacgtcaccgatgaagatggtctcaatcgaggcaaatggacacattacaagaccatcgccaaggccgacctattcagctgggctaccggtgatggcgcatacgctggccaagttgtgaccgacgataacggcactccgaacgacacctccgatgattggttctactactacgtaccggtgaaggacaaggcttctgaggcggccggacaggacccgttcgccatcggcgtggctaagtcgaagagtccgctcggcccgtggaaggatgccatcggtaagccgctgctcaccacatcgcaaacccagattgaaaccatcgatccggcattctttgtggacgaggatggcaccggatatttgcactttggtacttttggcacccagctcgcaatcaagatgaagaaggacgccacaaccggccgcacctcgtacactgagaccgaaaccaaggctgatggcaccacgccgaacctccacaccatgaaggacgcggacaataacgcgaatggtccgaagggcttctttgaggcggcatgggtgttccgtaagggtgacacctattataacgtgtacgacggtggtaagccgggctcaggtacagccacctgcgtggaatcgaactaccaagcttgcatccagtactccacttctgacagtccgctcggaccgtggaagtatcagggcgtgatcgtgccttccggttccgctaccaccatgcacccctcagtgctccagttcggcgacaaatggtatgtgacctaccacaccggcgataaggaaggcggcaccgatttccgccgtgccgtgtgcatcgatgaagtcgactggaccgctgacggccagatgactttcaccgcacatccgaccaaagcggagaaaacgcagccctccaccaacgtagcctcgtacgcaaaggtgagcgcaacgttcaccgagacgccggcatacaagggatcggtgaacgatgggcgtgtactgcaaaccattgtggtgccaccgaaccactggaccaactaccgctccattccgcagccacaatccggcgactcgctggtctaccaatgggatggcactgtgcgcgccaactcgtccaaggtttggttcgatgtggattccaacgcgctgcgcgcgcccgcttcgtggaagattcagtacttggacgcggacggtacatggaaagatgtcaccagtccgagcggttatacaacaaccaccggcaaggccaaccccaacactgtcacgttcgatgcagtgaccaccactgctctaaagctcgacatgactggccaagctgtggatggaggctacgcctccgtggccgtggctgagtgggaagtcggcgctgctgatagcgaatcgccggcaatcactgcgccgaagggcgtgacgaccgccaccggcaccgcgcccacgctgcctgccaccgtcgacgtgaagtatggagacacgaccgttgcttccccggtaatttggcgtccggtcgctgcttcttcctatgccaaggccggttcgttcaaggcctacggtgtggttgctggcgtgcccggtgaggcaagcgagcaaggcaatgtgtcgatgaacgtcactgttcaggatggctacaagcccgccgccgataccacgaagccgaccgtgaccgttgccgtcaccgccaacgcgggcaatagcgaatggctcactgccgctccgttcgccaccgtgcaggccacggacgataccacgccgattgccaagctggagatctccaccgaccaaggtaaaacctggatcaccatcgcggcgaatgccaacgcaactattgccgcgctttcccagcagggtgatgttgacgtgtgggctcgtgccaccgatcagaccggtaacgtttccgacatcgccaaggccagtggcaaggtggattccgccgcgccgaccgtgaaggtcactgtcgacagggaggagcgcacgctgaccttgaccgctgatgacggcaccggttccggtgtcgcatcaattgaataccgcattggcacagacggtcaatgggccacgtacagcaagccgattgctgcaccgagcgcgtcgcgcgccaccgtgtactaccgcgccaccgataaggccggcaacgtgtccgcttcggcgaaaaccgacattccatccgacacttccgtgccgctgaccggctacattgagggcgatgccaccgccaccgatgtggacggcaaggcatccggctgggtcaagggtgccgccgcgttgaacgacggcaagatcattcccgatatcaccattgccaacgaggatgtctggggcacttggcccaacaccggtgagatgcgcctcgactacgagtgggatcgtgaagtgactatcgactctagccgcgtgcaattcacctcggatgatggcggattgggtattccggcatcgtgggaattgcagtactgggacgccttggcgaacaacggtgccggcaacttcgtggatattcccgatgccacctacactgtgaccgccaattcaccgtctgctggctgggccaccggcgatgccaaggggtggtctgatggcacgtggaacactccggtcaagactaccaagttgcgtatggttatcacgtccggctcggcttctccggctgttgccgaatggcaggttcatgccattggcgacagtacgcttgagcccacaccgatcgacaagaccgagctcaagcaggcgctcgctgactcgcctaaggctgacgatgcctccaagtacaccgagacttcatgggcggagtacgcggcggtattggattcggcgcagcaggtgtacaaggctgaggatgccaccgaagctgcggtggcggatgccgcaacccagctgaagcgggcagcgaagaagctggtgcttgtagctacggtgcaagatcgtgccgcgctgagcgctcagctcggtgccgctgctgccgtggatcggacgaagtggaccgatgaatcactggccgtgctggattccgcaatcgctacggcgaatgcgctgattggtgacgatcgggccacgcagtctgatgtgaaggccgcgactgaggcaatcagcaatgccattgcgggtctggttgagaagagcaccacgaagcctggccagggtggcgataagcccggttccggcacggacaagcccaaccaaggcaacgattccaaccagaacaagggtgatgccgactccggcaagcacaagaagatacctgacaccggtgcagccgtgcttggtgttggcatcctcgccgtggtacttgttgttgcgggtgtaatcatcctcaagcgccgcaagtccggtacctgctagtcccactcgctcggcctagcatcaccaagcccccgcgcagaacagcgggggcttcacttttgttcaataacaagcattatgtgcgcgtatgagactacgatggtggggaatctacgaacaggggcagcaatgacggcatacatggaccataaggatctcgccaacgaagttatcgatcaggcgcgcgcacaagagattactgatggtgtgcatcgcgtgcttgaccagattgccgcagcggagtccgcagccgggcgtgctgccggttcggtgcaattgctggctgccaccaagacgcgcgatgtcggcgagattctggcggctatcgatgctggtattcgcgtgattggtgagaatcgtccacaggagattactgtcaaggctgacggtctggcaaaacgactgggggagcgtggttattcgctaggcgtgattgatgccgctgaggctgacacggccaatgccgcagctgcaacgcatattcctttccacatcatcggccaattgcaggctaacaaaatcagtaaagtgctgccggtagtggacaccatcgaatccgtggattccattgaactggcggagaagatcgctcgtcgtgccaccatgcgcggcatcacggttggcgtgctgctggaagtcaatgaatccggcgaggaatccaagtcaggttgtgcgcccagtcatgccatcgatctggcccaacgcatcggtgcgatgggcggactgcgcttgcagggattgatgactattggtgcccatgtggatgatgagcgcacgattcgtgcgggcttcgcgcatctgcgccgcactcgtgaccagattcttgcctccggtgccgaaggcacggccgactgcaccgaactgtcaatgggcatgacccacgacatgacctacgccattgaagagggctccaccatcgtgcgcgtcggcaccgccatcttcggcgaacgcgccttcatctgattggagctatacgaaaaaaacgccgcttgatcaatagccaagcggcgtttttttcgtaaggattttcggcgtatcaatcacgcatagatattgcgcggacgcatgtcctcgggcagaccgtcgagcagaatcgccacagaaccttcctcgaacacggagcgaatacccgcggccagcagcggtgcgcaagacagtacggtcatattcggcaggcgcttctcttcaggaatcggcacggtgtccataaacacgatttcatgcgcgccacagttggccagtcgctccacggccgggccggaaagcaagccatgagtggcgaccaaggtcaccgacttggcgccggattcgttcagggtgcgcacggcttcgcagatagtaccggcggtatcgaccatgtcgtcgatgaccacgcagtcgcggccgtcgacatcgccgataatgccatgtgcctcggcatggttcggacgagtaatatcacgctgcttgtggatgaacgccagcggcagattgcctagcttggcggcccactgttcggacaccttgatacggccggcatccggggacacgatggtggtgttgcccagatcaagggcggaacgcacgtaatcgagcagcaccggcatggcggttagatgatcgaccggaccatcgaagaaaccctgctcctgagcggcgtgcagatcgaccgtcataatgcggtcggcaccggcggcgtggaacagatcgaaaatcagacgggcggtgatgggctcacgaccgcggtgcttcttatcctggcgcgagtagccgaggaagggcgccaccacggtaatcgacttggcggaggcgcgcttcaaagcgtcgatcatgatgagctgttccatgatccacttgttgatatcgcccgaatgacactgcagcacgaacacgtccgcaccacgcaccggttcggtgaaacgcacgtacatctcgccattggcaaagtcataggacgtggtttcgaggatttcggttcccaagcattcggccaccttctcagctagctcggggtaggcgcggcccgtgaccaatacgagtcgtttatccggagtgccttcaagaatcgccgacatgcgttcgcatcctttgtttgagtcgctgtgtgatttacgccttaaccagtgtacaagcaccccgccgcagcgaacgccacggcggggtgcttatttcgtaagagtgttgagattgccgaaatcactcggagaactcgacactgaccttattgtctttgatggtgaagttgccgttgacctccttgccttcaagcgtgtacgtcagctgggcgctcacggtgccatcggcattattggaggtctgcgagatgcgcgcgttggtgatgcgcgtgttctcgcccgaggatgccttgctggtcagcagtgcgcgctggttcgtattcacgtgaggatcggcgatggtgttggccttgtcgtagttgccggaggagatggcggccacatagctgttcgcaacgctcttcgcgctgaacacggcggaagacagcacgccatacacgataccgaacagcacgaggaagccggccacggcaccaacgatgatgaagattttcttctgttgctcattcatggtggtggaggtcgcgccaggtgcggctaccggtgccgctccgggagtgatgggagccgcgggctgcgtgggcttggccaaaacggtgggcatcgcgaaaccggcaagaatatgggcataccctgtcccgcctcatatatagactgtccaagttgcccgaagaggcggtgccggtttggtgctgcgtcatgggctaacacgcatacacactcctgccacggaacgtccgtggccgaatagtccgaaggaggtgggtgatgtctgcgcacaagtacgaactgatgttcatcgccgatcctgagctggatgagcgcggtctgaagaagctgaccgagcagtatctggaactcgtcaccaaggaaggcggctctttcgatgagcccgattactggggccgtcgcaagctcgcctatgagattgccggtaagaccgaaggcaactacgtcgtggtgaagtacaccgccgagcccgctaccagcgatgagcttgaccgtgttctgaacctcaacgaatccgtgatccgtacgaagattcttcgtaagggctgaatcaagcgtttagtcagctgaacagctggtattcaaggtaagtaagaaggaccgttatggcaggtgaaaccgtcatcaccatcgtgggcaacctcactgcggaccccgagctgcgcactattggcagcggtgcgaccgtggcgagcttcacgattgcttccaccccgcgaacctggaatcgtcagaccaaccagttcgaggatggtcaggcgctgttcatgaggtgctccgcttggcgtgatctggccgaccactgcgcccagtccctgaagaagggcatgcgcgtgattgccaccggtcgcctccagcagcgttcctatcaggcacaggatggttcccagcgaaccgtcgtggagatgcagctcgatgagatcgggccctccctgcgctacgccaccgcacaggtgactcgccagtcgtccggtcagggcggcttccagggtcgttccggtggtttccagggtggtcagcagtccaatcagggctatggcaaccagggtggccaaggtggttatgccggtggccagggcggttacaacggtggctatcagggtggtggcgctggatactcccagcagtctgccgctcccgccaacccgtccgctcctgcggtcgacccgtggagtaatgccggtgcatctgatgccggtagcttctccacgttcggcgcttcctccgatttcggcggcgacgattccgacccggagttctgatcagtacttgcctccccgctgccagcagcaatcaatatcaagatttataaggagaacatcatgtcacgtaagaggccgcaaccgccggtcaagccgttcaagaagaagccgaacccgctgaaggccgccaaggtcaccgagatcgattacaaggacgttgcgctgctgcgtaagttcatttccgatcgcggcaagatccgttcccgtcgtatcaccggcgtgaccgtgcaggagcagcgtgagctgtccaaggcgatcaagaacgcccgcgagatggccctgctgccgtacgccacctcgggtcgctgagttagggaggctttgaacaatggctgaaaccaaggttattctcaccaagaccgtgtccaacctgggccattccggtgacgttgtcgacgtgaagtccggctacgcccgcaactacctgttcccgcagggcctcgctttcgcgtggaccaagggcgctgaggctcagatcgtcgctatgaagcgcgctcgtctggccaaggccgtcgctacccgcgaggacgccgtcgccgctaaggccgccatcgagggcactaccgtcgagatcgccgccaaggtgtccgagtccggcaagctgttcggtggtatctccaacgaggccatcgccgtcgctctgtccgacaaggctgcggtgaacccgaaggccatcgaggtcgagaccatcaagaccaccggcgatttccccgccaaggtggccctccacccggagatcaccgcttccttcttcgtgaaggtcgtggccgagtgagtcattccggcctagtgctggaatcacacagaccaagagtctgagcttaagcatcatcccccgtgcggtttgcgccgcatgggggatttttgtattagcaaaaacgccggaaataggcgcgacacgccgagagttgcattcgcttcaaatctgagtatatttatcacctgttgcaaggaatacttcaacatctaaccaagcccctgtagctcagttggttagagcagctgactcttaatcagcgtgtccagggttcgaatccctgcgggggcacagacaaccggaatcgaaagattccggttttttgttttttccagtatcagtccgtagctggtgcggaaaggccgtcttcgcgcgtgacggccggacgtgtaaggagcaacgtcatgcctcagatattcacgttcaccgtatccgaccccgaaggcatgcacgcccgcccggctggccggttggttgccaaagcgcaggaatatgaatcgagcatcaccgttgcctacggtggaaaatccgtggatgccaagcgtatcttcggtgttatgggacttgatgttcaacaaggtgacgaggttacggttcgggtgcagggcaacgatgaagctgtcgctgctgcagagttcgagcgattcctcaaggagcacctgtaatgagaacgatacagggcgtcagcgtatccgctggcattgctatcggcacggtccgcgtgctcgccgccgtagattatgccgtagaacgccgcttaatcgacgacccgcaggccgagatggatcgattccgcgcggcccgtgacacggccgtcgctcagctcaagcaactgcgtgacaacgtcgccgctgagttcggcgaaaacaaggccgaactgttcgacgcccatcggcttatgctccaggacccggactatgcggaatgcgtcgaaggtttgattgcgcaagacaaggtgaacgccgaattcgcggtgaagagcgccgccgaacagttcgccgccatgttcgctgcgatggatagctcgaccatgcaggctcgagccgctgatgtcaaggatgtttctcgccgcgtgatgaacgtgctgcaaggcaaacgcgatagcacggcgcaggatggcagtgtacaaggcgatgctgtgcagaacggtattgtgcagaacgggatcgcgcagaacggcgaaagccacatcatcttcgccgaagatcttgctcccagcgataccgcgcagctcgaccgcgctaaggttttgggcctcgtgaccgccaagggctcagcgaactcgcacaccgcgattctggcgcgcacgatgggcctgcccgccatcacaggtatcggcgacgcctttgacccggccgatgatggtcacgttgccgtaatcgacggcaccagcggtgcggtattcgtcgacccggacgaggccacgctgaccgaataccggcgcaggaaggccgaggctgaggagcacctaagcctcctgcggaagctcaagggcaagcccaccgaaaccaagtccggtcagcgggtccacctgtacgccaacatcagccgtccctctgacgcagccgccgtgctggccaacgatgctgagggcatcggcttgttccgcagtgagttcctgtatctggaacgcgaggactggccgaccgaggaatttcagttcgatgcatacggacaagtcgcacaggagatgggcgaccgtccggtcatcatccgtacgctcgacatcggcgcggacaaacaggtcgactacttcaatctgagccacgaggataatcccgcgcttggttaccgggcaatccgcatctgcctgacccgcccggagattttcaaagtccagttacgcgcattattgcgcgcctcagcatacggcaacatcgccattatgctgcccatgatcacctctgtgcaggaggtacgcgacgccaagcggattcttgaagaagccaaaagcgagctgcgcggcgagcgcatcgacttcaacgagagtatccagatcggcgttatgattgagacgcctgcgtcggtcattatggccgacgagctggccgccgaagtcgatttcttctccatcggcaccaacgacctgacccagtacacgctggcctgtgaccgtcagaacccgagtctcgaacgctttgccgacccgcattcaccagctgtgctgcgcatgatccagatgactatcgaggctgcccatcgtcatggcatctggtgcggcatctgcggcgagcttggcgcagacttgagcctgaccgatacgttcctgcgcctaggaatcgacgaactgtccgtctcgcccaccagcgtcctgcccctgcgcaacgtcattcgcaaccactgagattcaaggtcgcttcggctgattccgatggctttttgggcattgcattcggctggacattcgacatcgcatcttgccggcatttcgtcgtggggcaaagtgtacaatcaccacgtttgctttcgcgcccagcgtaaatcgcgtcgccggctccgcgaacggatttccagtcacacagaatgccgtgaacagtcagccatgcctgttgcgcggcgaagagaaaagaagaagcagtggattatcctctctttaccaagctggccgccgagttcttcggcaccgccattctgatgatcttcggcaacggctccgtggccaacgttgagctcaagaacaccaagggccaccacgccggctggctgaacatcgccatgggctacggcttcggcgtcatgttcccggtgctcatgttcggtagcgtctccggcgcgcacatcaacccggccatgaccatcgcccaggccgtcaacggcctgttcccgtggagcgacgtgctgccgtacatcgtcgcccagctgctcggcgccctgctcggccagctcatcgtctacatcacttactacccgcactacaaggagaccgaggacgccgaggcgattctgggcaccttctgcaccactgacgcggacaaccagaaggtcaactacttcctcaacgagatgttcggcaccctggtgctcgtcttcggcgccctgtgctgcctgtccctggcttggggcaagcaggattacgccgccgcctccatcgtcgtcggcttcattgtgtggggcctcgtgacctccatgggtggcccgaccggccctggcctgaacccggcccgcgacctcatgccgcgtctgctgcacgccatcctgccgatcccgcacaagggctcctcccgctggggcgaggcctggatcccggttgtggccccgattgtcggcgccattatcggcgcttggctgttcgtgttcttcttcgccagctgattcgttgattgattcatatatgcaaatggcctccgctcgttttgggcggaggccattgtcgttgaatcaggtaaacgcagagactactgctccaggaacacctgcggggccttcatgaagttcgtggcacagtgttcgccgcagaagtaataggacttgccctcatactcgcgcgtgatcgcatcggcgttcacagccacggtcatgccgcacaccgggtcggtggcggtttcgccgtccgcgggggcggtgtggtgcatgtgcattcccgtatccatagtgttctccttgttggttggattattggattggtcagatacgtgattggtttgattcagcgtggtgcgatcgtcgatgatgacggtcggctcgtgaggcgcgttggatgtggcggagccggtgatgttggcggcgttggcggattcggccgatccggctgattcgacatccgccgtgctgctgcccgaaccggcgggaccatcggcagcacccacgttgatgttcgctccatgcagccggttcgcgttcagcaccaggcacactgagctcaacgccatcgccagacccgcgatcatcgggctcaacagccagccggtgaacgggtagagtacgccggcggccaccggaatgccgatgacgttgtagccgaacgcccaccccagattctcgcggatgttgcgcatcgtggcattggacaggttgatggtcttgatgacgccgcgcaagtcgccgctcatcaaggtcacgtccgccgactgcatcgccacgtccgtgccggtgccgatggcgatgccgagatccgcctgagccagcgcgggggcgtcgttgatgccgtcgcccaccatcgcaatcagagtgcgggattgtgcggccgtgcgggaggtgccgtacgcggacttggcggcggcctcgtcgcgttcgcgctgcagtttggcgatccagtaggccttgccgtccggcttgacctcgcagatcaccgtatcgatgccgacttcgcgggcgatgcgcccggctacctcggccttgtcgcccgacagcatcaccgtgcggatgccgcgtgcgcgcaacgccgcgacggcctcacgcgagccttccttgactgtgtcctgctcgtagctcggcttgtcccagtcggcggccgcgtccaccacgccgcgcgtgatggtgccggtcttgtcgaacaccacggtgccgatgcgacgcgcctgttccagcgccttggcactggtgaccagcacgccgttggtggcgcccaagcccagcgagaccgtcaccgacagcggcgtggccagtcccagcgcgcacgggcaggcgatgatcagcacactgaccgcagtgaccagcgcgtgcgccagttgcggcgccgggcccagtgacacccagatggcgaacgtccagatggcgatgatcatcaccgccggtacgaaataccgggcgatcttatcggccagttgctgcaccggcgccttggtcgcctgggcgcgggccaccatcgccgcgatctgcgagagtaccgtgtccgcgccgacttgggtggcgcgcatcacgcagtcgcccttgagcagcacggtggccccggtcaccgggtcgcctgcggttttggagaccggcttggattcgccggtgatcatcgattcgtcgatacgcgcctcgccggccacgatcacgccgtccgtgggcacgcgctcgccgttcttgacgatcagcaggtcgccggtgacgatggcgtcgatgtcggtgtccgtgaaatgcgccggattacgccattcgatgccgtccacattgtctgcggaagtggcgttgagcttgtgcgcggtgcgcgggcgcagtctgataagcgactgcaccgccttgccggtgccttcgcgggccttggcctccagcaggcggccgaccagcaccagggtgatgaccacgccgaccgattcgaaatacggctcgcgcgagccctccgggaacacccacggggcgatgcaggtcaccagcgaatacaggtaggcggccgaagtgcccagcgagaccagcgagttcatgtcgggggagcggtgcgccagcgcggggaagccgaccgtgtggatcggacgcccgcagtagaacatcaccggcgtgatgagaatggcctgcagccacgggttcaccatccaatgcggcaccagcgcgggattggccatatgcagcatggtgacggcgaataccggcaacgtcagtaccgcgcccacaatcaccagcttcgtcagcgccttgatctcattggcgcgttcagccgcctctcgccgctcggcctccgccgcatccacaaccggagctccaacccgcaagtctgagggagagaccccctcggcttcggccgagccgtcagcacgcgggcgaagcccgtccttatccgcaccgtccttactctcctctccctcaaccctcaacaacccatgcaccatattcatgccgcatgcaaacggatattcgcccgccggcaacgccggtagttccacgtcggtggtggcgttgcccggcagcatggcgtcaagccccagatccgcgaacaccacatgcgaagtgcattcgccggtctcctgtcgatcgaaagtcagcgtgatcggcgtacccgtgcgcatgctgatcacggcgggggagtacccgcccttgacggtgattgttgcggattggcgttcgccggaggcgtccatggccccggccgtggctttctgcgttccgaagaagaaccgcagtaccagccatgtcaatgcggccgccgctatcagcgccgtggcggccgagaagatgctgagctccataaccgttccttccccttgtttgttgtactgaacaacagtgtataccctatacccctagagggtatataatggggtgtgttcagctgacggataagtatcagggggtttgcgatgcatggttatgacgaagacaaggccaaggtcatcgcacgattgcgccgtatcgaaggacaggtgcgtgccatcacgcagatggtggaggatgacaaatactgcatcgatatcctgacgcagatttcggcgtcgaattcggcgctgaaatccgtggcgttattgctgctggacgatcatctcaaccattgcgtgcggcaggcgtcgattcagggcggcgaggtggccgatgaaaaacttgcggaggcttccgcggccattgcgcgtctcgtcaaatcgtgacgagttttaccgtcattcaccatcgatgacatactgggtaccatgtttgagcaaataggaaccgtgattatcgtcatcgtcgtgctagtggttggtgcagggcttggcctcttcgccggcttcgtgctaggccgtcataagggtcaggagatggctcgaggcgtcaaaagcgaggagctggaagaggccaagacctcgctggagaatgcgcgattcgagaacgctgagctcagtgctcgcaatgctgccgcacaggctcagattgaaggcgtgaaccagcaattggctttcgccaagtcacaacttgcccaggcgcagcaggctgagcagattcgcattcagcaggaacgtgagcgtgcagctgcggaggcagaacggaagcgtcaggcggatgctcaggccgccgaggccaagcgtgctgaacaggaagcacgtttgaaagaacagagcaaggtgctcgaggcgcttgcgccagtggccaagaatcttgataccttgcagaacaaggtcacgcagatcgaagagggccgcaagagggaaatgggcgcattgggagcccaactcaaggggctcaacgatcagcaggcccgtttggacaaggaaaccagttccttgtccgccgcgttgcgcaacaacaaggtgcgtggcgcgtggggcgaggcccagctcaagaacattgtcgagtccgccggattgctggaacatgtcgatttcgacacccaggtggtggtcacggatgccgatgggcgtacgttgcgcccggatatgatcgtgcatctgccgggaggcaagaccattccgattgatgccaaagtgccttatgccgattaccagcgtgcctgcgaaatcccggacaccgccagccccgaggatattgcccgccgcgatgatttgctgcggtcccatgccaaggcgttgcgcgagcatgtacgtgctctcggcgaaaaggcctattggaatgcctttgatgtagcacctgattttgtggtggccttcatccccaatgaggcactactgcaggccgcgctcgaagccgatcccacactgatggatgatgcgttctctcgcaaagtggcgctcacctcgccggtcacgctctgggccgtgctgaaatccgtggcctatgcctggcagcagcagtcgctcaccgatgacgccaagcagctgttcgatttgtcccgagaactgtacgaacggttctccacgctgggtgattatgccatcaaattgggcacccagattactaagacggtcagcgcctacaacaagttcgcgtccagtttggaacgccgtgtgttgcccaccgctcgcaagctgcaaaaaatcgaaccgaccaagatcatcgaggaagtaccgatcatcgaatcagataaaggcaatgtgagcgaactgtccgcccctgaagtggtgccggccgatgaaggtgatactcatctgactgcctcaggcgatagtctggagtcatgactgaatctggattccgccccactggtaccccggaccttgccgtcgcgaagagccataatgactttgccatgctggagccgcgtgaacagctagccaccttgctgaaggagcatgtggtgggccgtccgttctccgaacttgccgcggtgactttcgaccaccgtgccgccactgtcatgggccatgtactgattgacgctttggaagatgcgggctattcgattgatgacttcgatgctgttggtgccttgaccgcagcatctgtgcccatggtgtctgccatgatccaggccgccgcctctcgtggcgaggacctagatggattcgtgatggacttcgtctacccgtccatcaagggcccctccatcgaaggccgccgtgtggtgctgttggatgcttggctgtccgaaaagtcgtacgtgcagacaagctcgctggtcaccctgcgcaacggcaatgagctgagcctcgactttggcatagtggagcagctgggtgccaaggtcgtggccatcgcctcgctggtcggtggcggtgccaaagacatcaatgtggtcaacccctccaccggcgacgagcaaacgctccccttcatccaggtcttcgacgaatccgaactgcggtaaatccacctttgacgtccctcgcataaagtcagccgggctgagcagcgaagctgactaagaggaaccggtgaatagcgttatcgaggagaaagattgcacgcacccaaccagatttctttggctgccaaggcttcaggtgaaccggaattccgtgaaatcggccttgggccgtggtctgagacccatcccggtgagcctcgtcccgatgatccgacttcttcgaattatgacggtcgtttcgactcggtgctgttgaacgacggagaccgccgcaacgtattggaccgttaccgctactggaccgttgctgccattaaggccgatcttgacgctcgagggcgtcacgacttcgaagttgcggtggaaaactggacccacgattttaacatcggttccatggtccgcaccgctaatgccttccaggccaagcgcgtacacattgtcggtccacataagtggaatcgcaagggcgcgttgatgaccgaactgtaccagcacgtcgaacaccacccctccatcgccgaactggtggaaagctggcatcatcgcatcgccggtgaaatcgcctatgaacgagccaaggccggtgccgccgccatccatgcgcatgatgtggctgtggatggagacaacaagcaccttcatgagctgctggccgaaatcgatgcttgtgatgcacgcatcaaggagcttcaagccgcccgcgtcatcgccctcgacattattcccggcgcagtgccgatggaagcctatgccttccccaagcggtgcctgctgctcttcggtgcagaaggccccggattgagcgagaaggccctcgcattggccgacgatgtggtctacatctctcaattcggttccgtgcgctccattaatgcaggcgctgcggcggccgtggccatgcacgcatggattgcccaacacgccgtatcaggcgtgtagccatgcgccgacaatcctgccgcatggatcggcggtctcatcgtcaccagaaaagcggatatcaaataatgacccgagtgcctgccctgctgaaatggtctcaaagggtaggaaaatgcggtttcccgacaactgcgtgtcacatacggctcatatagttatggccatgccaacattttcacgcgaagaaatcgtgcatttgggcgatctggcccgaatcgcgctcaccgatgaggaaatcacccgtctgcagggcgaactgaacgtcatcgcagactccatcaacaaggtccaggaagtcgcctccgacgatgtgccgccgaccgccaacccggttccgctggaagcctacctgcgcccggacgtcgccgaaaccccgctcacgcaggaagaggcgctcgccggtggcccgaagaccgaggccggcatgttcgtggcaccgcgaatcctgggaagcgaggagtaatcgatgagcaacgaaaccgcaactctcgtcaaactgtctgctgccgagcaggccgctgccgtcaagaagggcgacgtcacctctcgcgagctcgtcgaagcccacctcaaggtgatcgaggctgccgagccgtccatcaaggccttcctgaaggtttccggcgatgtggctctcgagcaggccgacgccttcgacgccaagtccgccgaagacaaggccgccctgcctgagctggctggtgtgccgatcgccatcaaggacatgatcgtcaccaagggcatcgaaaccaccgccgcctccaagatcctcgaaggctgggtgccgccgtacgacgccaccgtcatcgaaaagctcaaggccgccggcatgccgattctcggcaagaccaacctcgacgaattcgcccagggctcctccaccgagcactccgcctaccagaccacccacaacccgtgggataccgagcgcgtgcccggcggttccggtggtggctccgcctccgcagtcgccgcattcgaggcaccgatcgccctcggcaccgacactggtggctcgattcgccagcccggcgccctgaccggcaccgtgggcgtcaaacccacctacggcggcgtctcccgtttcggagccatcgccatggcctcctcgctcgaccagatcggcccggtctcccgcaccgtgctcgactccgcactgctgcaggagatcatcggtggccacgacaagcgtgactccacctccatccccgaaggcccgcgcccgatggtcgccgccgcccgcgaaggcgccaagcgcgatctgaagggtatgaaggtcggcctcatcaaggaactcggcggcgacggcttccagcccggcgtcgaggcccgcttcaacgaggccgtcgacaagctcaaggagatgggtgccgaggtcgttgaggtctcggtcccgcacatcggctactcgctaggcgcttactacatcatcatgccgtccgaggtcagctccaacctggcccgttacgatggcatgcgctacggcctgcgcgtgatgccgccgaccggcgtgccgcagaccgccgccaacatgatggcctacacccgtgaagccggcttcggcgacgaggtcaagcgccgtatcatcctcggcacctacgccctgtccgccggctactacgacgcctggtacggctcggcccagaaggtccgcacgctgattatcgaagacttcaagaaggccttcgaacaggtcgacgtgctcgtggcccccaccagcccgtccaccgccttcaagttcggcgagaagatggacgacccgctggccatgtacatgaacgacatcgccaccattccggccaacctcgccggcgtgcctgccatgtccatcccggccggcctgtccgacgacggcctgcccgtcggcttccagttcatcgccccgcagcagcgcgacgaagtcatgtacaagccggccgcggccctcgaagccgcgctggaagacagctggaacggcccgatctggaacgacctcaagaccccgtggcttgacggtctgggcaagtgagcatcggaaggaaagaaacaacatcatggctgaaaaactgatgaagtacgccgatgccaccaagaagtacgatgtggtcttcggtctggaaacccacgtggagctgtccacgaacaccaagctgttctgcccggcccacatcgagttcggtggcgagccgaacaccgagctgaccccggtgagccttggcctgccgggctctctgccggtgatcaacaagaccgccgtcgattacgccatcaagctgggtctggccctgcactgcgaaatcgccgagtggagccagttcgcccgtaagaactacttctacccggacatgccgcgcgactaccagatctcgcagtacgacaagcccaccaacggcaacggctacctggacgtcgagctggaagacggcaccgtgttccgcgtgccgatcgagcgcgcgcacatcgaggacgacgccggcaagaacacccacgtgggtggcgccgacggccgtatcgaaggtgccgaccactcgctggtcgactacaaccgtgccggtgtgccgctgattgagatcgtcaccaagccgatcgagggggcgggcgaccgcgctcccgaaatcgccggtgcctatgtgcgcgccatccgcgacatcgtgcgcgcgttgaacatctcccacgctcgtatggagcagggcaacatgcgcgctgacgtgaacgtctcgttgcgcccgagcccggacgctccgtacggcacccgttccgagaccaagaatgtgaactcgttccgcggcatcgagaagaccatccagtacgagattcgccgtcaggccgctcgtctggacgacggcaaggagattctgcaggagacccgccactgggatgaggctacgcagaccaccgctggcggccgtctgaagtccgatgccgacgactaccgctacttcccggaccccgacctcgtcatgctccacatcaccaaggagcacatcgaggagatgaaggcccagatgccggaaatgccgcgcgagcgccgcaaccgcctcaagtccgagtggggcctgagtgatctgcagatgcgcgacatcctcaacgccgacgccctcgacctgattgaggaaaccgtcaaggccggtgccaaggctgccggtgcccgcaagtggtggctgggcgagctttcccgcgaagccaacgccaagggtgtgtccctcgaagagctgccgatcaccccggccgatgtggccgaggtcgagaagctcatcgcctccggcaagctcaacgacaagctcgccaagcagaccgtcgaaggcgtgcttaagggcgaaggcactccggatgaagtcgtcaagaagcacgactacaagatcgtcgaagacaacggtgccatcgaggcggccgtcgacgcggcgttcgaagccaacccggacgttgtcgagaagctcaagagcggcaacatgaagccgatgggtgtaatcatcggtgccgtgatgaaggccacgcgcggtcaggccgacgccaaggccgtcaccaaggtcgtcatgggcaagatcaagggctgattagattcactggctcccgctggtgggagctgtcgaacggagtgagactgagggtggtcgccatgtacggatgaccaccctcagtccgcttcgcggacagctcccgccagcgggagcacttatttgtagggaaattctccagttcaaatccgttagacagctcccgccagcgggagcctttattgattctgtaagaaagtcgactcagagcatttccagcgttcacccagtcgagtaagatatgttcggcactggaccgtgagccgaaacaagccgaaccgggggacgtataccgatgaccgcaaccaacgagacgctgagcatggctaccgaagcgcaactgaagcgcgatctgccacagagcatcgtcattccgccaatccgtggcgaaatggtgcacctgcgccccgccaccgtcgaggacctgcctcgtttggatgaacttgatgccttctatggcgcatccaagatcacaggtaaggatgcggtcaccgaacgcgccatcgtacacacgtgggtccgccgctcccaggcttgggaagccggtcaggcacccgccgaatccggtgtgggtgatccggaatcccgccgcaccatcgcatgggccgtattgactgacgccgaccatgacgatgacggtcagctcgatgcggccagcaccgataatgtcatcggcatgattttccttatcgacatcgacggctggtccaagtccgcccgcatccagatcatcttgggccgtgaataccgtggccgcggctactcccgtgacgccatgccgcgtgtgatgacctacggtttcgcgcccgaaccggccggcttgggcatgcaccgcatctgggtgagcgtgccggaaaagaacagccgctcgatttcggtctaccagtcgctcggcttcgtgccgtccggcacctcgcgcgacgcgttgtgggatgccgaaaacaacaaataccaggaccttatcgtcatggacacgttggctgacgagtacgatccgattcgttcgcttgacgcttttggcatgcacttgattgaggacaacccgggtgtcaaggaagcgctgtccgcgcgcgagcattccatcgccatccagcagaacaagccggaacccgagccggcacagcgtggtgaggcagccggcgccacgacgagtgacgtgcagtcccaggcccagacgccggcggccgcacagccagtcgagccacaggccgagcaccacgacgatacgcagaagaacacgcgccacagtctcgaagaggaaagcaactggccgtacggtcaggcagaacgcaagccctcaaaggaagcatggtggcgtacgctgggccgcggccgcaaacgcgatacggaaagtgagtgagtaaacaagcatgagtgccgaggatctcgacaattacgaaaccgacgccgaactcgcgctgtatagggaataccgtgacgtcatcaagctgttcacctatgtggtggagactgagcgtcgcttctacttggcgaataaggtcgatttcaacgtgcgttccgctggtcaggacgtgtatttcgatgtgcagctgactgacgcatgggtatgggatgtctaccgttccagccgtttcgtcaagtccgtgcgcatcgtgaccttcaaggacgtgaacgtcgaagaagtccagaaaaccgatatcgacattcccgacgatattcactgacaggcaatcgtctgatacagcctgtattgacaatgcgcggcattccgtcatcttacggcggggcgtcgcgcattgttcatacaacgcatagcaaaagttcagactcgtaaccttgccatcgtgtgtcttgtttgcttgcggctgatagaaaatgctgcatgaacacacaccatatgcagcagggccttaagggctccatcgcgggcgtggttgctgccgccacattgctggccggtggcatcctgaccgttccgcacgccatggctttggaggccgatggccagtattacagcagcaagcagccatatgtggcacctagcgaagcgaccactgccagctatagccaggcgccggaaggctacgaaacggtatacaccgagtcgatggctcgccacggttcacgcggcctgtccagctacaaatacgacgcattgcttatgaagatggccgaagccgccgaagcggataacggttttaagtctgatgccatcaagtccgaattcatgaagaatctcaaagccatcaccgccgcaaatgtggagaatggctacggtatgctcaccggtcagggtgctgaccaacatcagggcattggcgcacgtgcctacgagcgcaacaagacgctgttcgacaacgcagccaaggacggtggcaagattgcctatcagtcctctggcgaagcccgcgctactgaatcaggcgagaattttgctcgcggtttcaacgcggcctcgaacaataaactggcgaacagcactgtgacgcccgccgatccggccggcaccggcgaggcggcggctttcgacaagacgccgaacacgctgtacttccacaagtccgaaaacccggacggcactgagaaaaccggtgaggccaagcagcgtgccgacgattaccagaacttcgtggaaaacgatgcgattatcgcaggcgctgagcaaaccatcgccgaaaacgaggacgtgaaaacagcctctcacgatttgctttcacaaatcttcaccgatgacttcctcgccaaactggccgacggcacgtacgcctggtacaacactgtcgatggcaccaagggcggcgaggccaactgcgcgccgggagccgaccccagcaaggatgccgacgcctgcggcgcagccaagaagaagatcgcctccgaatacgatgccgcgatggatctgtacaacctgtacatcatcgccgctgatatggagaacgagaacaccggcagccataccttcgacttcaaccagtacttccaaggtgagcaggcagacgacgccaagttgttcgcctgggcgcttgacgccgaggacttctacgagaagggcccgagctacgccggccaagacgagacctacacaatcgcacagccgctgcttgacgatttcttctcgtcgattgatgagcgcgtaaacggcggatccaccgttgctactttccgctttgcccatgccgaaacgatgatgccgttcgccgcgctgcttggccttcccggttccacccagcaggcggccgccagcaccaccgacgtgtacacctacgccaacaatgaatggcgcggtgaatcggtgactccgatggccgctaatgtgcagtgggatgttgccgtcaaatccggcaacgacccgaagaccggccgtgcctacacgccgctcgttcgtatgctctacaacgagcaggaaatcgccttccgctccgaatgcacgccgattgccgatggttccacgtggtacaagctcactgagcttaaaagttgcttggcctccgaccaccaaaccctaggcgacgatgcgcatctgactgatgattccacaacgcagccgggcacaggacctaacactggtgaaggaacgagtaccactccgaataacaatggtgcgggaactcatcagcccagcaacactcaggctaatggtacggaaaacgagttgagtcgtactggtgttgccgttactggtgttgcggggatcatgatgctgcttgcacttgcaggcatctcgctgaatctatggaaagttcgtcgctgacgaattagcctaagaccaaaccgattcgccgcgctgtgtgtgacgcaacgttgccgaatacccctacctcacgattcgatgcgtcgcctttctgctgatggaaagacggcgcatcggtcgtatatcgggagaattctgtaagcattcgctcatctttcggtgtgcgattccggggcttctagtagactgtctctgattttgcgtttataaggagcataatgaccgacaagcaatccgtagtgattatcggcggcggtccggctggacttaccgccgcatgggaactcatcaaggacggcggtgccgacaagtacgacgtgaccgtgctggaggggacccgcgaattcggcggtatctcgcgcaccgtgaagcacaacggcaaccgcatggatatcggcggccaccgtttcttctccaaagacgaacgcatcatggattggtggaagaccgttctgccgttgcagggcgcaccctcctatgatgacaagaagctcggccgcgaccacgacatggagccgggcggccccgatccggagacggaggacaaggtgatgctcaagcgccaccgagtgtcccgtatcttctggaaccgccacttcttcgattacccgatttcgctgagccccaacacgttgaaggccatgggcttcaagctcaccatggtggccggcttcagctacctgaagtccatgttccacaagctgccggaagacaatctggagaacttctacatcaaccgtttcggccgcaagctgtattcgatgttcttcgagggctacacggagaagctgtggggccgccacccctcccagatctccgccgactggggcgcccagcgcgtcaagggcctgtccatcatgggcgtgctcaagaacgccttccagaagctgctgcccaagaagcgctccaacgcggaggtcgagacctcgctgatcgaggagttctggtatccgaagtacggtcccggccagctgtgggagaccgtcgagtccaattgcgaggccgccggcgtcaaggtgctgaccgacgccagggtggtcgaggtccgccagaccgatggtgccgtgtcttccgtggtgtacgaggattccgagggcaaccgcaccgagctttccggcgaccagttcatctcctcgatgccggtcaaggacctggtcaacgccatcgacgcggccggcgccgatcccgaggccgttgattccaagcccgccccggccgatatgaccgaggtggccaacggcctgccgtaccgcgatttcgtgaccgtgggcctgctggtcaagcacctgaagctcaagaacaccaccagcatccccaccctcggcgatccgccgatcgtgccggactgctggatctacgtgcaggacccgggctacaaggtcggccgtctgcagatcttcaacaactggagcccgtacctggtcaaggacgtggacgacaccgtgtggatcggtctcgagtacttctgcgaggagggcgactcgttctggaacatgagcgaggaggatgtcaccaagttcgcgatttccgagctcacccgcatgcgtgtgatcaacggtccggacgaggtcatcgactcccatcgtgagcgcgtcaggaaggcgtaccccgcctacttcgacacctatgagcacatggacgagctcatcgagtacctcgacggcttcggcaacctgtactgcgtgggccgtaacggccagcaccgctacaacaacatggaccactccatggccaccgccatggaggccgtcggcaacatcaagaccggcaagacgtccaagaagaacgtgtggtccgtcaacaccgaaaagtcctaccacgaagaaaagtgaataaaccttgttgagctccctcgtcacagagggagcttttttggttttcggcgggccgttttgcgttggtcgagttggcgttgtacagtgaacgaagttcgcagagactcagagacgcagcgaacattcatgagcggtgcaaccgcaataatcactcttaacgcctggataggcatgggtctgttcggtatggaaagggcaaccagtggcaaatagccagaatcttgaggatatgaagctgcctgagctcaaagagctcgctaaacagatgggcctgcgcggcacgtcgaccatgcgcaagcccgagctgctcgccaccctgcaggcggcgcgcaatggtggagagccgccggccggtgtgaccgtgcgcgcccccaaggccgccaaaaccgccaaggtcgtcaaggctccgcagtccgatgccgctgaggccaacaccacagacaatgctgacgtggccacccagtcgccggctccggctccggctgccacggaaccgcagctcgatttgccgcttcccgtggccgacgatgccaagaaggacgagaccgaaccgcgacgcacccgtcgtaaggccgccgatgatgccgcatccgaaccgcgtgcggcccgccgtcgtcgcgatgacgaccagcccgatttcgctcgccgcaagccgcgcaagaaggccgatgaggccggcgatctgctggccacgctcgatttgggagatgcagcgcctaccgagcgtcgccgcgagcgtcacgaggacgtggaagttccgctgattcgccgagtccgtgatgatgaggacgagcagcctcaccgccgtcgtcgcactgcggaaaacagcgaagaaaccgtgcgtgacctcgacgatatcctggccacgctgcccacgcagaagcacgaggaaacgtccgaagacggcgagcagaacgacgatcacgagttcgtgcgtcgtaaccgccgcgaccgtagcgatcgcaacgatcgcgatacccgtaatgatcgcagcgatcgccgtaaccgtcgcatgcgtggccgtgatcgcgacaacgccgatgatgatcgtcgctatgatgatcgcgataatcgtagcgatcgcaatgaccgtgatagccgccgcgaagagccgcaggaggatctggtgccggtggccggcatcgtcgacgtgctcgactcctacgcttttgtgcgcacttccggctacctgcccggcccgaacgacgtgtacgtttccatgggccaggtcaagaagtacggcctgcgcaagggcgatgccgtgcatggttcgattcgcgccccgcgtgaaggcgaccgccgcaaccagcgccagaagttcgtgccgctgcaggccatcgattccatcaacggccaaagcgttgaagaagcgctcaaccgtccgcagttctccaagctcacgccgctgtacccgcaggagcgtttgaagcaggagaccgccccgaacaagctcaccggccgtatcatggacatcgtttccccaatcggcaagggccagcgtggcctgattgtctccccgccgaaggccggtaagaccatcaccctgcagaacatcgccaactccatcgccgccaacaaccccgaggtccaccttatggtggtgctcgtggacgagcgacccgaagaggtcaccgatatggagcgcacggtccagggcgaggtcatttcctccaccttcgaccgtccggcctccgatcacactacggttgccgaactggccgtcgaacgcgccaagcgtcttgtggagctcggccaggacgtggtcgtactgctcgattccatgacccgactggctcgcgcttacaacatcgcagcccctgcctccggccgcatcctgtccggtggtgtggacgcgcaggccctctacccgccgaagaagttcttcggtgcggcccgcaacatcgaaaacggcggctccctgaccatcatctcatctgcgctggtggaaaccggctccaagatggacgaggtgattttcgaggagttcaagggcaccggcaacatggaactgcgcctgtcccgcgagctggcggacaagcgactgttcccggccatcgacatcaacgcttccggcacccgccgcgaggagctcatcaccaacccgcaggaactgccgattatctaccgtctgcgtcgactgctgggcggcatggagcccgagcaggcctaccagacgctggtgccgcgcctcaagaagaccgccaccaaccgcgacttcctcgccgccatcgtgcagcaggccaacaccggcaacgcggtcaacggcaactgatcagaccgctgaacaatagtgtaagggctgcaccctgattgatacggggtgcagcccttgtcgtatctgatgcaaatacatcaactatcacattgcagttgtagtattgccgtcaacgttcacatgcacgctgacgatatatgagatgaaagaggcatcactgggttcgattgttttgggagtgggcagtggtgcggccatgttcggcgatgcggatgccagccatatcctcaccggcgactatgacatctgagatatctgactttgcgcatcgtgcaaagccgtaatcgggagtatcctcgaatctatgagcgaaacgagcagcgactggcaaaggaccaccatcgactccgcccaggcggcggcccacccggaaaccgcacaagcggtggcgcgcatcaaagcgctgcgccaaaccatcgataacatcgattcggcggtcatcgcattactggccgagcggttcaaggccacctcgcaggtcggcgtgctcaaagccaacgccggattcgcgcccgaagacaccaagcgtgaggactatcagatcgaacgcctccaccgcatcgccatcgatgccgggcttgatccggaaattgccgaaatgtaccgtgaattcgtggttaccgaagccaagaagcgccaccagcgcatagccgatgccggtggtgacccgggcgtactcgacgtattcgcctgattcgcccgcagcgaatgggcacctttcggatattcgtctatagggcaagttgcctgcagcgactacattaatacgggaatggaatgcccgtagtggtcgactgtatgaatgggatacgtagatgagatgtggtgccgcactggtcagttgcgcattgtgcgtggcttcgattctcggcggtgcttggatgtctcgtccgactccggttgattacggtccggtgctcgctacggcaagtgatatgtacgccgtcaccgatgccgaaggggagccggtccgttggtatgtggtagggaagggcggcgccggcaatggcgccagtgccgattccggcaatagcggttccactgataccgattccgccaatagtaattccggcacgtccaaggtttctcgtatccccgcttccgccgccaccctgccatggaaagtcagcgtcacctactcgcttgacggtccgaacgtcgaggcaaacgaggttgccggcgcgtctggactgatcggcgtgtatatcgatattaagccgcaaaccaaggaagccaaccgtacgatcccggttgtcgcctttaccgtgcctacgcaggtagccgatgatgtttccgctgacaactccattacggtgaccacgcaaggttccaataccgtagtcgccgcagctggaaaagccgcaaccggcttggaattcagctgctatatgaacgccaaagacttctccatgagttccgtggcgctcgccgtattgccttccaattccagcagtccggcagttggtgctaatcccgatgccgcgaatgctgcgaatgctgccgcacagcctgctgccgatacggatgtcgcccaactcaccgcctctgccgccacactggtcgattcactgaccgacgccggttctggtgaacagcaacagctcatcgagcagcttcaaaccctgcgcgataacgaacgtgcgctgaacaagtctgtagtggccgaacgcgaaaccgcccataagcggacgtttgaagactatatggccgcgtatgtgggctcatataccacgcacctgtctggatcgattggcacctccacccagttgccggcgttgatgggcacggccggcgaactgtccggggacacgcctttggctcaagccgtactcgacttggccaacgcggtgaacaacgtcagtgccgcacatcagcatgccggtgcggtcgatgcgttggacgaggtgattcgccgcatccagcagcaaggcaccaccggactggtggatgatctgatcgccgaggcttcggaggaagccactcaaggctccaagcaatacgccgatggccagagccagctctccgccgcaatgattccgtattcgatgaaatacacggacgtttacacggccaatttgagcgccctgaccggcggcacgtcctcgggcgccaccgcttacgagagccaagccatcgccgaaaccaacggtagcgatgaactcgccgacgctcaatccaaggtcgatgccgcgatgagcacgcttgccaccgcctccgagcatacgggcaaagccacggccttgcgccagattgtattgcgattctccgatcagttcgaaggcggcgcgtcctcggcttccggcagtgatggtgatggttcgtccggtgatgtctcttccgatccggtgaccgaggctcaggcactgaccggcctggtcgattcgcaatcgcaatcgttctacggcaagacccgggtcgcccaagccaagcgtaaggccgatgccgcccgtaagcaggccaaagccgcgcaacagcagcagtcgcagcattccaaggcctcactggtcgatgacaccatgtccatgtctgctggcgatgtgatgaactatgcgggtggtcttacttcggccatcggtggtggtgataagtccgactcgtctaagagcgctggttcgggaacgaacgactcagccaagtcgagcgacactggcgattccggcaacggcaaggcctccaacgccagcgattccggcaacaatcttgacaccgctccagtactgttcggctttggcactggcggcacgctgttcaagcacgatatgaacgcgctgattaatgagaccgtgaaaatcagtgatgctggcacgctcttggcgcaggccgtcgcgcagctcgacagccccaatacgcaacaaaaaaccgccgaaacccgatatctcatcgtgattccgacggtgtgatggtgtatgcgggatatttgcgtgccgtcccacagtcgtgtcatccgaacgtcaaaaaacaaaagaggggaacctcaataggttcccctcttttgttgttgtgcgtaacgttcagtgctttggcttcttagctggccgagccgttaagcgggaagcccggtgggcttcccgtaggctcggaacgagcggcattgccgtgagacctactgttgttgtgcgtaacgttcagtgctttggcttcttagctggcggctcaccgagctcgctggcttcgacggcgacctcggtttcgggcgtgccttcggcggcggattcctcggcgtgcttggccaccaagtcgaacttgccgaccacgcgaccggcctgcgcgatatcgcccaaggcggcgtgaatcgcttccacaccttccgaagcagcggacagtgccacagacaggattggggtcttcatggagaccttggcctcggacttgatcttacgcagctgctccacggccttgccggcccaagtcagcagctcgggggaagcaccggtggcggcctcgacatacgggtccacgaccggccaggcggcgcgatgcacggaaccggaaccggcgtgcatccagctccacacttcctcggtggcgtacggcaggtacggggccagcagacgtgcgaaggcgtccaggcccagacccagagcggtgcgggcggacttcacagccttctcggacggcacattgccgtgctcgtccggagtgccataggcgcggttcttgaccagctcgatgtagtcgtcgcagaactgccagaagtaggactcgatgacttccagcgccttggaatgctcgtaggattccagcgcctcggtggcctgacgcaccaccaaagccagcttggccatagcggcgcgatccagcggttcggtcacatcggccgggttccacgcggcctcggcggcagcgcccacgtgatggttctcgtcctcacggccgatggccagcgcgaacttggtggcgttcagcagcttgatggccagtcgacggccaatcttcatctggccgatgtcgtacgtggcatcgaggcctaggcgagcggcggcggcccagtaacgcacggcgtccgcgccgaacttctcgatcggctcgttcggcaccacgacgttgcccttggacttcgacatcttcttgtggtcggggtccagaatccagccggacagcgtggcatgggcccacggcaggcacttgttctccaagtgcgcgcggtccacagtcgagaacagccaggtgcggatgatgtcctgaccctgcgggcgcaggtccatcgggaaggtggaagcgaacagggccttggaggcctcgtccggctcggcccagtgggtcacgatctgcggggtcagcgaagaggtggcccaggtgtccatgatgtccttttcggcggtgaaaccaccgggcacatcacgctgggactcgtcgtagccctccggcacgtcgatggtcgggtcgatcggcagacgatcctcggacggagtgatcgggtgatcgtaatccggctcgccggaagcgttcaccgggtaccacagcgggaacgggacgccgaagaagcgctgacgggagatcagccagtcgccgttcaggccgtgcacccagttctcataacgcacgcgcatgaagtcggggtggaactcgagttccttgccacgctcgataagctcggcgttcagcttggcgtcggtaccgccgttcttcaaataccactggcgggaggtgacgatctcgagcggcttgtcgcccttctcgtagaagttcgtcatacgcttggtcggggtcggctcgccgtccagatcgccggactcgcgcagcttgtcgacgatgatcttgcgggcggagaacgtggtcttgccagcggtttcggcaaagacctcgcggccggccgggtcctcgatccagtccggggtatccatcacgatacggccgttgcgctggatgatcgggcgggtgggcagcttcaggtcgcgccaccactcgacgtcggttacatcaccgaacgtacagcacatggcgataccggcacccttgtccatttcggcggccgggtgcgccagaatcggcaccttgaccttgaacagaggggagtagacgtactggccgaagtactgcttgtagcgttcgtcgttcgggttggcgatcagcgaggtgcaggccgccagcagttcggggcgggtggtctcgatgtagatcggggtgccgtcctcaaagcggaaggccaccttgtggtagaagccggggtattcgcgcgattcgagctcggcctgggccacggcggtctggaaggtcacatcccacaggccgggggcgtcctgctggtaggcctcgccacgggcgaggttgcgcaggaaggccttctgggccacacgctgcgggtgctgaccgatggtgtggtaggtctgcgaccagtcgatggacagacccagcttgcgccacagggcctcaaacagcttctcatcctgagcagtcagacgctcgcacagctcgatgaagttcttgcgggaaatcggcacctgatccttggcgtcaatcttcttgccatcagtgccttcaaacggcggcttgaagtccgggtcgtaaggcagagacacgtccacgcgcacgccatagtagttctgcacgcggcgctcggtaggcaggccgttgtcatcccaacccatcgggtagaacacgtcgtagccgcgcatgcgcttgtagcgcgcaatcacatcggtgtgcgtgtaagagaacacgtgacccacgtgcagcgaaccggagacggtgggcggcggggtgtcgatggagtagacggccttgcggtcgcgggtgttgcggaatttgtaggtgccgtcttcatcccagacggtgcgccacttgtcctcaagtccgtccacgccgaccttgtcgggcagcggggtgaggttggcgttgatgatggatttgccttcagtcataaggccaaagtttatgcacgttgcatgacaagccgaactgtacagtaaacagcccagtaggctgttcgcaggcgaggtacgaacgatcgaacgatagtgagccaaggactatcgggcgtagcccgtccgtgactgaaggttgcctacttcaccgtcaacccggccagcggcatgcggcgattgatcatcgaggtcgggtagccggagaccttggtggacgccacagtgaagcatttgcgggtatacagccaatcactggccgcatcctcgctgatcagccgggcgtacgccttcattcgtgcctcataatcggcgtcattagtggcggcgcgagcatccgcataggcctgttgcgcttcggtatggtcgtaatggaacatggaatcggggtcggcgaatatgccggcatcatccgtgccgtccatgctcatcacggtcagttcccatttgccgtccttgattcgtttggcataatcctcatcggagagcacttcaaggttcaccgtggggcgcggctgccgctcgatctgctgcttgatggtttcggccaacgaccggtattcttcgggaaccaccagattcaccgtagtcaggtattgcgcaccaaagtaggagaacatctgcccagcttggttttcgtcatgcgggtacagtccggtcaaatcttcgtatccgggttccagcaggctgatggggccgcccaatgctccggctgcgtcgggttgggcggaggcgatgccggctgcgtcgatttgatagcggaaggctttacgcgcctgttcgtcggagagcagcgaatcggtgccgttgttgtaggccagcagcaccttatccgtagtggccccctccttgacggtcaggccatccttgccgttcaagccggtggccgtcgaagccgaaaccggtgccgccatatcgagactgccgtcggtcagggccttgctgagcgcatcggcgtcggagtattgcataaattcaacgacattgctggccgctttggtgccatggtaggtatcgctgcgcgccagcttcagggaatggccaggctggaaatcggccacggtgaatggtccggaacctatggccttgcgttgataatcggcactggacgactcggaatcgtagacaatgccgagtctgccggacagcgctcgcagcagcgtcggattgggcttggcaagcgtaatgaccaccgtggtggcgttcggattggcgaccgacgccagatcgcccaattcgtcgacgtccgccaccttgttggtcacgttctgttgcaacgaccacacggcgtccgaggcgtccaacgtatggccgttcgagaaggtgacgcccgattgcagtgtcagggtgacggtcagtccgtcatcggaagtcttccagcttgtcgccagtcccggctgaagcttgttgtcttgatcgacggtcactaatgtctcatacacattgtcgacgagcaggcgttcggctgccgcagaggaatcggaccgaatatccaaggattgcggcatatcgtcgatgccaatggtcacatcggcatcgagggatgatcccggctggaaccggttttgcatgaacgtccatcccacaaccacgagtgcgccgagtgccacggcgactccgagaaaaatcccccacttggaccatgtattgtcccgcttgctgtgctgcatggttttcagtctagcggtggattcagcctagaatccgcaattcaccatgatgaggtatgagttagcgcttggacgtgctcttgccggcgggcggcgcatagctagggcaggtgtcggacagcgggcagttggcgcagtcaggggtacgtgcgtggcaggtggcccggccgaacagaatcagtcggtggctgagattcgtccactcttcgggcggaaaacaggaggtgatttccttctcgattttcacgggatcggggtgtgcggaccgccaatccgaccgccaacgcagtcgtccggttacgcgcatcacatgcgtatcgaccgggaatccggggatatcgaacgcgttgccgagcacgacgttcgcggttttgcggccgacccccggcaagctggtcagttcatccatcgtgcgcggcaccacgccgccgaatcgttcgtccagtgccgtggccagtccgatgagatgctgggttttcgaacgatagaaccccagcggatgaatgatgtcttcgacttgggccgggtttgcggccgccaagtcacgggcggtggggtaggtggcgaacagttccggggtgaccgtgttgacacgcttgtcggtggtctgggcgctgagcacggtggcgatcagcaattcgagcggattcgagaaatgcagtgcgcaagcgggtgccggaatcacctggcgcagaatgtcgtattcgtcatgcatgcgcgtgagacgcgcggatttggtttctctcatcgtatggacctaagcggcgtaatatcgatgattgatagtttgcagcgccgctggtctgtcaggcgacggtgttgagatcgggagtatcgtcatcggtgtcgatggcggcagaggatgctttggcggcctgctgtgcggcggcagtttccttatccgtctccggcgggtcgaatcggtagcccacgttgcgcacggtgccgatgaggtgttcgtattcgccgccgagcttggcgcgcagacgacggatatgcacgtcgaccgtacgagtgccaccgtagtagtcgtagccccatacttcctgcagcaactgggcgcgcgtgaacacgcggccggggtgctggaccaagtacttgaggagttcgaactccttgtatgccagatcgatggggcgtccatgcagggaggcggtatagccgttggtgtccacaatgaggtcgccggagcgaatctggccatcttccaccgtggtggtggattcggcgggagaaccggctgctgcggctgcgggagcgttgccgcgctcggagaccaatcgcaatcggccctcgacttcggccggggaagcggtggcgaccaccacatccgcaatgccccactgggagttgaccacggtgaagccgccttcggtcagcaccagcacgattggcgtggacaggccggaagcgtggatgaggcggcacaaggttttggcggtcgccagatcatcgcgtgcatccagaaacagaatggtgttctccggcatcttcaccaagctggctgcatccatcggcagtacgcggacgcgatgagaaagcagggcgagtgatggcaaaacggtggcggggtcgctggcgaaagtcatcaacgtaagatccgtcacgctaatcccccttatcctgcaatgtgttacgcaattgctcggtgtggctgtacgagtcgtcagcggcgttatgccgctttcgcacggttttcattattctacgcgcttgtagtggacacataggttacaagtttgcggaatatggaacggtggacgtccatcaaccgatgatacggccgagcaccagtgcggttgcggcgatggtcacgcccatcagcattaccggcatcaggccggtaccgatccacggataacggatatccgggtccggatcggcgtcgcgcacccacaacgtggaagccacggccaaagccagtcccaaaacgatgaggatgatcagggcaacggttcccgcaacggtgcccttggcgagcatcgcgcccaaatcaggtaggaagcaccagccggccacggcgagagctgccacaccggaagtcacggcgtgagagagtgcgcggataagatgttcgcgcttctcacgagccatctggcgtccgaaggagaagaccaccagcaccaccagcagcaggcccatggccagtgcccatgaataccaaggaagtaccgagccatccgcagcggtctgatccggcggaacctcgctggtcgggaaaggtacgatgacgaaaatcagagaaatcgcgccaaacaccaaagtgacgatacgatccagtatgctgccgcggaacggccagaatacgacaaatgcggccaacgtcagagcggcgataatcaaagggatgatggggacggtgccaggggagggaatgaccgtggctgcgatgaacagtacataggacgtcagttgggccaacaacatgctcagagctttgttcttccaaccctcctgggtgatctcggtcatgatacgcctctcagataatcgaatttctatcccaatcctacgtcgggcattggaacggtgaaatcaaacaaaatagccccttctggtgaaggggcttatggcactaaatcagaacgcgataacgcccaaatgctccaatagcactttgatgccgagtagaatcagcaccacgccgccggcgatctgcgccggcttctgccagcgggaaccgaacgcgcggccaatgtgcaggcccgcagcggagaacagtccggtgaccacaccgatgctgaggatggcgaatgccatatgggctttggtgaacatgaaggccaggctcacgcccacggcgaacgcatcgatgctgcaggccacggccaggggaagcatatgcttccaatcgaactgggcggtctccttggagttttcctcatcttcttcgaaggcttcgtgaaccatgttgccgccgatgaacaccaacagggcgaagatgatccaatggtcgaattgggttacgtatttgctgaatgtagatgccgcgaaatagccgagaatagggaacagcatctggaatccgccgaaccagagggtgcttttcacggcgtcttgtactcgtacgcgggatacggtcaggcctttgccaatggatacggcgaatgcatccatagctacggaaacagaaataagcaggatttgaatgattatcgaaatcatggtgtgacagaaggttcatcgccggattaccgtgcgatgggcctcgaccagcgttcctacacgccgcctacgcctagttgaaaagacaaaacattactgtatcacaaaatacaagctccctctgttggggagctggcgcagtgaaactgcgactgagggagagtagagcggctttgccacaaatacaacaaaaggcccccgaaggggcctcctgtcaacgattcagaatcgaatcacttctcggaatcggcgagacgctgacgcgcggcaatgatttccttttcggcggcgtcagcaccagtccagtagtcgcccggcaggacttccttgcccggctccagagccttgtactgctcgaagaagtgcttgatttcggccttgtggtactcgttgacgtcgtcgatgtccttgatgtcatcgaaacgaacgtcggcgggcacgcacagcaccttgtcgtcgccgccggcctcgtcgaccatgtggtacaggcccacggcgcggcactcgaccacgcagcccgggaacacggagttcggaatcatcacgagagcgtccagcggatcgccgtcctcgcccagggtgccgtcgatgtagccgtagtcatccgggtaacccattgcggtgaacagggtacggtccaagaagacgcgaccggtctcgtgatcgacttcgtacttgttcttggagccgcgcggaatttccacaacgacgttgaaggtttctgccatgtcatttctccttgaaaatcgacagttacgttatcgtctcaccacaataccctgtttacgcctgcaaaacaggtgcggaactcaagaaaccgtgctgagattatgccgacactatgcccaaacagacgaaatcctccccttgaggggaggatttctagcggtttacgcgcacgataaacccatgcacgtcaacggcatcactgttgcattaccgttgcgtaccgcatcactgcacggacaggatgtgggccacatccgcccaaggagccagagacacgtagttgtcccaaccccactggaattcgcggccggtcagctcgtcgcgcacgttgagcgggcggtcggtgggcagacccagctcgctgagttccaggtgaatcatcgactggtgtgcgttgtgtccatcgaggttcacgaccacaatcagcgtgtccgcttggccggtaccggtcagttcggccggcgtgtggcgtgcgaaagccagaatattcgggtcggacgtaggcagcacggtgaggttgtggtagctcaacgcggccgggtgggcgcgacgaatcttgttgagtgcggtgagcatctcggccacgccgtactgcttggccttgctccaatcgcgaaccttgacctcgtacttctcgttgtcgatctgctcttcgaagccggggcgctgcttgttctcgatgagttcgtaaccgttgtagataccccaggacggcgagcccatggctgccagcaccgcacgcacgcagtggccggctacgccgttgtctcgcacgtaagcggtgagaatatccggcgtggtgggccagaaggtgttgtgctggtagtagccgtcgtcgccattggtgaccggcagatactcttccagttcgtccttggtgttgcgccacgggaagtagcagtgggactgggtgaagcccacgtagctcagggcgcgcatcatgcccgggcgggtgaatgcctcggccaggaacaggatctccgggtgcttcttggtcacggcggcaatcacgtcctgccagaaacgcaccggcttggtgtgcgggttatcgatgcggaagatggtgacgcccgcctcgatccacagattcatgatgcgttcgacttctttttcgatgccgggcatgtcggcgttgaagtcgatcgggtagatgtcctgatacttcttcggcgggttctcggcgaaggcgatggagccgtccggcttgtggcggaaccagttcgggtgggccttgacccacgggtgatcgggcgagcactgcagggcgaaatcaagcgcgatttccagacccagttcatgtgcacgctggcacagggccttgaaatcgtccatggtgccgagcagtggatccacggtgtcgtggccacctagctcggagccgatgccgaacggggagcccgggtcatcggggccggcgaccagcgtgttgttgcggcccttgcggttggtcacgccaatcgggaagaccggcggcaggtagacgatgtcgaagccctcggcagcggcgcgttcgaggccggccatcgaagtcttcagcgtaccctgaatgatcttgccggtgttcggatcgatggtggcgccttcggaacgcgggaagaactggtaccaagccgcgaagctggacttcgggcgttccaccttgaagcgctggggctggctgggggagatgccgtcgcgcagcgggtgagtctcgtgcagggcggcgatggtcgggttgtcgccggcggcgagacgatcctcggcgctcagcgtctgatcggccatggtctcagcggccttctccaaggtcttgcgatcgcgtgcggtcaggccggtgtccggggtttcggcccaacgggccagcaactcggcaccggaattgagtgcgttgtccacgtcgtccatcacacgcaccttgatgcgggcgtcgtgcagccaggagacgtacgcgtcttcccaaccttcgatggtcacggtccattcgccgagctgacgcttgacggccgcgtagccatcctcccaaggcttcagatcgctgtgctcgccgcacttgaccatcacggtccaacgatcgaggccgggatttacgcaggtcatggcccggcgcatggtttccttgccgcgcgggttgcgcacgatggcggtggcacccaccttggtacggccttcgatgaacacctgggcggtcatctcaaacggttcgccgagttccacacgggcggggaagatgccgcgctcctcggcgggagtgatgtccatgacattgatgcggccgaactggccgggctcgtttgcttcgatggacggtgcgggggcttcgacagccaggcctttcagcgctgctgcggcgcgtgccgtttcggcgctgactctcttgcgcttggttgcggggctctttcgggcagaagtcgcctttgacttcgttttcgtggtgctgttatcggtattactagtgcgcgtggtcgcgcgatgttgtactgctgccataaggccctattctaagggcttttgaacatatgttgcgcattgtggataactatcaggtaaacgttcggtcaaccgcatgaggtggataactcggcggaagagttatccacaactcgccggcaaacggcaagctcggaccacataggtcgaaaaaccggctgtagcgaatgaaaatctgccatgatcgtggcctacccgcacacagtgcagtatgcggggaaacgtaccaggaaaggacgaatgatgataacgacatggcggcaacggggcatggccatcgtagcgatgctgaccggtctgataataatggtgggagtggtgttcggctcggcgaatacggcgtatgccgcgacgttgacgcccgccgacgaaagatatcacgtggcgtttccatacaacgatatggaatattacgtcggtgtcgcggggctggacgcttcgggcaacaagtactactgcatcgaagcggggaaactgagcgactatgtgataggccccaccacggtgcttgcctccgatgagaacgcccggcgtatggcatggatccttgaccggtaccgcgacacggatgccgccacccatgcggcgatcggcatcatcgtgcaggatcacttcgggcgcgatcgggacgagtgggcgagacagatggcggtcattcaaggccggtaccccgagatcgtggcgaaggcggcccggatatgggatcaatcggccggcaagacgcctgcgggcacgacggtggaacgcaccgatgccgaggctttgcgcagcggttccatctcggtgaaagtggtgaaccgcgccggtgacgcgatcgcgggagtgccgttcaccgtcaccttgcagggggcggcgcggttcgtccaaggcggcaacacgttctcgggggtgtcgacgatcgccgggtcctcgatcgcgtgggaggcgaccggcgccggcgaggtgacggcgaacaccacatacgagtatgggcggatgcacgtcatggacagcactcaggacatgctggcctttgactcgatggcttccactggcggcgcgtcgacgacatttcgggtgcgtaaggattttgttccggcggtatccaccaaggtctccgagaaggtgcttgatgtggcttctccggtgttcgatgacgtgaccagtggcgtggcggatgcggacagttattgggtgcccgatttggaattgcaggcccgcggatactatttcgatggtcttgatacgggcgatgtgggcaatgtcattacgccgaatgcacaagagagcgccgatgcttttcttgcgcgattggcgactttgggttatgagccggtggcctatggcaaggcctctttcaccggggtggggcagcaggcacgtgtgcaggccatgaccaagccggatgacggtgccgcttaccggaccaagcagaatagcggttttggcacatgggtatgggtgtttcggcggtccgagcagagcaaacaggcgcaggaataccttataggcgactggataagtccgtttatggaggctacggaaagcaatacaagtcgcaggaagctagaagtcatgtcgacggtcactgagcattcggcggatatcggtgccgagctcagcgacaccattaccgtatcgggattccctgcggatcatggccagtatgccggcaacgaagagtatgagttcgcggcggatcggccgtatgcgacggtgagcgtatggtggtccggcgatcccgacaacccctccaacgatgaggcgtacaagccatccgggggagaggttcccacggaagacgacaaccaccggttgctggccacctgggagattcccgcgatgaacggcacgttcaaaatcggcgccggggcgttggacgcgcatggcgctcctatgtatctgaccgccgaacggcctgggtggtacgtgttcgtctggcggttcgagggggatgaccgtgtttccccggcgtccagccggtatgacgatgcctgggagcgtgtgcgggtgttgcccccatgcgagtcggagaaaccgtgcgaaccggagaaacccgagacgccgccggcgccggcggaggcaaccacgcccaaccctcgcccgtcactgcccgtcacgggtggcgatgtgtcgcttgcctcggttctggccgtgtcagctctggcgataggcgccatactgtccatcgtcgttcggtggcgtcgtcgctatgaccgattcaagcactggacgatgcgctggccgatacgttgacccgctgcggcatgatgccgatgatgtcggctggatggtgaaccacactccgcttctgagcagaagaacgggagctgggcacgaagtcgatcgtaacatacgacttgtgcccggcttccgcttcgttgagaaacttcacgcctgtcgcctcccgtggattagacaactgaagatccgcgatgaaaatgacgagacgtttatgatcgccgacttccctgggcaccgtagctgcctgatcgcctttcatccatatcgccacggtaaacggaaaggccgctgatttcggtaccgaaatcagcggccatataaccacgttcgtagcggggcatggatttgaaccatggacctctgggttatgagcccagcgagctaccgagctgctccaccccgcgtcggcttgtctctcagacagctctatctacaataggtgcagattccagaaagtcaacatcggcgtgtcgcgtcatcttcccgcggttttaaaacgtgaattggctcacgcagcgaggggtttggggcggagtcggagtcggggtaataacgcgccataaatggccgttataggaatgccctgaaccgttatcccgaatattgacataataggaacatgcctatcaagatccccagtggcctgccggccagagatatcctcgattcggagcgcatcttcgctctggagaagcccgaggcggagcgtcagcgcgtccgcccgctcaaactggtgatcctgaacttgatgcctaagaaaatcgagactgaaacacagctgctgcgtctgatttccaagtcgccgctgcaggtcgaaatcgacttcatgaagacctccacgcatgaggccacgcacgtttccgccgatcatctcgtcaagttctacgaaaacctcgatgcgttcaaagacaactattacgacggttttgtggtcaccggcgcgcctgtagagcatatgccgttcgaagatgtggactactgggacgagttcaagacgattctcgactgggcctccacccatgtgttctccaccatatacctgtgctggggtgcgatgggcgcactgtactaccgctacggcatccacaaggtggattaccccgagaagattttcggcgtattcccgcagtacctgcaggacgaatactgcttcctgaccaatggcttcgacgagattgatctgcagccgcactcccgcctcgccggcgtgaacgaaaacgaggtacgtgccaaccatgaccttcagatcttgacttgggggccgcagtccggcccgggcctgatcgccacgcgtgacttctccgaagtgttcgcgctcggccattgggagtacggcaagtacacgctcgccgaagaatacgagcgcgatatggccaagggcatgaccaacgtgcccttcccgaagaactacttcccgcatgacgatccgaagctggaaccgttgttcgcctggcgcgcccacgccaatctgctgtggcgcaactggctcaactgggtgtaccagaccacgccgtatgacctgaccgaggtgccgcagctcagggctgagaagaagctcggtactgatcgttcgattcggcatgagccgggcgggccgcgccaggatgatttcaagccgtttgtgcatgacgggtatggggtgattcagggctgagcctacgatctcccctcagtcgcctacgacgacagctcccctcgacggggagctcctttgcttctccttcgcggctcggcccatcagagggagctactgttggaggttgcgttcgtagcgtggacggttgttcgtccacgatgtggacggcttgatgaacgtaatgccacacatccgcgtaatgcgaccaatagtgcacaacgttcgcgaaacgcccgggaaaaccttgcagcagtagggatttcaggagactcgccggtataatattgacattgtctagacgcaggcaaataatcactcttcagtcattcggagccgaatgcccagcgcagactccgtgtccatgcccggcagactccacaccgaggagacaaaaaaagacgaaagtaacgagcacgtcacatttgcctgcccggtgggtttaaactgacacctgacattgaagaagcaggaggcgtgatatggtcggttcgctcagcgcaggattgctgttggctgacgaggcaggcgctcatctgccctcggttgatgacttccttcccccggagattctgttccagggaactccgtttgccatcaaccgcattattttgattcgtatcgtggcaaccatcgtgctgttggtggtgctcggcgtgaccgcaaagcgcgccaagctcatccccggccgttggcagggcgtagtcgagtacggtctcgacttcgtgcgcgacaaggtcgtgtatgacgtgatgggtgaggcccgtggcaagcgctacgtgccgatgatcaccaccctgttcttcacgatcttcattttcaacctgtgcggcatcattccaggtatgaacatggcggccaacgccacggtggtcatgccgctcgtgttcgctgtctggacactgatccagtactggatcgccgccatccgctcgcagggcctcggccactatctgcgccacgagctgttcacccccggtgtgccgtggccggtctatttcctgctggctccgatcaacctgcttgagctgttgatcatccgcccggcctccctgaccatccgtctgttcgccaacatggtttccggccaccttatggtcgccacctgcctggcgttcgcacagttctggatggttgacgcggtcaacaagctgcagggcatcccggtgggtgcgctgtggttcgccggtggtttcgccatgacctgcttcgaggcgttcgtcgccttcctgcaagcctacgtcttcgcgattctttccaccgtgtacatcaacctgagcttcccggaagagtgacgggcgactaacccgccgcttccggtccccggtctgggaaaatcgcagaccgaccaaaccccaagatttataacgtcgccaagtacgttagaaaggaaacacaatggatatcatcaccctcgcagaggtcgccggcaacctgtccgtcatcggttacggtatcggtactcttggccctggcattggtctgggcatcctcttcggcaaggccatggaatccaccgctcgtcagcctgagatgtccggcaagatccagaccatcatgttcatcggcctggctctggtcgaggtgctggcactgatcggcttcgtcgccgccctgatcatctgatctgcgcagatcaacagacgaaaaccgattatgtccatcactgaaaggagggcttgatgacacaagcagcaagcgggattgacctgttcattcctgaggtttatgacatcgtatggtcgctgatcattcttgtcatcgttgcggtgttcttctacaagttcttcatgccgaagttcaatgcgatcttcgacgagcgcgccgccaagattcagggcaacatcgccaaggcggagcaggctaggaaggacgccgacgaggccaaggccaagtatgaggcccagctgagcaccgcccgtgtggacgccgccaagattcgcgacgacgcccgtgcggaagcgtcccacatcatcgccgacgctcgttcccgcgccgagtccgatgcggcccagatcaccgcatccgcacagcgctcgatcgaatcccagcaccagcaggccatcgtctcgctcaagggcgaggtcggcgcacttgccaccgccctggccggcaagatcctcggtgccaagctggaagacaacgacgtgcagtcctcgatgatcgattcgatgatcgacgacctgggcgccaagaagtgaccgtgaccatccgtaaccagaaagggaggtgaccatgcgaggagaggcatcacgtattgcagaccgcgagtcgcgtgattcgctggccccgaaactgcgcgacacccgtgaggacgcgtggcggatcggcaacgaactgttcacgatcaccaaggtgctcgatgacagcattcagctggagcgcgcactgaccgacccgtcccgcccggttgccgacaaggtggccgtcctgaaggaactgctcggtgacaacgcgcatccgatgaccatggagatcatgactgacttggtctcccgccgttggagccgtgcgcgcgacatcgccaacgcagtggaagacttcggcgtggacgccatgatgtactacgcggacgccactgacgccacgctgcaggtatccatcgagctgtccgagctgcattccgcactgctgaacctgccggtcgtacgcgccaagctgtacgactaccaggccaccagcgaggcccgtgtgaagctgttccgcgaggtgttctctggcaagaccctgaacaaggtcaccatgaggctcgccgaacacgccacttgcaacctgcgccgccgccgctacttggagaccatccagtggctgatcaacaagttctcccgccacatgggcgagtcgatggtcaccgtgaccaccgccaccccgctgaagaaggagcagatcaagcgactggtcgaggtctactccgccaaggtgggccgtcaggtgcacatcaactcggtggtcgacccgaccgtgctgggtggcatgcgcatccaggtgggcgacgaagtcacggacaacaccgtggtcgcacagctgcagaacttgcatcgcaaggtgcagacggaggcgactccggcctgaccggccgagccaatccgtccaacaccacacacaagcaaagacttgactgaacaataaccaatagaaggagtgatcatggcagaactgaccatcgatcccgcctcgattcgcaaggccctcgacgacttcgtgtcgtcgtacaagccgagcgacacccccacccaggaagtgggctatgtcgccacggccggtgacggcattgcacacgtgacgggattgcctggttgcatggccaatgagctgctgacgttcgaagacggcacgctcggcctggcgttcaaccttgacgcccgtgagatcggcgtggtgatcctcggcgatttcgctggaattgaggaaggccaggaagtgcgacgcaccggcgaagtgctttccgtgcccgtcggcgacggctatctcggccgcgtcgtggacccgctgggcaagccgctcgacggcctcggcgagatccagggcattgagggtcgtcgtatcctcgaagcccaggcccccgacgtgatgcaccgccacccggtcgacgagccgctgtccaccggcctcaaggccatcgacgcgatgaccccgatcggccgcggccagcgccagctcatcatcggcgaccgccagaccggtaagaccgccatcgcgatcgataccatcatcaaccagaaggccaactgggaatccggcgacccgaagaagcaggtccgctgcatctacgtggccatcggccagaagggctccaccatcgcctcggtgaagcagagcctggaagacgccggcgccatggagtacaccaccatcgtggcctccccggcagccgattccgctggcttcaagtacatcgccccgtacaccggctcggccatcggccagcactggatgtacaacggcaagcatgtgctcatcgtcttcgatgacttgtccaagcaggcagaggcctatcgttcgatttccctgctgctgcgccgcccgccggggcgtgaagcctacccgggtgatgtgttctacctgcactcccgcctgctcgaacgttgcgccaaggtctccgatgacctgggcggcggttcgatgacgggtctgccgatcgtcgagaccaaggcgaacgatgtgtccgcctacatcccgaccaacgtgatctccatcactgacggccagatcttcctgcagtccgatctgttcaacgccaaccagcgccccgccgtggacgtcggtatctccgtctctcgagtcggtggcgccgcacagaccaaggctctgaagaaggtctccggtacgctgaagatctccctggcacagtaccgttcgctggaatccttcgccatgttcgcctccgatctggatgcggcttccaaggcccagttgacccgtggtgcccacctgaccgagctgttgaagcagccgcagttccacccgtactcgccggaacaggaagtcgtgtccgtatggaccggcacccacggcaagctcgacgacctcgacctgaaggacgtccttccgttcgagcagggactgctggactacatcgaccacaacaccgatatcctcaagaccattcgcgagaccgaggaattcaccgccgacaccgaggctgccctcgataaggccgtggacgagttccgttcgacgttcgtctcttccgccggcaagccgctggtcgagaagaagccggacgttgacaaggccgcgccggtcgatcaggaaaagatcgtggcgggagaaaagtaagccatgggctcgcaactcgcattgaaatcacgcatccgctccaccgagtcgttggcgaagatcttcaacgctcaggagatgatcgcgtcttcgcatatcgccaaggcccgtgatgtggccctgaacgcgaagccgtacaccgatgcgattttcgatgccgtgcaagcgttggtggcccacacccatatcacgcatccgatcgcggtgaaggacgagaagaacccgcgcgtggctgttctcgccctcacctcggatcgtggtatggccggcccgtacacctcttcgattatccgtgaaacggagtcgctgctgtcccgcctcgatgcggcaggcaagcagccggagctgttcgtgtacgggcgtcgcggttcgacgtactacaagtaccgtaatcgtgacatcgcggcgacgtgggaaggcgacaccgaccagcccggcgtggaaattgctgaaacgatctccaacaccttgatggacgcctacatgaagccggctgagaagggtggagtttccgaactctacatcgtctacaccgagttcatcaacatggtggtgcagaaggtgcgcgtgctgcgcatgctgccggtcgaaatcgtgaaaaacgagaccaaggtgcccgatcctgatgaagaggcaccggctactgcggatgtcgctccgctgtacactttcgagcccagcctcgaaaaggtactggatgcgattctgccgaagtacattcagtcccgtatccacgagtgcctgctgaccgcggccgcgtcggaaaccgcaagccgccagaacgccatgcacacggcaaccgacaacgcacgaaacctgatcgacgaccttacgcgcaagctcaacgcttcccgccaggcctcgatcacccaggaacttaccgaaatcatcggcagcgctgacgcgctgaccaagaaggaagagtaggaacgcatatggctgacaaccagaccactgcggccgagcctaccaacggtcgcgtcacccgcgtccagggctcggttatcgacgttgaattcccggtgggtcatctgcccgacatctacaacgccctgaaagtaacgatcgtcaacaccagcgccaaggaagaaggcgaggcgaaggagaccgagatcaccctcgaggtcgaacagcacctcggtgattccacggtccgttgcgtcgctctgaagcccaccgacggcctggttcgtggtgcctccgtctccgacaccggcgccccgatctccgtgccggtcggcgacgtgaccaagggccacgtcttcgacgtgtccggtaacatcctcaacaagaagccggatgagaccatcaccgtctccgagcgttggcctatccaccgcaacccgccggccttcgatcagctggagtccaagacccagatgttcgaaacgggcatcaaggtcatcgatctgctgaccccgtacgtgcagggcggcaagatcggtctgttcggtggtgcaggtgtgggcaagaccgtgctgattcaggaaatgattcagcgcgtggcccagaaccacggtggtgtgtccgtgttcgctggcgtcggcgagcgtacccgtgagggtaacgatctgatcggcgaaatggccgaggccggcgtgcttgagaagaccgcactggtcttcggccagatggatgagcagccgggtacccgtctgcgtgtcccgctgaccgcactgaccatggcagagtacttccgtgacgtgcagaaccaggacgtgctgctgttcatcgacaacatcttccgcttcacccaggccggttccgaggtgtccaccctgctgggtcgtatgccttccgccgtggggtaccagccgaacctggccgatgagatgggttccctccaggagcgcatcacctcgacccgtggtcactcgatcacctcgttgcaggccatttacgtgccggccgatgattacaccgacccggccccggccacgaccttcgcccacttggatgcaaccaccgagctttctcgtgacattgcctccaagggtatctacccggctgtggacccgctgagctccacctcgcgaatcctcgatccgcgttacgtgggccaggctcactacgactgcgccaaccgcgtcaaggcgattctgcagcgtaacaaggagctgcaggacatcatcgccctgatcggtatcgacgagctcggcgaagaggacaagaccaccgtgaaccgtgctcgtaagatcgagcagttcctcggccagaacttctatgtggctgagaagttcaccggtcgccccggctcctacgtgccggccgacgagaccatcgaagccttcacccgcatctgcgacggcgtgtacgacgacgtcccggagcaggcgttctccggcatcggcggcatcgacgacctcgaagagaagtggcacaacatgcagaaggaactgggtgcgtgatggctgcggaaaaaaccacgatgaaggtcaacatcgtcgccgctgaccaccctgtgtggcacggcgaggcgacgagcgtgaccattcccgcctctgagggcggcatgggcatcctgcccgaccatgagcctgtgctcacggtgatcaagcagggtacgctcaccgtggttgagcccgatggcgatcgccacatgttcgaggtgaccgacggattcatttccttcgactcgaacaaactcaccgtggcggtcgagcgcggccacgacgtccagtactccggcaccgccgagtgacctgaaccaactccttaaggggctctctggttttccagagagccccttttgctatgtatgccatgtgttgcgctacagtggtggcctatgcgagttattgttgccgactgttcggccgagtattcgggccgcctcaacgcctcactgcccctggccaagcgcgtattgctgatcaaggccgattccagcctgttgattttctccgaattgggctcctacaagccgctgaactggatgaccgcgccctgcacgattcgtgagatcgacccagccgccaaatccgcgcaacattcccgggaaagtgtcgctggtggggctgtggatggtgattctgcgacgcattccccggaaagtgtcgccgctggtgagccggaaaaggtgctacgtgtcagcgccgacaagggttcggacattcttgaagtgacgctgcagcatatctattccgaccgaacctatgatctgggcgaagatccgggtctcatcaaggatggcgtggaagaccatctgcagcgctatctggccgagcaaatcgagcgtatcggcaagggagccaagctggtgcgtcgcgaatacccgaccgccattggcccagtggatattatggccgtgaatgccgagggcgagcatgtggctgtggaaatcaaacgtcacggcggcattgatggcgtcgagcagctgactcgctactgcgaactgctcaatcgagatccgctgctggccccggtgcacggcatcttcgccgcacaaaccatcacgccgcaagcccaggtcttggccaaagaccgcggcttcacctgcctcatcctcgattacgacgatatgaaaggcaccgaggacgacagtctcaggctgttctagatatagcaggggctccctcatcagagggagcccctgctatatcttttagtacgcggcgagaatatcgattacgaagaccaacgtggagttggcgggaatcggaccttgctccttatctccataggcctgatccggcggaatcaccagcagaacctgagagccgacggtctggccgaccagacccttctgccagccctcgataacctgatgctggccgctggaatcgctgaacagatcggcgtcgattgtggaatcgcgatcccaggacgaatcgaactgcttgccattcgtaagccaaccggtgtacttgaccaccacggtgttcttgtcggtcagcttggcgccgttacccttgatcagcgtctgcgagatcagcgaatcaaccgaaccctgaccgttcatgtcgatggacggctcgccgtttttggctcgcgtcaccttcggcagattggccggcacatccttgacttcctcgccagtggccttctccaagtccttggacttggacacaaacgtcatcgccagaatgtaagagtacccggacgaatcctgagcgttgacgccaaagccaatcgtggtgttgatcttggcacccttgatctggttgtagtaggtcgaggagagggtcttggaatccaccttcagcgagcaatccggcgtgttcttggtccaggtgtccatgagctcggttccgtctttaacgttgagcgcgatgccttgggcgcagacgcggtcgccctcctcgatcacgtcgccatcgcccttctgcagcaccacataagagccgtcggacacggtcatcggcgtattaaaggagatggtcggcttctcgccgagcttgcccttggcggtcacgccggcaatttggcccttcttgtcagaagagtcggaagatgaagaggaatcggaagaagaggatttcgagtccgagctcgaactggagcaggcagccagcgacacgcacatcgccagcgagcaggcaagggcaacggccttgccgaggggagataacatagacttaacagacttacgcatgacacatcaccctactggtaaaccttgattttctgcgctcctaggtaataaacaggtgaagattgtagaatggttgagttatgagtgctgaagaacagactacaagaccggataagggcgccaagcgtccatcccgtcatgccaaaatcatgcgtggagtggtgacgcctatcttcggactattggccgtggcggctgtggtgttggggtacatgaatgccacgatgtggaagccctccactgaaatcaccgcttccgcaaccatgagcggctcccggtatgtcgtcactgatccgaatgtgctgaccttgttggatcagaatgccacgataaccgtggactcgggatcctctcaggacgaggcgtgcgtggcgttgggttcgtccaaggatgttgccggatgggtcgcgcccgagaagtcctatacccgcatcaccggattggcatcatggagcgagctgagcacccagaagggaagcagcacgagtcagggagcgcctaccagtgccgatgacgcggtgtcgttcaaggattccgatatgtggactgccgtgaaatgcggcactgggtccgtttcgctgaagagcaagaagaccggcgcctcgacggtagccattgtggatttgggcgaaaatgtcaccaacgccaaggtgcagctgcactgggtgcgctccgaagtgccggactttgcgatgccgttctatctgtccggcggattgctggccgtgctggccgtactgtgcgcctccgtgttcgccatgccgccgcataagcgccgcaagcgcatggtggaaggcatggcaagcgccgtaatcgaggaagaggcacccgccagcatcgcagtgtccgggaagccggatggtgcaagtcgacgtaatcgtcgccgtcacgccacacatcggcgttcgggccgtgcgtcctcgcaatcctcgcaatctgaagccaccgaaacaccggttatcatcgacccaagttcgcgtaacctggtcgccgaccagcagaccggtgccgaaagcggcgctgagcccggcctcagcgccggcgataacgaatcgacttcggtaatcacccctgacgaactgcaggcctacttctcccgcttggcccaagaggtcaataccggagacgactcggccgatgacggacaggaggaaagctgatgaacaagcgatggaacaaactgtgtgtgtccgccctcgcctgcatggcgttggtcgtgccgttgaccgcctgtgaaggccaactgccgacgccggctgctgatacctccaccaaggttgcgccggatttgaccgaggcgcaggagaagaagattcgtctgaagattctcaagacgatcgatgaagccgatcaggccaagaatcccgatgggtatgcgaccgttatgggcgggccccagctggacattcgcatcagccagaccacgatcaatcagcgtggcggcggtatgtccgaatatgcgaccattcccaaggacatcgcccagacggtgattcctacggacgacggatggcctcgctcggtgttcaccatcacgaccaccaccgaagatcagcagtccaagcgtttgctggtcttcgatcaggaatccgcccagcagaattacaagctgatggctatggctcgactgtttgagggcgccaagctgccgaagttcgagattccgactattggctcgcagatgggcaccgcaaaggatgagaagctggtggccgctcccgccgatgccttggcccaatacgccgatgtgctgcagaacggctccaagagccaatacgcttccaagttcgcagacgatttgctgcgccaggaactggccaataccacggccaaggtgcaggaaggtatgcaacgcaacaacggtacgcaggagcaaaaattcaccgctgtgcctgaacagatgtgggtgatgcgtgctgcagacggtgccggtgatctggtggttggccgtattaacggcgaatggactcgcaaggcaggggatggccgcgaatcgcggccggcttccgacgacgagaaggcgctgttcaatagcgacaagtacaccagcaccatgaaggtcacgtatgtgaacgtggtggccttgtacattccgttggcaagttccggtgagcaaatcaccgcagtgggcgccgaccgtcagccggtaaaggtcgaagcgctgtaattgttgccgccacccaccgcgcggttaacgcccccaccacgatgtgattcgtccaccacgatgtcgataaaactttacctttcgcataatggtgccgtttggggtcacatcgtggtgggcgttttgctacgtggtgggaattccaccgcgtagtggaagaatccctacgtggtgggaatcggcattacaatcaatgtcagcaaatgtgattgttgttgtacgcgaatcgcgtggaatcgggaggcattatggcagagcagcagttcaatccgggagtctcattggcgggcgccgtcgatttggaggcgctgaagcatcaggtcaaggccgagcccggacaagcgggcggcgcgcctgccgctggtgggtacgtgatcgacaccaccgaaaacaccttccaggcaatggtgcagacttctgcgaccttcccgatcctgctgcttctgtgggtgccgaccgatgaccgcctgttcccgatggcccgtgcactgggcgacgcggtgaacgccctgaacggccagattcagctctcccgtatcgatatctcgtccaatccctcgattgcccaagcgctgcaggtgcagggcgtgcccgcactgttcgcgttgattgccggccgtccgatgccgctgttgcagggccttccgggtgacgacgagctcaagcaacttactgacgaggtgattccgaagattattgaggccgccgcgcagtctggtgtgaacggtaccgcgccgtactcgggtgatcctgattccgatgccgccaagagcgctggtgccaccggtgccgtcgcgggtgctgagcaggtgccgccggagcatgccgaagcccatcgtttggccgaggagggcgattacgccggtgccgccgccgaatacgagcgcgtgctcggatccgacccgtccgatgcactggccgcccgcgaacgtgcgaaggcgctgttgctggcccgctccggggccgctgatgtacgtgatgtacgtgccgctgccgccgcagcgccggacgatgtggaagcgcagttggccgtggctgatatcgacatgattggtggccagattcaagacgctttcgaccgtttgctggactttttggccgccgggcacaaggccgatatcgagcaggttcgcaagcgtctgctcgaatacttcgccatccccgaacccaccgacccgcgtctgacccgcgcccgtcgtcgcctagccaccctcatgtactaagtggttttggctcccctctttgagaggggctgtcgtcgtagatgactgaggggagctcacgagcgtactcgattgctcccccctaaaccatccgattcttcccgaaatactgctggaaccttggcccctccagcgccagctcctccttgaaatcatccgcccacttacagaacggacggttggcgagaccatcgttattgaatcgcgcctgatcggtgatttcggtgatgcagaatttcggaatcgtcagattggtaaccggcccggatcgttcggcctcggctacgatgagcggcgcattcggcccgccgaacacatccacgctccagccgtcttcctcaatccacacggaataccggttcttgatgattaccgagccgccgcgcttgatgagttcggccgcgatacgcgtatcgatttcgcgctcgacttcgtagcgcgtgccgcccacggacggacctttgacggtgacatatgcttccgagaaccggtcgcggtattcgtccagcacggccaccggatttacgtcgggcgtcatgtcgacgtgaaccttgcgcgagaccagccgcacgcgcaaggcgtaattgtcggcatgcacgtagtagctctgaatgatgagggtcggggcgtcgccgtcgtcgtattccgccggcagttcgcggcagaagaagcggcgttcgtattcgaagtcatctgtaggttccgacataaccccattgtagagccgataatggcgattttctcgttattttggcgacgtatgtgccgcatgcaacgtgatgtggtgtacagtaaagaagttgctcgggtttgtagctcagtggatagagcgtctgtctccggaacagaaggtcgtgggttcgatccccatcaagcccaccagcatggctttcggctaaccgccggaagccttttgcatattcggcgcgtgcaaggctggtgctggtgtcggcaatggcaaggccggtgatgccggctcgcttgggtcgtggaaaaaccgtccggtttggcgagaacggtagccgaatcgtctggaatcgtctggaatcgtctggaatagcaaggaatagtctgttgatggccgtatgccgggcatcatgcgcgctaaacgcgactttgctcagtagactgctacgtaatcggcattgccaatcgttgctgatcgtgcgattggtcgtagccggtggtgatgtgtaccggcgccggccgcagcaggtgggcgcccccaagatgagaaggagcacaatatgagcgaaaagatggaagccgtagccacttccgaggcgccggccgcgctgggcgcatacagccaggcggtgaaggccaatggcttcgtgttcgtatccggccagctgggcattgatccggccaccggcgaactggcgggcgagaccgctggagagcaggctgcacaggcgctgaagaatattaagcacattctcgacactgccggtaccggcattgagcatgtgtgccgtgccaccatctacctgaagaacgtcgaggacttcaaggaagtggacgcacgttacgctgaggcgttcatcggctccgtcaagcccgcccgcgtggcctttggcaacaacatgattcccaagggtgcgctcgtggagatcgacgccatcgcggtggagtgattcgaacgtttccccggcggcccgtctgcgcgcatggtgtgtgcagacgggctgccgcgtattgtgcgacgcattccggggaatgtttcgctgggcgggggtgcgaggtgtggttccgcgacgcattcccgggaatgttgcgctggaatcgttgggcggtggtccgtgccacaatagagaccatggcatccaaaggaaaaccgtcgccgcgttcggccgtaagcccgctgagtgatgagcaggtcaagcgtctggccgcccgccacacgcttgtggactcgacacagtattacccgaccggcccccgcacgcctaatcagccggaaatcaacgcccagaatcccaaggccaccaaacgactgctgggaggggtgtccattgtgttccgcgccagctgcaagaccaaggcctggggcttggaacaggtgccggaaaccggaccgttcatcaccgccgccagtcatgtcaccatgtttgatgtgttcgtgccaatgatgagcctgttccacatgggccgccgcccccgttacatggccaaggccgagatggcgaagtggccattgatcggcaagtggttccagttggtcggcatgcagccggtgcagcgtcattcgggcaaggccaagcagatcgaagagacctcgattgatattctgacgtccggccgcccgctgacggtctggccggaaggcaccgtgacccgcgacccgaaaaagtgggtgatgagcattaaggagggcgtgggatatatcgcccttgaatcctcgcgcagactggggcatcaggtgccgctgtacccggcggtgacgtggggtgccgcctccatcaaccactggtggccatggccgcgcaaaaacgtggtgatgtgctatgaccatgcgctcgattactccgatctgcttgccgacatggactcatggggtgaagagccgcctgccgaggccgtgaacgagctgatgtggcgcgtgctcaaacgcatgaacacagtactggaggaaattcgtggcgagcagttccccgctgaaggctactgggactaccgcagtatgagtcgtaagccttggcctgaagccggcggcccgttcccggctgagaagtagccgcaccggttcccgtacggggagcctaggcgagtagcatggcacaagattgtgccgatgaagttgcgcgacaagcgaaggtaggaatttgatatgggtaaaaatataacggttctcggtgcaggagcatggggtactgctttcggccaagtgctggcggacgcaggcaacacggtgaccatgtgggccaaggagcagcagattgtcgagggcattcgcgatcaccaccacaacgccgtgcgcctgccgtccgtcgaaaagttgccggacaacatgaccgccactggggatcgcgccgaagccgtcaagaacgcggacatcgtagtcgtggccatcgccgcgcagttcgcgcgagtggcactcgtcgaattcaagggactgattcccgatcacgccatcgtcgtcagcctgatgaagggcatcgagcgtggcaccaacaagcgtatggacgaagtcgtccgcgaatcccttgacttgccggccgaccggttcgccgccatttccggaccgaacctgtccaaggaaatcgccgatcgtcatcccgccgccaccgtggtggcttgcacgaacctcgataatgccacgaaggtggccgaggcatgcaccacctcctatttcaagccgttcgtgaccaccgacgtcatcggcctggaaatgtgcggcagcctgaagaacgtgaccgcgctggccgtgggcatggcccgtggtgccggctacggtgagaacaccgcagccatgatcgaaactcgtggactggccgaactgaccgcgctgggcgtagccgctggcgccgatcccaagaccttcttcggcttggccggtgtgggcgatctcatcgccacctgtggctcttcgctgtctcgtaactatacgttcggcgcgaatctcggcaagggattgacggtcgaagaggccaccaaggtcagcaacggtgtggccgaaggcgtgcccaccacggatgcggtggtggctcttggcgatcagcttgatgtgccgaccccgttggcgtatcagatgagccgcgtgctgaacgaaggcatttcctgctcggagatgcttgccggactgttcggtcacgaggttaccggcgaataacgagagaagcgacgtatacgtggcgtatacgttgtacgtgcaaagtcgcgtggcgtatacgtcgttgacgtgcacgagtagactggtgtgcgtctcttgtgcgcggcgttccgagcgcggttcggtccggttggcggtgcaaagcataggcttgaaaacggttgtagtttcaacaaaaggatggttatggccaagaagcgtgttgtggtgctctatggtgggcgtgcagacgagcattcgatttcctgcatctccactgccggtgtgctgggggccatggacactgaacggttcgagccgattccggtcggcatcaccaaggacggcaagtggatcatcaatggcgaagatccgcgtggctggaacttggacggcggcgagctgccgaccgtaaagatcaccccggaatcgcgcccggtgatgcttgacccctctcgcggacaggacggtttcttcatcggcgagcccagccacatcaattccgccgattccggcttcggcaccagcttcgtcagcatgtccgacccggaaatgcaccatgtgctgacctcccttggccatgtggacgcggtactgccggtgctgcacggcccctatggcgaggatggtacggttcaaggcctgctggaaatgatgggtgtgccgtacgtggggtgcggagtgtttgcttccgccgcctgcatggataagcattacaccaaggtggtactggatgccgccggcattcccaccgcgcccggtgtgacggtcgatgcgcgcaacttcaccgccgccgatgtgcttgccgagatcgaggacgccggtcttacttatccgctgtttgtcaagccttcgcgcgcaggctccagcttcggtgtgaccaaagtcgagaaagccgatgaccgcgagacccagcaggatcgtctggccgccgccatcgccaccgccggcgagcacgactggaaggtgctcgtcgaacaggggattgatggtcgcgaaatcgaatgtgccgtgctgtgcccgaaggccggtgacgagcccgaggccagctggcccggcgaaatcgtgctcgatcatcagaacgacgaccagttctacgatttcgactccaagtacatggatgcctccgccagccacgtggaagtgcctgccaatctgccggtcagcgtgcttgaggacgtgcgtgacgtggcccgtcgcgcgttcaaggccgtggatggtgccggcttgagccgtgtggacaccttcgtgacgcctgatggcacggtgatggtcaacgaaatcaacaccatgcccggcttcacgccgatttccatgtatcccaaggcttgggatgccaccggagtgagctacaccgaactcatcacgcgattgattgagggcgtgctgaggtaagtgtggtgcggaatcggccgcaggccggttccgctattgacacatcgcccatacctgtcagtaattcatgccaagttttcctaagttcaacaggcgtacagcaaatggcgaacgcaattcacttgcgcgccagtgtcaggacagattaggcgcatagtttcttttcttggattcacgggccgcgcgaatgccgcgcataccaagcccgactccccagactgtcgtctggatgatgttgagaaaaggaacattatgaacaacctgcgtaagatcgcggccggctccctcgccgccgtgctcgcgttctcgatggccgcctgcggctcgagcaacgcctcctccgatggcaccggcgaaagcaccggcaaggccgtcaccgtgaacgaaaagtccgtcaaagccacctccctcgccgacttcggcaccatggaagacctcgagaaggccgccaaggaagagggcgcgctgaacgtcatcgcccttccgcacgactggtccaactacggcgaggtcatcgagagcttcaagaagaagtacccggagatcaaggtcaccgagctcaacccgaacgcctcatccaaggaagagctcgacgccgccaagaccaacaagggcaccgacgccgcccccgacgtcttcgatgtcggccaggccatcgccgccacctccaccgactacttcgccccgtgcaaggtgcaggcctgggacaagatcccggacaccgccaaggacgccgacggcgcctactacgccgactacaccggcatcatgtccgtgggctggaacgccgacaagtacggcgacatcagctccctggacgacctgctcgacccgaagttcgccggcaccgtggccctcaacggcaagcccgccgaggctggcgccgccttcaacggctacctgatggccaaccagctcgccggtggcgacatcaacaacctgcagcccggccttgactacttcaagaagctcaaggaagccggcaacctgaccaccgtcgacgtgaccaacggcaccatcgactccggccagaccggcgtggtcttcgactggacctacaaccaggcctcctacaagaaggagctcaaggacaagggcgtgaactggaagtacaagaccttcccgaaggcccaggtcgtcagctactacaaccaggccatcaacaaggacgcgccgcacccggccgccgcccgcctgtgggaggagtacctgtacaccgccgacgcccagaacctgtggttcaagggcggcgccaacccggtgctgctcgattccatgaaggaagacggcaccgtcgaccaggccactctgaaggacgccatcaccatcgaaggcgagccggtctcctacaccaacgacgactccacccgcatcaccgagtggctccagaacaactgggacaagacgatcggcaactgaggcacagaccgatgaccgccgcaatcgcacccattgcatcgaacggacctgctgccgccaaggctgcgggtccgtccgctactcccgcttctcctctctcctcggcgatggccaagcaccgccaggagctgggcacgctcgccaccacgctcccgttcttcgcctacaccgcctgcttcctgctcgcacccaccgtcatcgtgattgtcggtgcattccaggatcgcagcggcaacttcacgctcgcgaacttcaataagatgttcgaggccaacaccatcgccgcattcggcacctcgattctggtgtctttagcatcctctctgatcggcgcagtggtgggcgcgctcgcttcctacgcactggtcattggtgccaagccgaacggcctgctgcgtcgtatggtctccgccatctcctccgtgcttgctcagttcggcggcgtgatgctcgcgttcgcgttcatcgccaccatcggcatcaacggtatcggcaccatgcttatcaagacactgaccggctacaccgtgaacccgaactggctcagttcgttgccgggcctggtgaccatctactgctacttccagattccgctgatgatcatcatcttcctgcccgcggtcgattcgatccgtccacagtggcgcgaggcatgcgaatccctcggtggcaacacgttccagtactggacgcgcgtggcctgcccgattctggcaccccgcttcatctccgcgttcctgctgctgttcgcctccgcgttctccgcatacgcgaccgccgcggccctgttctcccagcgttcgattctggtgccgcttatgatccaaggtgccatgcgcaacgaactggaccccaaccagcagggctttgcccaggtgctggcattcgcaatgatcatcgtcgtggccatcgtcatgctgttgagccacgccgtggaaaagagggccggacgttggcaatgaccgaaacttccgcaaccaagccgccgcagctgcgcgccgctcgtgcgcgtaaacagagcatcatcaaattcgtgatcctgttcgtcaccctggcgttcctgttcgtgccgctgctggccatgctcatcttcaccctgcgtcacccgctgtccggccgctggtcggccgcgccgtggatcgcgattttcaccggcaacggcgagtcgctgggtgccgacctgaccgtgctgtggcagggcatcggcacctcgctggccctgagcgcggtcaccgtggtgatcatgctggtgctgctggtgcccaccatggtcatcgtgcatattcgctccaaggttttggagcgcgcgatcgaatgggtggccacgctgccgctgaccatcccggccatcgtgctggtggtgggtttgggcccgatctaccgctggctgtccgccgacgtgctgagcaccagcccaatctggctgtgctttgcctacgtgattctcgtgatgccgttcgccttccgcgcgatcgccgtggggcttaactccatcgacgtcaagacgctggtcgaggcatcccgctcgctcggtgcctcctggcccaaggtgttcttcaaggtgatcatcccgaacctatggcagtcgattctctcggcatcctttatctccatcgccgtggtgctgggcgaatacaccgtcgcctcgctgctcggccgtatgaacctgcaggtcgcgctctaccagctcggccagtccaattctcaaatctccaccgccatgtcgctgctggctctgctcttcggtgcggtgctcctcgttgcgctcgacctgatctccgacgcaatgcgcaagtcaagggaaggtaagtaacctgatgaacagcaattcgattttcacccgtcgccatgccggtgccgatgccgcggcttctgtttcggcacccgccaccacgtccgctgccgccgaggacgccttcaagaacgatcccaccgccaccctcgaaggcgtgcgcggcaaggacgtgaccaaggccgccaaggccctgctcaaagacagcgtcaagcgcggcggcggctccatccagatgcgcgacgtcgtcaagatctaccccggctccaccgttcacgcgctcgacgacttcaacctggacatcaagcccggcgaaatggtcgtgctgctcggcggctccggctgcggcaagtccaccgcgctgcgctcgctcgccggcctcgaagacatccagggcggccgcatcatggtcggcggccaagacgtcaccggcgtgccggtcaacaagcgcgagatggccatggtgttccaggcctactcgcttttcccgcacatgaccgccctggagaacgtggaattcggcctcgaagtgcgcggcatgggcaaggcagaacgccgcaagatcgccatggaacagctggagctcgtgggacttgccgatcaggccaagaagtacacgcagcagatgtccggcggccagcaacagcgcgtggccctggcccgcgcgctggccgtcaagccgcgcgtgctactgctcgacgagccgctctccgccctcgacgccaaggtgcgcgtccagctgcgcgaccagattcgccgcatccaactcaccaccggcaccaccaccgtcttcgtgacccacgatcaggaagaggcgctggccgtggccgaccgcatcggtgtgatgaacaagggcaagatcgagcagatcgccgccccgcagaacctgtaccagcgccccgccaccgagtacgtggccacgttcattggactcaccaaccgcctgcccggcgcatccaatggcgacgaggccgtggtcttcggccagcgcgtgccgctgctcgccggctccgccaagggcgattccgtggccgtgctcgtgcgcccggagaacctgacgctggccttggccggcagcagcgattcgcacgtcggcgaacgcgcccgcgtggaggtcattcacttccttggctccttggtgcgcgtggatacggtcatcacctccggcgaataccagcgctggaacaagggcgaacagctcaaggccaccgtgcagctgcccgccagcgagctgccggccggtctggcggtgggcgatgacgtgattgtcaccccgcgtccggtcgccgcgctcgcctgctgaatggcgttgcgatgatcgtgcggttctgttctgtttttgtgactgtacgatcgtcgaatggcttatcggcaatgatgtgtgtgggacggcggcgatttttgggcgattatcgcgtgccgtcccacagcaatcttgcagagtaggggactttctcggcattgggaatgattgacgttgatcattccttgcccattgatgatttcctcccccattcccaatgcaatcgaaacgccgtgccgtattcttgaagagtattgcacgtgtgatcggtccgtttgcggccagtaactatgggggataagtatgagcgaaccaatgccgccggcgcagcagccgcaggcacctcagcaatcgcagcagccgcaacaatctccacgcgattggtggttcacggcccatcgccggttttcgacaatcggctcggcgctcgccattatgatggtgttctggatcggactgaatattctggccactgaagcactacgaacgctgcttggcaccgatgtgcccgcttgggctgtgctgctcgcctcctccggaccgctgtatgtggtggccatgccgctgagtatgttggccttcactcgcgtaccggttattcgcacccggcagtaccccatgaaggcgggggagttcattcagattttcgtcatgtgcattccggtaatgttcttgggcaatatgattggcaatatattgtctgccggagccactgatggtcaggccaccaatcgcatcaacgacgtgattcttggcagcgactggcgggtgaacgcattgttcataggcctgttggcaccggtttgcgaagaatggatttttcgcaaggagattatctcccgcctgcgccggtacggagagaagaccgcaatcatattctccgcattggcattcgcgctattccatatgaacgtgttccagttcttctacgcctttggcctaggactgatgttcggatatgtatacacgcgcacctcccgactgcggtattcggtggctatgcacatgctgatcaacctgaacgggtcagtactcgccccattggtgatacaacagatcgatccccgcatcctcgacggcacggtcagcgaggccgaaatcatgcgtatggctgaagccggcaacatgggcgacatgggcatcatgatgttgtacggcacagtgatgttgggcctctgcattgccggtatcgtgctgcttatcaccaagcgcaagagctgggagttctatcttgcgccagaggagttgcctgcggggcttaaaatacgcaccgcctatgccaatcccggcgttatcgcgtacctactgttgactgtgatgcttaccggttggatgctgttcgcatgactgtcatagccggacccagagaggcgagccgggagatatcacagattgcctgacgagccgccatcttcaacaaggtattcggtgcccgaaccggcgatggctcgcgccgccatatctttgatggtggaaggcagcacaccctcgcgcgcgaacacaagcacttggccggtcatgccgtaaggggagaagccggtgaacttgaccaatggcggctgaccctccagcgccacgtcggcggtggctttggttacgcggtcgagaatatcctgactgatcgcagacgggtcgccggaggccttggccgtgaactcaagcgtggccatgccttcgctgaccggcgtgagcttggtcagggcggccgtattgagtaccgaattggggatgaccatcatgtctccggaacgggtgcgcaccacggtctgacgccaggtgatgtcgtgcacggtgcctgtgacgccttgaatggtcaccagatcgccgggttggattacgcggcccagcatcaggccgaagccgccgatgatgttggcgattgtatccttcagacccagcgagatcgccacacctccaacaccaagggcggtgataagtgtggtcggattgatgccgaatacgggctgcagtaccatcgctgcgccggtgacccagatggtcacgcgcgtgaggttcacgaaaatcgaggcgctgggaatctgagaattgtccagaatcttgcgcaacacgcggctgatgacgcggtcggccacaaatacgatggccaatacaatggtcagccagatgagtttgccggcgttcacctgaaaccagcgtgcgatgtcttctgcatattcagtcatacgcctactgtatcggtcgtttctggtgaagtcgtggagacggggtggcagaaagcggaatcggcctacggtcgattccgctactcctggcgttcgcggcaggtctggccgaggccgcgggccagtcgaatcggatcgagaatctcgtccaactgctcggcgggcaggtcggtgcgttcgccggccacctcgcgcacggtacggccggtatgtacggcttcggcggcgatgtcggccgcgtgctcgtagccgatgtagtggttgagcgcggcggaaatcgacggtgaggactgggcgtatgaacgccccaggtcagcattgatttcgatgccttccacgcagttgacgcggaacgtctccatggcgtgcgtcagcaacgccatgccggtcagcagctcatgcaccatcaccgggtcgaaggcgttcagctgcaactgtccctcggccacagcccagttcacagtcacgtccatgccgaaaatcgtgaagcagcactggttgacgcattcggggatcacagggttcactttggccggcatgatcgacgatccggcctggcgagccggcacgttgagatcgttgaaaccgcagcgcggcccggaattgagcagtcgcaaatcgtcggcggccttcttcaggtgcacggcgaggctcttgatggcagccgacgtggccacgtacgcgcccatatccgtcatggcggccaccggatcgggcgcggcggtgaccggcagcccggtgatttgcgccagatgcttgatagcggacttgcggaatcgcagatccgcgcaaatgccggtaccgatggcggtggcaccgaggttgagctgggccagcagcggcaccacgcgatcgaatgcagccaaatcagacttcaacagcgtggcaaacgcatgaaattcctgaccataggtcattggtacggcgtcctgcagctgcgtgcggccaatcgtcacgtcattgatatgtttgtcggccagatcgtggaaggccttggcgagtttcttggtggactcggcgagcggcccgatcgcgtcgataagcgcgagtttgcaggcggccgggtaggtgtcgttcgtggactgcgacttgttgacgtcgtcgttcggatggatgtatgtgtaatcgccgcgctggcggccggcgatttccaacgcacggttggcgatcacctcgttcatgttcatgttcgacgaggtgccggcaccgccctgcatcacatcgaccgggaactgatcggccagtttgccggcctcaatttctaggcaggcggcgcgaatggcctcggccttggctgggtcgatcaggcctaattcctcattggcgatggcgcaggcgcgcttgaccgtggcataggcgcgaatcagctcgggatgttggctatcggtgatgccggagaccgggaagttgccgatagcgcgctgggtgtgaataccccagtagacgttcgccggcacctccatctggccgatgcagtcatgttccagacgggtcttgttcgatgtttcgctcatgcttccatcttcctgtgcgtgggttggaaacgccagcatgagaggctgattgcgccttgtgagaaacctcacgcgaggttcgtgcggcggaaacaatccagactcgctggttttcggtcaagcggtgtacccggggaatcctgcggggccgttcgacgatgagatggtggatggcgcggcatgcgtggcggcgaccggcatgccgggggcggtcgaatcctgcgcattgtgcacgaagatgcgattccagtaattaagcatgtccttttggctcatggccaggtatatgcccatggccagcacggccacatcttctttaagcaggtctttgatttcgatggtgtcgctcaattcgggccaacgttgcagcacggcgagcatgccgcccacggtgaactcgaccatgagatcggttttcaggtcaaggttcttggggtcgcgttgcaatgtgctgagcatttgcagacggcagaagtcgcgcagcgattcggtcagttcaagcgtgctgtgcgggcctgccaacagggccaggtggtcgaggcgctgacgctgctctggatcggagagcgtggcggtgacgcggtctcgccattgttcctcgggattgccgttcggatcgggggtgcggttgatcggaatcgattcgacctgatgcaggatggctgaatcggccaattcgggcaggctggagaagtgatagtagaacgaattacggttcacgccagcctcacgcaccacgtcggtaacggtgatcttgcgatagtcgcggtcggcgagcaattcccagaaagcgttctcgaggcgttctttggcgggcagcacctcggaatcatggcgtggacgtggcatctcttcctcctgatgcaccagcgtgatatggtcacgctgtctaataacttattgggcagtataactattatttgtggacatgtctatgagctaatcggcgatttcagttgcgtcctccgctgatggcgaagctgtggtgccggcatcggcatcagtatcggctctggccggagctgcgctatctgctcctgctgcagtttctgctgggatctcggctgttgctttggaggtcgcagaacttggtgcggaagccggggcgggcgtcggcttgcgtttggccgtggacgccttgaacagtatcgccagggcctcaaccaaatgacgccggtctgcgggggtcagcccaacgtacgcgccaagcatcgccggaatcgaagcggggaagttgctcatcacctcgctgaagctggtggcgccgttggcgtgcagcacggtgaacagcgcatccaccgcacgctcgcgctgttcgggcgtaagcgtggcgatccaatggttcagctcctcgttaaacaactgcgagctggaactcaaatccggctcggtgatgaactggtcaccatccaatagccaggtgaaggcggaatgctgcatgatgccatccgaatcggaagagaccacgcggcaaggctccggggtctcgaaaatcatgcccacaatcgacgaactcggcacgattttcgtcaccttcggctggatggtgcggtaggcggggctggtcacaatctccggcgggaaaccggggccatccagtgaatagacatgctgaatgcgcttgcgcaccttgggatcggcgttcatggccgcgtaaatcgccagattgcctcccttggaatggccgaccagaataatcggaccctcccacagtcgcgccaccatatccagataggcgctggctgaacgttgcgccggcaccggatactggaaagccatattgaaatcttccttccatccgatgagcgaatcatcggtgccgcggaaggaaataaccaacgtgcctttgtaggtcggctttcggcgcttgtggccgtcgggcagttggaaggtggcggcggcgaattgggtttgctcaccctgattgatgtgctcgaccaccgcgcccaggcgaacgttggcgtagcgggggttttcgcctgcggcctggaacaggtcgtgggtcaggtccgggttgaccactgaaaccatttgggcttcgtgcggcttgtcgtcggcatgtgtttccggcgaacgatgcagctcgcggttggcctcgtcaaggcttaccgattcaagctcgggatgccagatacccttcagccagatcagtggatgcttgggttcgaaagcgcgaatgcgtgcggcgaacgagcctgaccgcgtctcatccagcatcaacgtcggacagacactggccacatcctcatagatgagcgtggagatgatcaaggcgtcgatttcgttgaacggcaagtcggcgaaggagcgcgtttcggtgtgcgcgtaatcgataatgccggtcatgcgcacctcctgcttccgttgatattgcatatccccttgggctgcgtggtcttgcgatcgcgtgcggccgtgcggctgcgcgcagcaattaaccatatgcattccattgtagggattgtacggttttggccggcgcgatcgagcaagactgcaccgacggcgaacaattcgtggaaggattcccgtcggcttgtcgaaaattgtcgggtagcagggttgcgatgccagccagccgaccaccctccggcgctacgcgccatctcccgccggcgggagggttaaccactcaatcctttttgacgaggcggaccgctgggcccgtcaaaggttcggcagatcgaagcgcgccagatccacgccctcgagttcaagcaactcggccttgatgtcgagtcggccgccgtagccgccaaacgcgcggcccgagccgactacgcggtggcagggcacgatgatggtaaccggattgcgcttcactgcgcctccgaccgcctgcgcggccatgcggccgccgccgcgtcgttcggccaattcggcggcgagttcgccgtaacttaccgtcatgccataggggatttcggccaccagattccacacttcatgttggaatggcgtgccggcgggatgcaaaggcggcacctgatccgagccggggcgttcgccggcgaaataggcggtcagccattcgcgggttatgcggaatacgtcgggttcactatcggattcgcgattcgaatcgagaacggcttggtgatcggtggcccaccaccagtcttcaagacagagttcggtaagtccctcgccgtcggaggccatcatcatccggccgatgggcgtttcgactgtggcccgcatcagttgtcgttgcgtcataccgccattatcgcgcgttgagggatgaagcccataccgtgcctgattccatgaaggacggcacgtcggcgtagttcgggaacttcacttcggcgctcgataatcgttggaaaaccggtgggacacgcgggggcttggctttttcctgagattggcgtatctttgtcacctgttgcctgtgaaggtaacacatgcggacatagcttagttggtaaagcgcaaccttgccaaggttgagaccgcgggttcgagtcccgttgtccgctctcggatggttgattcatgctgattgattcgaccggatgatgacccgggcggttggcgcagtggtagcgcacttccctgacacggaaggggtcacaagttcgaatcttgtatcgcccactcgatgaatcgccggcagaatgttgccggttttttcatcacaggctcgggcgattggcgcagcggctagcgcacttcgttcacaccgaaggggtcgtaggttcgattcctacatcgcccacccgagattcacgctcgttggccatgtggccgcgagcgttttttcataatcgatgtattccgattatgccggtccaatcggggtgcgggctagaatgccgcggagccggcagaatggcgggattccgccgatgcaacctgtggttgcgcgcgaatatgcaacctgaagatggtgacgcggaactggtttgccgtggcatagtgagggcatcggccgaatatgtcatgatgagcattacctatgaagggacactccgatgagcttccgcgccaacctgcaatacctgcgcgcacaacgcaacatgccccaggaacagctggccatgttgctcggcgtctcgcgccaggccatctccaaatgggaatccgagaaggcctatcccgagatggacaagctgcttatgatctgcgacctgttcggttgcacgcttgatgacctggtacttggcgatgtgagtgcgagcgtgaacgtgggtgcggccgcgcgcggcgcagcggagggcgaccatggctcggctgccagaaccgtaaccggggagggagccggggaactcgcgtatatgaaggatgctgatgggaacatcggtgaatcagcgcggtccggcggtgacggcatcaatggcccgagctccgcaaatgcattgcccggcgaaatgttgcacggaaccagttcatcacgtcccggcacgctggctaatgtggctgccttaccgcaggatctgaccggctacgatgaacaccgctgccgattcgcgctactgattgccggcggtgtcgcggcgattatcgcgggagccggcatcggcaacctgttcgattccgataattccattctcggcgtgacgccactcaacgattttctgacattcctgggcatctgcgtgggcgtgattatcgggctggcgatgctgattccgggcggcatgtcacataccgacttcaaacggcggcatccctatgtcgaggatttctatgctgcgagatgtcgccctcggcacagagttgccgagggccggcaaatcactcccgcgtcgggtccttttgcaggagcaggaagacgagtgccgcgacgagcaggacggcgatggagagcacgccgagcgaggcgttgccggtcagggacgtggtggtggccaccaggaaggtgccgatgatcgaggcggtcttgccgaagatatcgtagaagccgtagtactcgttggcgtgattcttggggatgatcttgccgtagtacgagcgggagagcgcctggatgccgccctggaacatgccgaccagaatcgccagaatccagaactccacggccgacttcaggaagaacgcggcgaagaacacgatgcacatgtatgccacgaccgccgccgtgatcatcactttgcagccgaaccggccggccaaacgaccgtagagaatcgcgcaggggaaggccacgaactgcgtgacgagcagtgccaccaccagctgggtggagtcgatgccaagctcggcaccgtaggaggtactcatcgaaatcaccgtgttcacggcatcgatgtagaagaagaacgcgatcatgaacatccacaacggcttgttcttcacgattttgccgaacgtgcccgccagttcgctgaacgtgccgcgcacggccgagcccagctggtcacgggtggcgcgatagtgcacttggcggtagctggtaagcagcgggatggtgaatgccacccaccagatggcggtgatgatgaacgaggcgcgcgtgcaagccaccgtggaccagtcgaagagcgacgggccgccgaagatcagcgcgatgcagaagatgaacggcacggtggagccgatgtagccccagccgtagccatgcgaggagaccttgtccatgcgctcgttcgaggtggcgtcgatgagcatcgaatcgtagaacgttagcgagccgttgaggccgatggtcgccagaatgtagacgactaggaacggtagccaggtcaggggcagggccattgcgcagcaggtgaccacgccagtgccgaagaagccaaggaagaacttgattttcatgccttgcacgtcggcgatggagccgagcaacggcatgagcagcgcgatgaccaaggaagcaatggtttgcgcgtagccccaggcggacacgatgttgccgtccgccggcatcagcgatttggcgtaaatggggatgacggcggtggacagcagcacgaatgccgagttgccgacgtcgtagatgatccacttcttctcgcgggcggtcagtttggcgctttgcggcaccggttcgtggacattcgtgggatcagtcatatacactcctcgacagtattcaactcaatctatcgtagaagcgcggactagggtaggggagccattccggttgaacggcggatgaataatgccgggcctctttctaaggggagccagagcaaaaatagctcccctcgctgaggggagctggccgcgaagcggactggggggagctacctatagtcgactattcgccgatcagcgcgatggcctcgtcgtaatcggggcattgcggcacgccgttgaggctgtgctggatggcgatggatgccgccgcgttggcgatctttaccgattcggccagactatggccctttgccagcatcgcgcacatcacgccggtgtggcaaccgcccgccgaacgggtgtgtacggccttggtcgggtatccctcgatatgaatcgtctcgccacctggctcacgaatccaagcgccgcgggcgccgacacgcaccaccagcggcgcgcgcagtgtagcgcccaagccgtcgcacaactggtgcatgaagtcgtcaagtccgccgccaatggtgactttgctgtcgtcgattggcgcaccaagtcgctcggccagcgtcatggcctcctgacggttgcaggaccagaccgggcgtgcgagcaccaggtcctcaagcatatggtcgttgaccaaacgcaacgtattggtggggttgatcaccagcgtgtagtcgcgtgcagccgggtcggtaccggccttgagcaggaatccgtccacgccggtggccgtgtggtccatcagtgtgttgccgctgatgtgcaccacgtctttgggctgcggctccagcgtgtcgaacgtgtccgagtcgccatgagcctcggcgccataggaagcgatgaatgtcttcttcggcgcgccggagctcagcaccacgcggaagccggaatcctcatcaagacgatcctggccgatatgcgtaatgccgttgtcttggaatgactggcggatgaaatgcgcccacaggccgttgcccagaatgccggcgtgctcggtcggcacgcccatgcggctggccgcctgcagcacgcgatagctgccgccaatggagggcttcggatgatcggccacggcgaatccgccctgtgccggcaccttgtccacattgagcataatgtccacccagacttgccccagtgaaatcacgctgggctcgtgagtgccgatacctcgcttgagattcaacatgacagcctccttcgtcgtaagttgcacgaggaccccttcgtcccttgccgtctcttataccgagattatatgagagtttgctggatgcggaaaaggaaggccggcgtgttttatcgggtaaacgctatgatttgcagcgtaattcgccgctggcgaactgctgacgaactacttgcggaccgctggcgaaccaatgccgagccgctcgtgaaccgctgatggcccactcgcaagttacgctcgaaccgcgcgtgaaccgccgaggttcgcccatgatacacgcaagagttgcggttgtcggtattgggctatatatttgtgaagttgtgtgttcggcatgtcgggtgaaaccggcggtcgaatgcgtgaaagacttgacacatcaaggttaagggagtccatcatggcagctcgttgcgcagtgtgcggcaagggaccgcagaccggtttcaccgtttcccattcgcaccgtcgtaccaagcgtagcttccgcccgaacctgcagtctgtgcgcaccacgattgatggcgagaacactcgcctgcgcgtgtgcgtcaagtgcctcaaggctggcaaggttcagcgcgtggccgcgtgaatcgcgtactaacgtggagcaaaacccgtttgagcttcggcttggcgggttttgttgtttctgcggcctaaagaggccgtgcgaatagaataggccaatatgagcatcactatgggcaccactctcgcttcgctggtcaccaacaagcgtcgcgtgtccgcgctcaaatcgctgggaatcgtcactgtcggcgacgccctgacctactatcctttccgcgtcaccgaaccggtgccgcttcgcgccatccgcgaggccgcacccggccagcagatggcatttgccgccgtgatacgagatatgcgcgtggtgccgatgaacgctcgccgcggctaccgactcgaagcgacggtcgatgacgccgacttcgcccggtctcgtcgcgtacccggcagtacggcccggctcacgttcttctcgtatcgtaaatcgtatgtggattgggtcagcgtgcgactgcgcgccggcacgtctgtggtggtctccggtatgcccggcgaatacatgggtcagctgcagttcacccatcccgaaatcctcactgtcgcgcccgtgccggccggagcaggagcggggcttgagggttacgctcggggcgcggcatccggcaatggtgcgtttgcgggaagtgccgatccgtatgccagtgcgcagtccgcgtatccgccggccgcgactgccccttccggggccgcgttgaaatacgacgccgataccgtgcaagaggcgcttacccgcgtctgccggccccgcccggtatatcacgccagttcgcgtatctcgtccgaacatattcatgagacgattctgggattgctgtggatgatgggggcccgcacgtcatccacgcctgacgggcaactcgctggcgctggggcagccggcattgtggctcccgcgactgacaccatcgccgtccaaaacggggaagagaagtccggcacgaccgccgaatccggtgctgaggcgctctcccaatccatcccagatgtgctgcccgaatcggtgcgcaaggccaagaacctcatgcatcgggctgaggcgttcctggccattcatgatccggcctccacggcccggttcaaggaggccatcgaaaccctgcgctatgaggaggctttcgtttcgcagacctcgctgctgaagtctcgacagcacgcgcacaagtcatcggcgcatccttgcccgctgaacgaggcgctggaaacagctcgagcgtcggtgggcgaagcggttgcggagccaagtacgcaaccagaagcatcggagcgcggttctgcgaccgatctgcctgatctgcccaatttgcccaatttgcgcgaccgcttcatcgcatcgttgccgttcacactgacagccgggcagagtcaggtggtggacgacatcgcgtccgatcttgaacgtgactggcccatgcagcgtctgttgcagggcgaagtcggctccggcaaaaccgtagtggcgctcgcggccatgctgcaggcggtcggcgccggctatcaggcggtgctggtggctcccactcaggtgcttgccgaacagcattacgagaccatcagcaagatggtgtcggggttgacccttgcacagccgggtgccaaggagaccgatgccgcggccgacgttgagggcgcgatgggcgcgtccggtgcttcgacggtctcttcttccaaggtgactgcggaaattcccgtcaccctgctgaccggtggtatgaagcttgccgcccggcgtaaggcgctcgctgcggccgccagtggtgagccgggcattatcgtggccacgcacgcggcgttttccaagaccttccaagccccgcacttggccttggtggtgatcgacgagcaacaccggttcggtgtggaacagcgcgaaagcctcaacgccaaaaccgatgacggcaccacgccgcatctactggtgatgaccgccacgcccatcccgcgcaccgccgccatgacttggtttggcgatctcgatatttcctggctcaccgaattgcctggcggccgcaaaccgattcgtaccgtggtggtcaatgaggccgacgccgccaccatggggcgtatgttcgcgcacattcgcgcgcgagtcgacgcgggggagcgggcctatatcgtgtgcccgcgcattgatgcggatgatgaggagaacgaaggcggttccggcgtttcggcagcagccggttctgcccgcggacgcgccgcagcatctggttccagtgcccgcacagctgcgggcggccgtgcgacgcgcgcggcggccgatgccatcggcatcgacgacccctacgaaaccttcgacgaaaatggcgaaaccgtggctcgcccgccattgcatgcggtggccgaaatcgccgaccggttgcagaaacttccacagttccaaggcattcggtttgcgactctgaccggccgcgacaaggatgacgtcaaaacccaggtcatggccgattttgccggcggcgagactccgatcctggtgtccaccacggtgatcgaagtcggcgtggacgtcaagcaggccagctgcatcgtcatctttgatgccgaccgatacggcctctctcagctgcatcagctgcgcggccgcgtggggcgtggcggcaccaactcgtgggcgttccttatttcccgtgcggaacccggctccccggccgagcaacggctcgaagtgattcaccactcgctcgacggtgccgaaatcgcccaagccgacttggaattccgcggtgccggcgatgtgctcggcgacgcccaatccggcggcaagtccagcctgaagctcctgcgcgtggtcaaggacgccgacatgatcgccgacgcccgcacccgtgccgggcagcttctggccgccgactccgaactggcaggtgaggtccaactcgccggtgccgtcctcgacttcacccgaggcaacgaaaccttcctgacctccagctgaggcacctccagctgaggctagggctgcgcccccgtaatcgcacgatatagtttttccgtatgccgatcgtgaggaaatcacggtcgggaagccctcgaatgtgcttcagtggaggcaagaccattcgtacatgaggtactcgaagtgcatatatcattggtgcgcttcgagcaccccattgttgttcatgattggtatgcgcagatgaacctgtacagtgaaagctatgcgtgtaatttctggacgattcaagggtgtggcgcttgctacgccgaaaacgggtacccggcctaccacggatcgcaccaaagaggcgattttctcgcacctcgactcatggggagtgctggatgatgcccgtgtactggacctgttcgccggtactggtgcgttgggcatcgaagcgctgagccgtggcgcgcgagaactcgtggccgtggaaagttcccggcctgcggcggcgctgattaccaagaccttggcgcagctacagaagaatcgttcgtgggatgcttcgctcaaggcccgtgtgctggtcaaaaaagccgagcaagtggctggcggcttcggcgaaccattcgacgtgatattcatcgacccgccctatgcctatgagaccgctgaatgcaatcagctactgtccgatctggcggcgggcagcgccaccaacgagaacacggtgatcatgctcgaacgctcggtacgctcggatgatcccactgcccccggaggctggcaaatcaccgaaagccgcaactacggcgaaaccgccgtcttctacatcgaatccgcggatgacgactcggatatagagcgttccgacgattccgccgcgtagtgaatctcccaccgtgtggtgaattaatcggcgagccggcgcggatgggcggcggagacctcccagcccaaggccatcagggtcttgcgatcggccttatccagcgccttgcaatccagtgccgcgataaggtctggccgaatctcggcggtgcgggccagcgcttcgtcgcggcgaaaacggtccaccttgccgtggtcgccggacaacagcacatccggcaccgcaataccgcgccacacggccggcttggtgtactggcgatgttcaagcagtgcgccctcgccggtgtaggattcctcaacaatcgaatctgggttgcccatgaatccgggcatcaggcgggtgatggcctcaagcatcaccgataccgctacttcgccgccgttcagcacatagtcgccgatcgaatattcgcgtacgtcgacgccttgggcgcggtagtagtccgggatgcgcgcatcgtagccctcataccggccgcagccgaacagcagatggtcggcatggctgagctcggtggcgtcgcgctgggtgaacaacggggccgatgggttcgggaagatgagcaccggtgcgccggatggggcgggggagccggacggctgcgagaatcccagcagttcgtccagacattcgctccacacttcgggcttcatcaccatgccggccccgccgccgactggcgtatcatccaccgaatgatgcacatcgtgggtccagtcgcgcaggttgtgcgccttgatctccaacaatcccttggcctgggctttgcccatcaggctgaggttcatcacctcaaagtattcggggaacacgctcacgatatcgatcttcatgtcatccagcctaacggtagcccctcccgcattacacggccaccactacactattacggtgatgaatacgacgatgaacctccccacccgcaaaaagcccgaagtgttgtccccggccggcaacctgaggggcctgaaaaccgcggtcgattatggtgccgacgccgtctactgcggcggcaaagccttcggcatgcgatcggcccccaaaaaccttagccttgaggatttcgaggaaggatcgcgctacgcccatgaacgcggcgctcgcgtgtacgtgacctgcaacgtgctgccgcgcaacaacgagatcgaagccatgcgcgagtacgtcggccagctcaaagacaccggcgtggacgcgctgatcgtctccgatattggcgtgatgatgatggcccgtcaggtggctccgaatctggaactgcacgtctccacccaggccggcgtgactaattatcaggctgcgaacgccttctacgagcttggtgctcgccgtgtggtgttggcccgcgagatggacttgcaggccgtgcgtgatattcgcgccaacattcccgatgacctcgacatcgaatgcttcgtccacggtgctatgtgcatggccttctccggccgctgcctgttctccaactatctgaccggccgcgatggcaatcacggcgaatgcgcccagccatgccgctggaagtattcgatcgtggaagagaagcgccccggccagtacttcccgatcgagcagaccgagaacggcgcctatctgttcaattcgcaggacatgaatatgctggggcacttggatgatttgattgactccggtgccaccagcctcaaaatcgaaggccgcgcgaaaagcgcctactatatcgccgccatgaccaacgcctacaaaaccgcggttaatgaatacatgattcaacgcggttttgaagacgctgatggcaatgttttgaagcctttccatgaccgtgtgattcgcccgggcgaccccgattttggccaaggaaccgaagatcaagtgatgcgcaatgctgatgccgcgttcgccggtgtggccgatgagggatatgaccgtggctctgatactgcggttgccgattcggtcaccggctcggttgccgcagaacgtgaccgcgtgacggttgctgatgccgtcgactcaactgcctctggtacgccggccggcaccgccgtcgaacccgacggcatgagctctcacgcccgttccacgcgccgcaagtccaacaccgcggtcgaacagattgagaccgattggaaacatgcggccgttcgcccggccccacacgtcgaactgcccgaatggctgctcgaggaaaccgacaaggtggcccaccgcgactactccaccggcttctattacccggagcacaaggtcacacagaacaccgaccgctccgcctacttccgctcatggctggtagtgggcgaagtgctgagctggagcgcggacgaagacggacgtgtcacgctgatgagccgtaacaagattgagcccggtcaacaggtcgaattcctgctgcctggcgagagaccattggtctttaccgtgccggaaaccggcctgcgcgatgccgatggcgcgccagtacccgccatcaataatccggcgcacgtgttctcgatgccctgcccgcaccaggtgcccatcaacgccgccatccgctcgcgcaccaaaaagcccaccctcaaagccgaataacctaccactccgcccccgctgactgggggtggtcatgaaaatcatgaacaccgcccgcacccaagaaagaatgccttatgcctgaatacagcgaagaaatcctcgattccaacagcatcagctctaccgataaagccggtcgccctattccggtgaccatccccatcgcactggcccccggcatcaaggtggtgtacaccacgcgactgggcggcctgagcaccggcgattacggcaacctgaacctcggcggcaagtccggcgacgaacctgaggccgtgctgtcgaaccgcatcgcactcgccgaagcggtgcaagcccgcctatcgctggtctcccaagtacattccggcgtggctgtggacgtggacgactcgttcgtcatcaacacccccttcggcttcgacgtgtccggcacacatggtgagactgacactccgcacgtcatcgaggcggacggccaggtcaccgcacaatccggcatcgccctaggcatgttcgcggccgactgtctgccggtgctgctgggcgacccggtcaccggtatcatcggtgcggcccactgcggccgtcgtggtctggagcgcggcgtgatcggcaccacggtggacctgatgaagagcaagggtgccgacccggcgaacatcgtggccacactcggcccgcgcatctgcggcgactgctatgaagtgggcgacgagatcgccgaccagttcatcaagcgcttcccgctgaccaagacgaagacccgtttcggcggtgccggcatcgacatcgccgaagccgcgatgatcgacctcgctttcgccggtgtacatcaggtggtcgattcgatgccgcgcgtgcacgccgccacccagtaccttgaggaagacccggaactcgccgaactgtgccgtacggatggcgaaggcccggccgagctcgcggagcgcatcgacaacatcagccacagcatgtgcacgctcgaaaacccactgtggtactcgcaccgccgcgccgcgctcgccaacaaaacacacgaaggccgcctcctcgccctcatcgtgcgtgactaaacggagaatgcgagcacattccgtggagaagatgtgatgcagttcacggacggccagccctcaccctacggtggtgcctatgactgagagagatttcgatacccccgtcgagacgcctaccgtccagccggcccccgctcagggcgccaaaccggcgcaaaccgtgccggtggtggccgtggtgctggccgccggcttcggtacgcgcttcgaccccgataatcccaagcagcttgtctccgtgggcggcaagcccatcgtgtgctggagcattgatgcctttgaacattgcgaccgcgtcagcgacatcgtggtggtggtcaatcccaaggtgcgcggtgaagtggaaacgttggttggcgagatgggctacaccaaggtccgcgtcatcattgacggcggtgacgagcgtgtggacagtaccgccaccgcgctcgacatgctggctacggctggcattccggacgatgccaagattctgatccatgacgccgtccgtccgttcgtggaacagtccgccatcgacggttcgattgatgcgctcgaccagttcacggccgcgaccgtggcctacgcctcaaccgacaccgtgctgttgaccgaggatctgggcgatttgaaagtggtcaagtcggtgccggaccgcccgaacaccttccgcgcgcagaccccgcaatccttccgcttcgcgacgattcgtcacgcttacgatttggctgccgccgacccggacttccatcccaccgacgacacgcgcgtagtggtcgattatctgcctgatgaacccgtcgccattgtctccggtgcggaaaccaacctgaagatcaccacgctggaagatattcccacagctgagcgtatcgccgaggagattctcggtcgtgatcccaaggaagaggcccgcgcccgcatgcacgccctgctggcccaagcggccggccagatgcatcgctagactggcattatgcgtgaactcaatgttgtgatctccggcttcgaccactatgacggcgtggaggtcaatcccgccgtcgaagtgcccaaggccatcgccgagcagggactgggcgtctcctctgctccggacgatccgttggagcaggtcgccgtcaccgttcatgctgtcagcatcccggtgagcttcgccaaagcctggcccacgctgaaagagacgattgaggccaccaagcccaatatcgtcatcgccaccgggctcaagcacgcagcccgaggcgtgatgcttgaacgatgcgccaccaacctgatggacgcgatcaagccagacgcggacaacgtgatcccacgccgcgaacccatcgatcccaatggcccggccgcctattggacccgcctgccgttgcgctcgatcctgaatgatttcacggacgattcgattccggccaccttgagttcggacgcaggtacgttcgtatgtaattcgctgttctacaacttgctcaactggaccgccacccaggagcaggtgctgggcggattcgtcagcttccctccggtcgttccggcgcattccagccagcatggtctaccactcgaccagcagatcgccgctggccgtgatgtggtgcgcgaagccgtgcgctactatctcaagccctccagctccgacatcctcatcgcctagcacgctgtgcgccacgccggaatagaacatggttcgcacgcattgtaacgattgcgcgtcgctcaacgctcagcgctagtgcgatgcgctacagtgcttcaaggatgtgccaagagctttatgcgtgtgcgaaaggaataaacagcgatggtggatcgtttcccggtggtgctgcgaggatatgacaaggagaaggttgatgctgccttcgacgctactcaggagagtatgaagcgtgcgcagcagacgttggccagcatgcgtgagcagattgcggcggatgacgaccgtattctgcaactgcaggcccaacttcaggaagagaagaacaagaagccggaaggcaacagcttcgcttccttgggagcgaacgcccagcagatgcttgcctccgccgaacagacgagtaccgaactgctggaacgcgccaagcaggacgcgtcctccatccgtaccacggctcaggctcaggccgaaacactgatcaacaacgccaagctggatgcccagcatattgttgacgacgccaatgccaaggccgcctcgattctgacgaacgccagcaatcaagccgaatcagtgaccacctccgccaacgaggatgccgcacaactgcgctccgaaactgccaagaccatcaccgaacagcgtcagaccgtcgagcttgagctcagcaacgcgcgcgaagagcacactaagaagatggcttccgaacgctccactcaagagcgcgaaatcgccgacatgaaggcggaggcgacccagcaggttgccgcaatgcgcaaaagcgccaatgaggagatcaccaagcttaagtctgattccaacgatcagattgaggcggcgctcgccgaggccaacaagaagctcgccgacgtgcgcgagcaagtgtccaagatgatgaccgaagcccagcgcaaggccagcgaaatcattgatgcggccaaaaccaagggtcaggaaatcactgatgaggccgaggtcaagcgcaccagcacgatgagccaggtcaacgccgaggtcgagcagatccgtcacgacatcgccgctcagcaggatgaggccacgaagaaggtcaacgaactgctgcagcacctcgaagagcgtcgtgtggcggccaagcgggaagccgatgagttggtcggtcaggccaagaacactcgcgaccaagccgattcgtatgccgcgtccaagcgcgaggaggcggacatccaggccgccgcaatcgtacataaggcgggcgaggaagccgatgcgcagatcgaggagcgtcgcgccgccgcccaaagcgagcttgacggtctgtccaagcgcatcgccgatctgcaggaacgcgagtccgtcatcacccagcgtgtttcggaactgcgttctatgttctcgcaggcgttctccggattcgctttcggcggtaatgcggcggcctctggtcaggatcaggaagccgctgccgcggcggcattgccggtggttgcgcccgtcccggaagtcaagcctgtacacaacgaggccgatgaccagccgggtgagttgagcggaaacgagtcggctgccgacgatcacaatgagacagatgcggcaccggctgattcggctgattcggctgattcggctgcgcagaatgagcagtccgaatcgtctgagccgtccgagcaccagacacagggcgaaccggaggccccgactcaggagaatccggccgtatctgagcagaacggcgaatgacaggccttcgattagactactagcggtaagaattacggcacctgcgctttcgagccaggtgccgtattcgtttgaatctgcgccacaagcgcaccatcacagaaggagtatgacatgagtgaattgacgcctctgaccgacgaagcgttgaataccctgcgcggcgatttcgcacagagcggcaccaaccgtctggccatgaacgcggtgaccgccgccggcatcgacaaggtggctcgcaattatgaccgcgctcgtctgatgcagcgtcgtttctccaccatcgttgacaatggcgaagccacccatcaggatcgctccggccgctgctggctgttcagctccctgaacgtggcccgtttcgtggccaagaagaacatgaacttgaaggagttcgagttctcccagaactacgcgatgtactacgacaagctggagcgcgtcaactacttccttaaggatgtggccgctctggtggctgccggagagccttccgactcccgcctgatgcagcacctgctcgccgacgtgatgggcgatggcggccagtggaccatggccatgaacgtgtacaagaagtacggcgctgtgcccaaggacctgttcccggagaccgaatcctccaagaacaccggtgaaatgaacatccagctgcgccacatgctgcacaccgccgtggcgcacatgtacgccgctgacggcgatgcctccaaggtcgaggcgattattgccgacgccactgctgccggccaccgtattctgaccatccacctgggcgagccgccggtttccttcgactgggaatggaccgacaaggatggcgaattccaccgcgacggcgagattacgccggttgagttctggaagaagtacgtgggtccggctgatcttgaggactacgtgtgcctggtggacgatccgcgcaccgagcacgccaagggcaagaagatcggcatcgagcacctcggcaatgtggctggcggcgacgccaccgagtacctcaacgtgccaaaccagttcatgaaggactgcgtcaagcagattctcgttgagcagggcattccggtatggttcggtgccgactgccacccgttcatggaccgtgagaacggcgcttgggccaccgacctgttcgagtacggccgcgtgtacgacgtggacttcgatttggacaaggaagcccgcgtgcgcttcggcgactccgccatgaaccacgccatggctttcgccggcgttgacgtggccgacgacggcaccacccgccgctggcgcgtggagaactcttggggcgccaagatcgccgacaagggctacttcaccatgtccgacgactggttcaccgaatacgtctacgaggtagccgtcccgaaggccctgttgcccgaggaataccagaaggccctcgaagagccagccaccatgctccccgcatgggatccgatgggcgctttggcctgacttcgtcagcctcccggaatcggcctgacggccaatgctgtgttttctcgcagcctgtcggctgctagggtctctccctctgtcagcgcgaagccgctgacagagggagagaccgcggtcgcaggccgcacaacaacacagcatcgccgcaggcgagtccacacaggcgagtccacccaaagtccataactgccggcccaacaagcagtccccgtaacaaactgctatagttgggcttttgcgtctatggcgacataccgacagtacgtatacaaggaaaggagtcgagcaatggcagcactacgtggtccggatagttccgaggatgaacgtcgtttgggggagcaggccgtctttcctgagaccgtcgatgtcaacattcgtcagcttgaccccattcccgcgccgcgtgctttcctcagggagcagccgctcaccgatgagatgagcgagctcgtgctccactcgcggcaggaaatccgcgatgtgctcaacggccgcgacgaccgactgctcgtcatcgtgggcccctgctcaatccacgacccgaaggccgcgcacgagtacgcagaaaagctggctgccgtcaagcgcgagttggaagaccgactcgtgatcgtgatgcgcgtgtacttcgagaagccgcgcaccaccatcggctggaaaggcctcatcaacgaccccgatctggacggtcgcttcaatattcgtaagggcatgtggctggcccgcaaggtgctcaccgacgtgctgagcctcggcctgcccgccgccaccgaatggcttgaccccatcaccccgcagtacatctgcgacgcgatcagctggggtgccatcggcgcgcgtaacaccgaatcccaagtccaccgcgaactggccagtggcctgtccatgccggtgggcttcaagaactccaccgacggctccatcaaggccgccgccgattcctgtttcgcggccggcttcgagcatcacttcctgtccattaacttggacggtcgcgtgatttccgccgaaaccaaaggcaacccggattgccatctggttctgcgcggctccagccacggcccgaactacgatgccgaatccgtgcgtcaagctctggaagacctcaaggtttccaaagcgtccggcccgagccagcatggcctcgtcatcgatgccgcccacggcaactgcggcaaagacgaaaaccgcgaagccgaagtcatcgaagagatcgctgagcgcctggcgcacggcgaacaaggcatcaccggcgtaatgatggaaagcttcttggtcggcggtcaccaaaagccggccccgctcgaccagttggtctacggtcagtccgtcaccgactcttgcgtgccgtgggaacgcaccaacgaactgctgcacaccctagccgacgccgtcaccgctcgccgctcggctaaatagctttgtctttgtaaaaatgctcactgagacccactcagtgagcattttttgccaataacggtggtcatgtcagtttgttcccgtgacaccttatccttgggaaggatactgacccaaggagagatgttatgcagcagcaggaggaagcagcacattcgctgcatccgttgcaagtcggtccgcagccgttgaacaccccagaagagcttcgcgccattcgtcaggcgatgggggaggggaagaacccgctcgttgccactgatgtgccgcgttgggaagatcaggtgggtgtcagtcgcatcatcaaccgccgcgtattggagttggagccgctgcccacgcccgcgcaagtgctcgctgaactcccgctgactgatcaggctcaggaaatcgtcgcctactcgcgtgatgagattcgcgcgtgcctgtacggccaagacgacaggctgttggtcatcgtcggcccctgttcggttcatgacccgaaggccgcgctggactacgcgcgccgattggccaagctgaaagatgagctcggtgaacagctgctcatcgtcatgcgcgtgtacttcgagaagccgcgcactaccattggctggaagggcctgatcaacgacccggatattgatggcagccacaatattcgcaagggcctgttgcttgctcgcaaaaccttgcttggtgtgctgaaggaaggattggcggccgccacggaatttctggagcccaccagcccgcagttcatctcggacgcggtgagttggggcgccattggtgcgcgcaacacggaaagccagatccaccgccaattggccagcgggctttccatgccggtcggctttaagaatgccactgacggctcggtgaaggcagcggtcaacggttgcttcgccgctgctcagcagcacacgttcttcggcattgaccatctggggcgtgcctgcgcagtcgagacccttggcaacccggactgccatgtggtgttgcgcggctcgattcacggcccgaactacgatgccgaatccgtggccaaagccatggaagacgtacgcgccgaaatgcccgccgaatccgcagcctcgcatggtctgattgttgattgctcgcacggtaactccggcaaggacgaacatcgtcaggccgaagtcgtgcgcaatattgccagcagaattgcagctggcgaacagggtattaccggcatcatgatggaaagctttattgaaggaggcaatcagaaggccgcgccgcttgatcagctggtctatggcaagtcgattactgacaagtgcatcagctgggaagaaaccgaggccttgctgcgcgagcttgcggaagccatagccacacggcgttggcactgagttgcgtcatcggctctctcgcgggagcaatgcaacgaaacgtctctacccctcagcctgccattcggcggccacctcccctgacaaggggagccgaaagtgttgtgaaaggaacttacgtatgggtatgaaaactgtagctattattggcgcattggatgaggaagtggcgctgatcgccaaatcgctcacgcatgtgacgcacaccgccaagggcagccttgacatcgtgtccggcacggtcgactccttcggttctgacgtcatcaaggttgccgcaacggtaggcggcatgggactggtcaatgcggccgccaccacgcagctgctgattgacgagattgccccggacgccgtgattttcagcggcatcgccggcaacctcaacacccacctgcacatcaacgacgtggtgctcggcggcaccctgcgctacctcgacactgacatgcggctcgtaggccagtggaagcccggcactgcggacgctccggtggaggaattccactctgatgaccgtctgctggaagtcgccgacgaggcgcttgccaatgcgggcattacccacatcaccggcatcatcgcctccggcaactacttcgtggacacgccccaaaaggtcgaggaggtcatccgactcaccggggctgacgccgtggagatggaaggcgccgccgtggcacaggtcgccgcccgcaataacgtgccggcactggtgattcgtgccctttccgacaacgccgacaccgattacgaggtattcaaggagttcgacatctccgaatacgccgataccgccgcccgtctggctgtcgacatcgtcaagcgcctgtaactggtcacctccaagttcggcgttgccggtgtgggctggtacatggccatcatgactgccctcgctctgctcgctctgttcctgatcaaggaaagcaaggacaaggactacgagctgtaaatagagctccccatattatgctcccgccagcgggagcattttgttatgtcgtcccgccaaaaatgaacaatagacgaacttacgtagtttaggcatctcactacgcctcgcacgttttactctggaaatcatggatatctggcagatcgtcgtgattgtggtgctcgccgcgctgatactggtgtgggttgccgtcatcgcctacaacaaaggccgcgtttcaggccggctcgccgccgaacaggacctgtccggcgacgaggatacgcattctctattcggtgatgatgcgcccgtgcgccccaccgagcgtcgcctgattgaagtcctgcccgaagccctgatcgtcaccgaccgcaacggtctggtccaatattcaagccccggctcagtgccattcggcctagtctccggcgaccgactcaactcgcgtgaagtcgaggacatcctcactcaggccgccgccgacggtggcatgcgtgagcgtgaggttcagctgccggtcaatcgcaattcctatccgtcctctaatggccgaggactggaggccggccagtcacgcccgtccaacacgctgtatttgcgtgtgcgcattggcgatatcggcgatgacctgtacgccatcttcatcaacgacatgtccgagcagcgccgtttcgaggccgtccgccgtgactttgtgaccaacgtttcgcacgaactcaagactccggccggtgccatcgcgctactggccgaaaccgtgaccgacgccgccgatgatccggacgccgtacggtatttttccggccgtatctccaaggaatccgcgcgcctgaccgaactggtgcatcatcttatcgacttgcagaaagcccaaagcccgcaaagcgtgatcgatgcgcggcgcatttccgcgctggatgtggcacgcgccgccatcgccgccaatcagacccaagccgactcccgccatgtggatatccgactgagtgtcaacggacagtcagtacccacgaaggtcgaggagccggccgatggcgaaggttccttggaagaatcaggcagcccagccacgaacggtccgatgatcaaggccgacaaagaggccatgcaaaccgccgtcaagaacctcgtagagaacgccatccattactcgcccgaacacaccactgtggcggtcggcgtgggggagcgcgatggcaaagtcaccattcgcgtggtcgatcagggcatcggcatccccgccaaatcgctggaccgcattttcgagcgattctaccgggtcgacccggcccgttcgcgcgagaccggcggttcgggactcggcttggccatcaccaagcactgcgtgcaggagaacggcggtcggatttcggtctggtcgcgtacgggggaggggtcgacgttcaccatcgagctgccggccgccccggatgaggatgacgacgaggcccggtcggacgagtcgacacaagcgtagggccttggttggtgcccgacatggtgccattccattgccacacaatcacacagtgggcgaggtgcgcacaccgcgcgtagcccaattacgcaattacgtactttcgggaaacagcaggctaacggagaacaaatggttacgataatgtcggaaaactttgcgcctatgcgcacgggaacatacccaagaaaggctactatgacacgcattcttatcgtcgaagacgaggaatcctatcgcgagccgctggtataccagctcacacgcgaggggtacgacgtgtccgccgccgccactggcgaggaaggtctggaactgttcaccaagggcggcatcgatttggtgctgcttgatttgatgctgccgggcattgacggcactgcactgtgccgccgcattcgtgagcagagccgtgtgccgattattatgctcaccgccaagagcgccgaaatcgataaggtcgttggccttgagattggtgcggacgattatgtgaccaagccgtactctttccgtgagctgctggcacgtattcgtgccgtgatgcgtcgcaatcaggccactgcccaggcttccggcactgtggatgacgatattccgctggtgtgtggcgatatcgccatgcaggttggccagcatcaggtcaccgtacgcggcgaaaccgtgttcttcccgctcaaggaattcgaactgctcgaatacctcatgcagaacaagggccgtgtgatgacgcgtcaccagctgatcgaccgcatctggggttcggattatgtgggcgacaccaagacgctcgacgtgcatgtcaagcgcgtgcgctccaagatcgaggaagatccggcgcaccccaagtatctgactaccgtgcgcggtctcggatacaagatcgatactcccgcggagtaaatggaaggcggccttcgggtcgcctttttttgttgtggattgtgggctcgctgtggactcgccgcaggcgagcccgctccaaaaactacgtagcctcaacgtagcccacaaacatccaagtgttcatcttctgtttactgatttcggttttgggcccttgaaaccaccaatacgcttgtagttgtcatgaattgaccgggcagcgctgagccgcccgcgaatagttgatagagggattaagtaataatcatgcagaagaacatcctcgttcgctccattgccgctctgtccggcattgtgatgctcgcttccgtggccgcctgcggcgataacaccgccaccacgaccgacaacagctcctcctccgattccacttccaagtccaccccgatctccggcaacttctcgggcgccggcgcctcctctcagcaggccgctgttgaagcttggatcgccggcttccagggcaccaaccctgaggccaagatcgcctacaacccgtccggttccggcgctggcgtgcagaccttcctgaccggtgccaccgcttgggccggctccgacaaggcccttgccgatgacgaagttgagcagtccaagtccgtgtgcactgaaggcaccgccttcgatgtcccggtctacatctccccgatcgccgtggttttcaacctcaagggcgtttccgatgccggcaagcacatcaacatggacgctgccaccatcgccaagatcttcgacggcaagatcaccaagtggaacgatccggccatcgccgatcagaacaaggacctgaagctgcccgacaccgccatcaccgtggtgcaccgctccgataagtccggcaccacccagaacttcgtctcctacttcaaggacgtcacccctgacaactggacctacgacctctccgagaactggccgaacgaggttggccagggtgccaagggcacttctggcgtgatctccaccgtcaagcaggccgacggcaccatcggctacgctgacttctctcaggtcggcgacctgggcaccgtggccgtcaaggtcggcgacaagtacaacgagatttccgccgaggccggctccaaggtcattggggattccaagcaggacgacaccgttaagggtgacaaccgcatcgtcatcaagatcaaccacgccaccgaggccgagggcgcttacccgattgtcctggtctcctacgacatcgtctgcccggcctacaaggacaccaagcaggctgagttcgccaaggcttggctgacctacgtgacctccgacgagggccagaaggccgctcaggatgccgccggcaccgctccgctgccctcctccctgaagtccgagatcaccaagtccatcgaggccatcaagaccaagtgatgacgtcggcccgcaagggtcgtgtggactggacctgacaactgaacgatagactgtagtagtaagagcagtcgccgccaactttaagccgcagtcgtaaaccatacggctgcggcttaaagcgggtcaggacccgaacggtttggcaacgtcacagacgaaaaccgcaccacttgaatacttgataaccaccctatataaggagaatccgtgagttcgcaagacaaaacggctgtgcagccagttggtggcaagaccgccgacaaggtgtttcgcggtgtggcatacgcctgcggcatcctgatcctggttgtacttgccgctgtgttcctgttcctgttcttccgcgcctggccactcatcggtggcgatcaggccgccaacagccagaccgtgtccagctttaccggcggcaaggccagcagcttctggggctacgtgctcccgctgttgttcggtactgtgctcgtgtctttgctggcactgctgattgccttcttcgtgtccatcggcattgcgctgttcatttcgcattatgcgcctaagaagctcgccaccgcgctgagctatgtggtcgatttgctggctgccatcccgtccgttatctacggtttgtggggcggcctgattctggtgccggccatctacccgttctggaactgggttgccaaccacctgggcttcattccactgttcgagggcccggccgccaacccgccgcgcaccgtcgccaccgtggctgtggtgctcgccgttatgattttgccgattatcacctccatgtcccgcgatatcttcatgcagaccccacgcctgcacgaagaggccgcgctggcgctcggcgccaccaagtgggagatgattcgtctggccgtgctgcccttcggcaagtccggtatcgtgtccgcctccatgctggctctcggccgcgcgcttggcgagacgatggccgtgttaatgatcctgtccccgggcctcaactactccatcaagctgctgcaggcctcgcagaaccagaccatcgccgcgaatattgccgcacagtaccctgaagccaacgatctgggcgtctccacgctgatcggaactggtctgattctgttcctgatcacgttcgtggtcaacttcatcgcccgtaagcttaccgagaaagcgactgcgtgatgactgctgctgagaacactgaaaagactccgatggacggcgcgcccgaaatcgacttcgatcgtttccgcccgacccgttccgccatccagcgccgtaatatcatggaccacttcatgtgggtcctgatcgcggtggcgtttgtgatcgcctgcatcccgctgatctccctgctgtggaccactatcgtcaacggcatcaagcgcctgaacctgaacttcctgagctacaacatgaccggtgtggtcggtggtaaccagaccccgtccggtggttacggcggtgtgctgcacgccatcatcggtactctcgaaatcaccgctggcgctatggttatctccattccgatcggtttgatgtgcgccgtgtacctggtcgaatactcgaaccgcggcaagctcgccaccacggtctccctgctcgtcgacgtgatgagcggcatcccgtccatcgtggccggcctgttcgccttctcgatgttcacgattctgctgggccccggtaccatcaacggtttcgaaggctccgtggctctctccctgctgatgctgcccaccgtggtcaagtccagcgaggaaatgctcaagatcgtgccgaacgatttgcgtgaggcttccttggctctgggcgttaccaagcagcgcacgattaccaagatcgtgctgcgcaccgctctgccgggcatcgtctccggtgccattctggccatcgcccgcgtgattggtgagaccgcaccgttgctgatgaccgccggctacatctccagcaccaacgtgaacctgttctccggccagatgaccaccctgccggtgttcgtctaccaggagtactcgaagctcagcgcgaactgcccgcccaacgccgacgccacctgcgtgaccacgattccgatggaacgtgcgtgggctgcggctctcgtgctgatcgtcatcgtgctgctgctgaacctcattggccgaatcgtggcgaaggtcttcgccgtcaagaccgagcgctaagccagtcgctaagcctaagccttaagaacacaaggaaatataaggaaacatcatgggacaacgtattgacgtcaaccacgagaacatctattacggcgactttctggccgtggaagatgtgaacatcaacatcgagccgaacaaggtcaccgccttcatcggcccgtccggctgcggcaagtccaccgtgctgcgcaccttggaccgtatgcacgagatcatccccggcgctcacgtcgagggcgaggtgctgctcgaaggcaagaacctgtacgacaaggacgtggatccggtggccgtgcgccgcgacgtcggcatggtcttccagcgcccgaacccgttcccgaccatgtccatccgtgagaacgtgctggccggtgtgcgcctgaacaaccaccacctggccaagtccgacgccgacgatctggtcgagtgggctctgcgcggtgccaacctctgggaagaggtcaaggaccgtcttgacaaccctggcatcggcttgtccggtggccagcagcagcgtctgtgcatcgcccgcgccgtggccgtccacccgcaggtgctgctcatggatgagccctgctccgccttggatccgatttcgaccttggctgtcgaggatctgatcaacgagctcaagagcgactacaccatcgtgatcgtgacccacaacatgcagcaggccgcccgtatcgccgactacaccgccttcttcaacctgaaggcagtgggccagcccggtcacctcgagtacttcgcggacaccatcacgatgttcaacaacccgcaaaacgaagaagccgagcgctacatctctggaaggttcggctgatcgtttcctgcgcgcagcgtaatgatttgtgcgtaggagaaacggcaaagcccgccgcaaggcgggctttcgcatattcaacgcgagtattgccgagtattatcgttctcgcaacggagcgagctggaatacttcgtcagactgggcggcgatttcccgcttcggtcgatcgacgggagaacggcggtaaagcggtacaagacaagtccgcacgatgaacactctgtgataaattttctgtttacgtgcgagtgtggaagaatggtcgcagcaaggtccagcaaaggagcataggtgagtactggtctgatcgtcagcatcgttgttgtcgttattatcgttgtcttgattggttggggcgtcagcgcctataacaacctggtgacgctgaagaaccgtgtgaagaacggttgggcgcaaatcgatgtgcagttgaagcagcgcgccgacctcatcccgaacctggtgaataccgtcaaggggtacgcatcccacgagtctgaagtcttcactcaggtgaccgccgcccgcgccggcgtagtggctgcggccagcaacccgagcacgaccactgctcagcgcgccgccgctgaaaaccagctgtcccgcgccctgttcaacctgcaagccacggctgaggcatatccgcagctgcaagccaaccagaacttcatggatctgcagaaccagctcaaggaactggagaacaagatcgcctacgcccgtcagttctacaacgacgtggtcctgaagctcaacaccgccatcgaaaccgtgccgacgaacatcatcgccggtctgttccactttgagcaggcgcaatacttcgaggccgatgacgcttcccgtcaggtgccacaggtccagttctgacccgcttcaggcccgtccggtaagccgccggccgggcccgtattgtcttaagagagggaagacatgcggatacgattcattcgcgccggaatcatcagcattgttgccacggtggtgttggcagttatcaccttggcgataatcgggacttccgcgttcggcgattcggccgacctcagctaccgcacgctggactatgacgtgaccgccaccgcgaacggtgatttgaaggtcacgcagcatatcgacgtcaagatgcgtgagcgtaccgacagtgacgacaacaccaagccgtggaagcagctgttccagcaatacacgctgaactccggcaccttgactgatatcagcgatatcagcgtgcgcaacgtcaccgacggcatcgactacgcacaacagagcgagcccaagctgcccagtgacgtctcttccgacaaggaatggaacagcgactacgccaaccattggtatgtcgccgatgtgagcgatggcagcgaccatccaaaggcatacacgcccggtaccgatggcctcaagcccagcgcctccgccaccgaagatgacacaaccgtggagatcggctggaatattccggtcaccaccgaggccgacagcatgaagttcgatgtaagcttcaccatgcacgatgtggccaccaaatggaaagacgtggcctccttccaatgggagccgttcggcaagaagaaccaagtgcctatcggcacggtcaccggcaccgtccacttccccaacggcatcaccggcaaaacctcatgggcatggctgcacaccgagcgcacttcggaaaccaagcgcaacagcgacggcagctacacgttcacggcctacaacatccacaatggcgactacctcgatgtggtcgcggcgttcgatgccgccaaagccaagggcatcgcccgcaagggaaccggcaatcatctcaaggacctgaaacaggacgaatataagcaacagcagcgctggctcgacaagcaacgattcgctgccagagctcgtctcgtgtcctggattgtcagcatcgtgctcggcatcgcgttgtgcgcgtggggtatctgggctgtgatctccagcaaccggcgtgcgcaataccgtggcagcgtcgaatactggcgcgaccagcccggcatcagtccggcttccgcagcccgtctgattcgcgtggtcgatccgtcgacgcgccaatccgatgaagaccgccagctgaccgccaccatgctgtcgctcgccgtcaagaaggccattgccgtctatccggggccgtcggacatgtatcgcggcatcgacatgagccaggccacgccggtaggcttgagccaaatgattgccgccgaccaaggcaagcagtatgcggcaggcatcaccagcaccatcgtgattctgccgctcgccattgatgaggcacccaacgcgcaacagttgggattgagtgaatcggaagatgcgctgctgaacctgctcatcgtcatttcgcagcgcgtgggcagcccggtattcgacctgaaccagatgaaggcgacctgccagaattggcaagacggctatattgagctcggcaaattcaccggtgcatgcagcatggaataccagcggctgggtgccacgcgctctgtgggctggcaatggatcctacccggcgtattggccgccgtgctgggatttggttcgctgctggccaacagctttatcggatacccggtggctggtcttatcgagctgccgatattcctggtcggcctgttctgctcgatggccggcgcgatgaccgtgctcaccgaccaaggccaggatattgccggccggactctgggccttaagcgttatatggaagacttctccaacttcaccgaccgtggtgccgccgatttggccttgtgggattggtatatggtctacgccgccgcgtttggcatttccgatcgcgtgatgcgtgagctggccaaggcctatcctcaggtcaacgatccggcttggctggatgccaacgcctccaactcgttgttctactggaactaccgcccgtatggctggtacagccaccgccacaatgacgatgctgccgggcagatggacccgggcattagcggcccagctccggcttacggaggcacgtcgtttgccggcggattctccgacctcggctcgcagctgaactccggactcgctgacatcagctcgaccatcagcgcggcagcaccatccgctgattccggtggcgatttctccagcttcggctcgggcggcggctccggtttcggtggctcgttcggtggctcgggtggcggctcgttcggcgggcggtaaatccagcgttctgcttacgctggaatcggacacagaccgtctcattactgttgaagggaatcaccatggcattgttccgtaacctcggaccgttctccaccaccgccatcggccacggcgaaatgccgctgaccatcgaaaacaatcgtggccacgaggtcggcatcgaaaccctgcatgcctcgctggacgccggctgccgtcacatcgacaccgcttgggcctactactgctccggcggcgaagaacagaccggtgaaaagctggtgcgcgaggcccttgagacctggaaggggccgaaggacgaggtgctggtggccaccaaggtgggccacttccgcaacttcaccgacggccgccccacgtgggatgtggacggtcgcccggagaacctgattcgtcgcggcaaggagagcgcactggcgctcggcgtggacaccattgacctgctgtacttccaccgccctgatccgaaggtgccgtacaacgagtccgtcgaagccatcaagcagctggtggacgagggcgtggcgcaggaggccggtatctccaacgcctccatcgagcaaatcgacattgcgcgcggtattctgggcgacaagctcgtggccgtgcaaaaccagtactcgccgattcacctggagacccaggacacgctcgactactgcgccaaggttggcttggccttcgtgtgctggagtccgctcggcggctaccgtcacccctatgatgagaccaagttcgacccgttccgcgaggtcgcggcggcccacggcgtgagctaccagcaggtcgtgctggcatgggagctcgccaagggcgaccacatgttcgtgattcccggcgcgcaccgtcccgaaaccatcctcgactccctgaaggccgaccagctcgaactcacccccgaagaactcgccaagctcggctgaactttctcagctccccttgtcaggggagctgtctcgcgtagcgagactgaggggtagtcgccggagtagtcccgggtagttccacaaggagataattgtgcgcaaaaaactcatcctcgacctcgataccggcatcgatgacgcgctcgccatcgcatatgccctaggcagtgccgacgagatcgatttgatcggtatcacggccacctacggcaatgtcgcggtgccgctggccgcgcgcaacgcgctggcggtactgcacttgttcggccgtgacgacgttccggtctatcccggagtcgaccatcccatcgccccggcaacattgccgaaaatgcgtggcaccacaccagacgagcgggcccaggcctacgcgcgctggcagaacggcggcgcggacggctggcaaacggacgcttcgtggtcaccaactcccggctcggtggcggtccaccatcccaacggcatcggcggcgcaatcatccccgactccccgcgcgctccggaagcaccaggctcggcggttgatttcatcatcaccgccgcgcgcgaatacggcccggacctgaccatcgtgcctacgggcgcgatgaccaccatggccaccgtattccgcaacgctccggacctgaaggattccggtgtgaacgtgacgttgatgggcggtgcccttacattgcccggcaatgtaagcccggccgccgaagcgaacatctcccaagacccagaggcagcagactatctgttcaagtgtggcgcacgcaccaccatgatcggcctcgacgtgacccaccagaccgcgctcactcgtgagaaagcccatgaatgggcgtctctggggacgccagccggcgactttctcgtcaccatgaccgactactacatcgacttctacctgaagaaccagccggagattcgcggatgtggactgcacgacccgctggccgtggccgccgcgctcgacccatcgctggtcacgaccttcgggttcaacttgcaagtcgatctcgagggcccgttccgaggccgtaccatcggcgatcgttcacggcttcaggaccccgacaaacacacgcaggtcgccttgggcgtcgatgtgccggaattcctggatcgtttcatggggcgcgtcaccgcggcggcccggtgacgcggacggcggccgtccggtccgctccacgccgtggatggatatgacccatggcgtggagcgcccttttgggaaccgacagaacatagggggggcggtgcatgcgcaccccccctatgtgtcagatcacgccgcagcccggaatcaggccgccgggcggatcgagcgtgagatattgctcctccagatcgatgtcggggaccaaggcctccacgaacgggaccaacgcggtcttttcgaccacatcctcgcccttggaattctggccggttaccaccggctcggtcaaacgaatcttgagcagggattgggcgggggagtcgatcacatccaccactttgccgaccacttggccggcgggcagtcccagaccgttgccctcgactagacgggcctcaaggccaataagatccttgggataccattcgtcggcctcgagcatgtcctccgcatcgtcgacctcgccgtagagttcgacaccgtttagggcctcggcggcattgcggtcgtcgacgccctcaagcttgagaatccaacgatccttgaacgtgcgcgagccctcgacgatgtactcggtctcgccatcctggctgtagagcacggagtccggctcgaagcgccactcgggatcatcggtgtacaggcgcacggtgacttcgcccttcaggccctgtgcgcggccaatacgagcgaccctcagcaactcgagctgctgagggtcgtcgtgcatgtcttgctgtgccatgctgtgaatcgttccttatcggttatcgacggacgtccatgatgtcaacgcggaccttgtggtcagacagtgcctgaatcacggtgcgaatcgcgttggcggtgcggccgccacggccgatcacacggccgatgtcttccgggttcacgcgtacgcgaagcagttcgccgcgcgcgttctcatgagacttgacggaaacatcgtcgggaaaatcaacgatgttcttgatgaggtgttccacagcttgtgcaagcatagctagcctttcgtttccgctcaggcctcagccggagcttcttcggcggcctcttcagccggggcttcctcagcggcggcagcggcttcggcttcagccttggccttggcagcagcttcggacttggcggccttcagcttctgagcctggtcctcaacggccgcgatgcgggcctcggcgtccgggccagcctcaacggtcttcagggtgccttcggcaccttcaaggcccttgtacttctgccagtcgccggtgatgttcagcagcttgaagacgggctcggacggctgagcgccgacgccgagccagtactgagcgcgatcagacttgatctggatggtcgagggctgggtgttggggttgtaggtaccgatctcctcgatgaccttgccgtcacgcttcttgcgggaatcgacgaccaccacacggtagaaggcgtagaacttcttgccctgtcgcttcagacgaatcttggttgccaaaatggctctccttgtaatgctaggtgtgcgggttctcggtttgccatgtggggcatggccgtccggaatccacgtgtcctcgcggctcggggtgtagagggcgccacgcgcgcgcgaataactggcctattatagcgcacagggccggactgggcgtggcgcactgtggttgcggtgtggtgcgcgttccccgttgcgcaacattccggggaatgtatcgcgaaaatgccggctatcgcagtgcaagcgttgcggtcagggccagatgatcagtgccctcgacctcaaacgacttcacgccggacggtttgagcccgggagtgaacagcacgtgatccagctcgatgcgcggccacttgagccagctcgggaaggtgagattcgggccggcggcttgaatcagacttgcgtccttgaatccggacttgagcaacgcgcggaagctcggatggtcggtgctcgagttgagatcgcccataacgacgacgatattgcgattgctgacggattttgcacgggcgagttctcgcagacccagaatgccggccgaccaatccgcgcagccgcgcatcggcgatttcgggtgagccgaacaaagcgtcaccgtgcgattaccggaggttttgagggtgatggcgggaacgtcggcggcggggatggagaccacgttgggcaccgctgcgctcggctcgtagcgggaatagatcacgttgaatccgccattatcggtctctttggcgtctccgaactgatggtaggggagaagttcgttgatgtcggcttcggtaagacgtgtgatgaggtcgtcggtgacttcctgcaaggccaatacgctgatattgcgttcgcgaatattgcgaatgatttcagcggcgtcggcgcgtccgtatcgacaattcatcgtcataaccgagaactggggcgagagtgtttcacgcgttgtttcacagtgtccatcggagatggtttcgggcccttccttcggagtgcttgaggtacccgatgtattgctgttatggctttttgacagcgtcggcgaagttgtttcacgggctgtttcacggtgggattctttgcgtttcccggccgggtcgattgacgtaccccagtagttgatgcgctgtgagctggcaatcagcgcgaccacaataagcaacgacatcgcagtccattcatgttgccatgcggcgaccgcggccagaatcatcaaaggaacccacaacagcggcgtcagggcaatcatgtacggaagcggcatacgggcctcgagaccggcgggcagcgcgcttaaggtcgtccataacagtgcgatgattgccaccgcgctgaggattgtcgtcatggaagttcctttcgaaatataaattgaaccgagatataatttggctcccctctgcgaggggagccaagttgtgagatcagcgaccgaacagtccgccaaggcctccgccgaggttcggcggcagttcagtgccaccgtcgacgttgcccatcatctgctcaaggccagcgggcagggccgggttctgtggcttcttggcgaaggcggaaccgccggtcgaaccggaggacttgccggccagcttatcgcgcaatgccttctcctcggcctcgcgcttcatcggattgccggacttgccgcccttcttcttgttcttgcccttcttcttgccgccgcccatagccgggccgccgaagccggggatgccgccgcccatgccgccacgattggacatgcgcttcatcatctttgcggcctgctcgaaacgctgcagcaaagcgttcacctgagaaaccgtcacgccggaaccataggcgatacgggcgcggcgggaaccattgataatcgacggatcgcggcgctcggccggggtcatcgagcgaataatcgcctcggtgcggtcgatttccctctcatcgaactgctcgagttccttgcggtgctgggccatgcccggaatcatgccgagcagcgacttcattgagcccagcttgcgcacctgctgcagctgatcgaggaagtcgtccaggccgaaggaaccttcggagattttctcggcggccttgcgggcctcttcctcatcgaactgcttctgcgcctgctcgatgagcgtcatgatgtcgcccatgtcgaggatacgcgaggccatgcggtccgggtggaagacctcgaagtccttcaggccctcaccgttggaggcgaacaggatcggcttgccggtcacggacgccacggacagcgcggcaccaccgcgggcgtcgccatcgagcttggagagcaccacgccggtgaagtccacgccttcgtcaaaggccttggcggtcttgacggcgtcctggccgatcatcgcgtcgatgacgaacaggatttcgttgggacgcacggcatcgcgaatgtcgcgagcctgcttcatcagctcctcgtccacgcccagacgaccggcggtatcgatgatcaccgtgtcgtagagcttctgcttggcgagttcgatggaatcgcgggccaccttcaccgggtcgccggaggtctggcccggagctgcgacggcctcgccgccatcggattggacgcccttttcgggagcatagacgggcacgccggcgcgttcgccgaccacctgcagctgcgtcaccgcgttcggacgctgcaaatcggccgccaccagcagcggcgtgtggccggaatccttgagccagtagccgagcttgccggccagcgtggttttaccggcaccctgaaggccggcgagcatgatgatcgtcggcgggttcttcgcgaagttcagcggacggtcgacgccttggccgagcacgtcggtgagctcctcgttgacgattttcaccacctgctgggcggggttgagtgcgtcggacacctcggtgcccagtgcacgctcacgcaccttgccggtgaaggaacgcaccacgtcgagcgccacgtcggcgtcgagcagcgcgcggcggatttcacggatcgtgccgtcgatatccgcctcggaaagcttgcccttgctcttcagatgcttgaacgcattcgagagtctgtctgtcaaagatgaaaaagctgccataatgggcaacagtctagccgccacgcgggaaattgcggtgttggggacgacgcttttcggggaatgtgccgcgtagtagtcagggatgttgggcattcagacggcaaatgccgtgccgtccgctcgtggcgaagccaatcgagtgcttccgataccatggaaaccgtaaagaatcctgtgttttttggaatacttacgctgttttgaaaatcgctggacaccgcttatacgcagactgccgtgcgctccgaaccatgacgttcgggccaacgcagacatgccgtgcaataaggaaggcccactgatgcccacccaaaaactactcgaacgcaaagccctgatcgttggtatcgtcatcaacgtgctgcaggtcttagccggcatggccgtgttcttcatgaccggtctcaaggccatgttcctcgacttctccttcaccgcgatttccgtcctgtccggaatggtggcggtgtacctctcgtcgcgcacggtgcgaaccaccgagcgcttccccaatggcatgttcgcactggaacctatctacgcgatctgcaaggccattttcaccatgtcgttgttggtgtattcgctgattgacgtgtgccgagtagcgtacgactacttcgtgttcgggtccggcgaacgcattgaaaccggcccggtggtcatctacgagatcctgaccgtaatcgtgtgcttcagcctatacacgtattaccggcgctccaaccgatccatcggcgattccagcaccatgctcaccgccgagtgcaagagcacgttggtcgacggatcgatgtcgttcggcatcggcgtagttgccatcttcctgatgctgctaccggccggcggtccgcttgacttcctgcactacaccggcgatttcttcatcaccgtggctttggtggcattgaccatcaaggagccgttcagcgtgctcaaagaggcgttcgtggaattggtcggcggcgtgcatgacgacgatgaaaccaacgcctacgtggaggccgaggcacagcgccatctgcctgccaacaccgactacgagcagacgctgatcttcaagaccggtatgaactacaccgttgacgtgtatctgagcggcatcggcgaaaccattgatgtagctgacctcatcgaatgcaagcgctcgctggaaaaggagctcagcaagcgcctgcacatcgtggacgtggacttcgtgtttgactgattgatgggtttgaagcgactacttcagactccaagtggaaccctgcgggccgtcttcgatggcgatgccggcctcggtcagggcgtcgcgaatctgatcggccttggcgaaatccttggccttgcgagcttcggcacgggcgttgagctgttcggcgatcagtgcctccagcgctgcatgctcgggcgactcggccgtgccatcagcggcaccgccggcagcgccggcggacacccacggttcggccagcgggtccaggcccaaggtgtcgagcatggcacgcacggcgagcagcgcctcacgcacctcggccttggcggtttcggaatcggcgcggtcagccagctgtgaaagcaacgtattgccggaacggatggcggtgaagatcgcggcggttgcaccagacacattgacatcgtcattcatggcggccacgaaatcggcgggcaaatcgtcggcggagacggcagtgacttcctcgcgagaaggctgtccacccagcgccacaccggcacgctcgatgaagttcgagacgcggtcgtatgcggcctgcgcctcgaccagcgcctgatcggaccattcgagcatcgaccggtactgcacggagcccagggcgtaacgcaccacccaagcggaatgctcagccaacacgctcggcacggacaggccggtgcccagcgacttcgacatcttctcgcccttggcggtcacccatgccgaatgcatccagcgcgcagcggaggggtagccggccgcacgggtctgagccatttcgttttcgtggtgggggaagcgcagatccaagccgccgccgtgaatgtcgaagccatcgcccaggtaacggtgggacatggcggagcattcgatgtgccagccagggcggcccacgccaaacggcgtcgaccaacgggcgtcctcgggatcggtgtccttcggagccttccacagggcgaaatcacgcggatcatgcttgtcgggggaggcatcggccgggtcgaccggattgtacttgtcggcaccggtggcgtccacggacgggcccatgcggtcggccacggcggcggcctcatcgacttcggaggtctgcttctggtgagtgagttcgccgtaatgcggccaggatgccacatcgaagtacacgttgccggtgggcttgccgtccgcatccgtgaccacatagccgtgaccgttgtcgagaatgcgctgaatcaggtcgatcatgtccgacatgtggccggtggcgcgaggttccacagtgggcggcagtacgccgagcgtgttgtatgcctcggtgaattcgcgctcgtagtaataggcgcgggcccaccaacgctggcctgcggccgcggccttaacgagaatcttgtcgtcgatatcggtcacattacgcacaaaagtgactttgtagccgagcttcaaaaaccagcggcgcacgatgtcgaacgccacggcggcacggatatggccaatatgcggtgacgattgcacagtcgcgccacacacataaatgccgacttcgcccggcttgagcggcacgaaatggctgacctggtgcgaggcggtgtcatacagattcaggccttctgcggccttggcaacatgcaccggcgtcaggcttgaaggcatgacggaaatgttgaaatcctgcggttcttggctgtttcccataacactcaagcgtagggtccgaaccagacatgctgaatcgttactcgaagagtttgatgaacgcttcacaggtggggcccgaacgaggtgacagacggatgagaagcgggacaacagtctcgcgagaacacgtctttgaccgctgcggaaactgcgagattcatggatttgccctgctcgttacgcaaacggggaacgctcgtgccacaatagaagtcatggccacaccacaagtgctcattttgcaacatgtcccatgggaacgcccgggacgcatattgtcgaacctcgaggacatcggtcttgagacggtgacgatgaatatcgtcgacaaaaagaaaccggacttgcctgatttcggcgaactggctggcgtggtaatcatgggtgggcctatgggcgcgcttgattacgacaagtatccggggctgaaggcagaagccaagttggcgcgtgccgccgtggcttcaggcaagccgattctcggtgtatgcctggggcatcagattatcgccactgcgcttggtgcgcagctgcgcaagggcgatgcgccggagattgggttcgcgccgatcaagcgtgtggacaagcatgacttcttctccatgtgggataagcagctgacagtgctgcactggcataacgacgtggtgggcctgcccgcggaaggccagctgctgtcgcgttcgtcttccaccaaggtgcaggcattccgactgggatccgcgctgggcatgcagttccacctggaagtgtgcggctcgctgctggacgaatggctggatgagccgagcatggtcaaggatctcaaggccgcgggtggttccaagtcccaattgcgcgagcagttcgcccaatacgaccagctactgcaaccgctcgccgagcaagtgttctccggttttgcggcccgctgcaactcctacgctcagacgctgaacaaataacgtttgcgggccgccgctgggcaagcgtggcgctacattggtgagtcatgccgacttatgacattggactggaacacgtttcgctcgctttcgctaccaaaaccatcttcactgatgtaacgcagggtgtttttgaaggcgaccgcatcggcatcgtcggcaagaacggcgacggcaaatccacgttgctgcacctgttccgcggtgctcaggagccggattccggccgcgtgacaaagcgtggcggactcacgttcggcatgcttgaccagcgtgatccccttgatgacaacgccaccattcgcgaagccgcacttgaggggcgcgccgactacgaatgggcgtccgataacacttcccgtgaaatcgtcgaggcattgctcggcggcatgagcctggatgccaaggtcggctccttgtccggcggccagcgtcgccgcgccgatttggcccgactgctgctcaaggattgggatattcttgcacttgacgagcccaccaaccatctcgacgtggtcactatccactggcttgccgaacatttgaagaaccgctggtccaaaggccagggcgctctgttgctcgtgacccacgatcgctggttcttggacgaggtctgcgaatcgatgtgggaagtccacgatggcgtgatcgagccgttcgagggcggctattccgcatatatgctgcagcgcgtggaacgcgatcgccaagccgatgtgcgcgaaaccaagcgccgcaatctggctcgcaaggagctcgcatggctttcccgcggtgctcgtgcccgctccaccaagcagaagttccacgtcaaggccgcacgcgaattgattgccgatgtgccgccgatgcgtaacacacttgaactgaagcaaatggccacctcccgtctcggcaaacaggtggtcgatttggtcgacgtgacgcagattttcgaaaaaccgcagggcatggccgatatcgacccggatgtggcggcgctctccgcgtccgcttcccgcgtggatgtggtcaacgccatgtacgccgagccgcagctgcatggttccgttgaggtggcggtcaccgacatgactgacccgcgcctggtggacgccggcgtgccggaagccgtcgagtccgctgaggaagcgcgtaagaaggccgaggctgagagcggcaatccgcagcttgctgacgatcgcgaggttcgtcgcatgaacacgggtggtgaaaccatcggcggtggcactgctgcaacggattcggatgatgacactgctgcagccggtgtcacctcggctgcacgcaaggtgacggtttccggccgcgagattcttgacgatgtgacttggctgattggcccgggcgaccgcttcggcatcgtcggtgcgaatggtgccggcaagtccacgctgcttaagttgattgatggcacactcaccccgaccgcaggccatgtgaacattggcaagacggtgaagttcgcggtgctctcgcagcgcctcgatgagctggagaagctcggcaagtacaagatcaaggaagtgctttcccgctataagccgagctacattgtggatggcaaggaagtgacgccgggacagttgatggagcgtctcggcttcgaatccgcccagctgatgacgccgatccgcgatctctccggtggtcagaagcgccgcatgcaactgctgctgattctgcttgacgagccgaacgtgctcatcatggacgagcccggcaacgatctggacaccgatatgctcgccgtgatggaagacctgctcgatacttggccgggcacgttgattgtggtctcccacgaccggtacctgctggagcgcgtcaccgatcagcagttcgcgctgattggcggcaaagtacgtcacttgcccggcggcgtgcaggactacctcgatatggttgaggctattaagaacggcaagggattgccggctgacacgcctggcttcgcgggcaccggtagcagctcggcgaagtctggtaagggtaaggcggccgccgtcaacgctgccgcatctctccctcagtccgcttcgcggatagctccctcgtcagagggagccaataacggtgaggactccacctcgaagctcaccggcaaggccttccacgaggcatccaagcgcgtgaatgccatcgaacgtaagctcgctaagcttgaagagcagaaggccgatctcgaggcgcagatggccgcccatgacccgagcgactacgagggtctcaacaagctcaatgaacaactcaccgccgtcaatactgaaagcgatgatctcgaagccgaatggctcgaactctccgaacaattggagtagcgggagaaaccgtaacgttcacaaggcctcggcagtttgccggggcctcccgctatgcaaactcccacggattaatcaattccacgtcggtaccttcgaagtccttgatattgcgcgtggctatggccgcatcccaggaacaggcaattgccgcaatcatggcgtcttgaatactggtaggtgtgcccctgtgttcgcgttcgacaaggatatgggcataatccgcagctgcctgagtgtcaaatgcgaacgttctgtcctctaatgtcataagcgccagcttgacggtcgtatctgtgtactttcgtcgtttgccttcaggcatgcgacatattccggccaacaactcggcgacggtgatggcggtggttgccaaattgcttgtatcttggttcctcagccaattggcaacgtgttcgtctggctgtttcttgatgatttcgctgatgacgttggtgtccagaataatcatggccgattcctattcaaaagatactggcggtcgggaatcggcggaatttcgctcggatagtgggagttcccccttgtcgagtccctcaaaatccatgttcttcatgaattcgcggatctcgtcatagaaattggtctttcgcgtgatttcatgcgccaccgtgccagccagccattcttcaagaatggatcgcacctgagattccatggagcggttgtttttctcagccacttctttgagctgctgaatctgctcatcgggtatttttcggatggtcaatgttgccatgatgcacctccttgttgctgtcataatgctagcatgaggtgctgtcgttttgcttgcagtacgggtgacgaggtatgcacgcatgaaaaaaggcggatatgcatcatgcgcatccgccttttgagcttggactgggtcttcccgcagtcgccgaatcagcgcccggtaacctcggaaccgacgaccttttcgctcagggcgcgcgggccgcgggtcacggctacggcaccggagcgcaccagctcaatcacaccgtaatgctccaaaagccccagcagggcgtcgatcttgccttcggcaccggtggcctcaatggtcagcgattccggattcacgtccaccacgcgcacgcggaacagacgcacgatctccagcacgtcggaacggttggattcgttggcggccaccttgatgagcaccagttcgcgttccacggtggagttcgggtcgagttccacgattttgagcacatgcagcagcttgttgagctgcttgatgatctgctccagcggcacggcctccacgtcggcggtcaccgtgacgcgagagatgtccggacgctcggtgggggagacggacagcgagttgatgttgaacgcacggcgggcgaacaggccggcgatacgcgccagcacgcctgggcggttctccaccagcacggacagcgtatgacgctgggaaccaggctgggatgcaggatagttagccatgagtgttctcctctcctcagtgctcgctcgcagtggcagcggcggtctcgtgctcgaacacgccggtcgcatgctcgtccggaccggttcccggagccggggtgccgccagccagcggcttgatgccgggcttgtacgtcacctcgtcgttgggggcgccggcggctaccatcggccacaccatcgcatccttccacacgcggaagtcgatcagcaccgggcggtcgttgatctggttcgccttttcgatggcggcaatcgcctcttcctcggtgaacgcgcggatacccacgcagccgtatgcctcggccaacttgatgaaatcaggcacttcgagcggcgcatcgccgtcggccagtgccgccgcaccatcggcaccgtgcgcttcaccatcgagcaggttggtctgcgagtagtggtgctcgtagaacagcgtctgccactgacggaccatgccgtatacggagttgttcagaatcgcgatcttcaccggagcgtggtccaggaacgcggcggccagctcctcagaggtcatctggaaggaaccgtcaccatcgatcagccacaccggcttcttgccctcgaattcacgggccgagcccacggatgcgccgatggcagccggcagaccgtagcccatcgtgccgaggcctccggaggagatccaagcgtgctggttctcaaaatcgatgaactgcgaagcccacatctggtgctggcccacaccggtcacccagatggtggacggatcggccatctcagagagcttcttgatgacccactgcggggccagcgatccgtcggtcggctcatcccacgtcatcgggtattcctcgcgccagccgtcgatcgccttccaccagggggccagattcggcttgccctgaatggcctgcgtacgctgaatctcgggaatcaagtcgtcgagcacggtagccacatcgcccacgatcggcacgtcgggctgacggttcttgccgatttcagccgggtcgatgtcaatgtgaatcacgcgggcggtcggtgcgaaggcgtcgagcttgccggtcacgcggtcgtcgaaacgtgcaccgatggccacaagcaggtcagcgcgctgcacggcgccggttgcggcaatcgtaccgtgcatgcctagcatgccgaggttcttcgggtcggagtcgggaatgatgccgcgtgcgggcagggtcgtgaccacgggagcgccggtcaggtcggccagagccttgacctgtgcgccggcgttggagcgggcggcgccgccacccacatacagcaccgggcggtacgactgagagaacagcttcgccgcgtcggacagcacacggccgtgcgccttggtggtggggttgtagccgggcagaatcatgcgctgcggccatgagtagtacatgtcgccggtctgtgcggtcttggtcagatccacgaccaccgggccggggcggccggtgttggcgatgtagtacgcctcggaaagcacgcgaggaatgtcctgcgcgcgggtcacgaggaaggagtgcttggacaccgggtaggtgatgcccacgatatccgcctcctggaaggcatcagtgccgatggcttgcacgcccacctgaccggtaatcacgaccatgggcacggagtccatgttcgcgtccgcaatggccgtgaccacgtttgtggcacccgggccggaagtcacgatgcacacgcccaccttgccagtggccagtgcgtagccttcggcggcgtggccggcggcctgctcgtggcgcataagcacgaagcggaacttcgtgttgtctttgatctcgtggtagacgggcagaatcgcgccgccaggaatgccgaagacgtcctcgacgccgaggtcctccagcgaacgaatcagcgcctgggcgccagtcatcttctcgccatcgacgatggtctgcttatcgggggccgtgttgattttcggtacaccgctgaatgcctgcaaaggcgtgggtaaagccatgattcctctcacctcataggttttgtcgcgaacctgcccgaccttgggatggggccgggtgcccgcgtgtctgattccagtcgcttccccgagacttgtggccccggcgcgactcgtcgctcatgttggtattagtctattcgcaaatccgacagcgggcttacttagtccgcgtcttgaacgagtccagtgacttccagcccgcttcggcggccgccagctgcgccttacgcttgctggagcccttaccgatgccgatgatgtcgccgttctcgcccaatgagacgcgcgcggtgaagatctgcgcgtattccgggccggagacctccatatggtagacaggctcctccttgccgaggccgtgcgccttgacggtcagcgaggtcttccagtcaagtgccgggccctcggtggccacttcggcgagcgtgtcgtcaataagccggtgaatcaccttgcgtgcctcgtcgatgccgtgttccaggaaggtcgcgccgatgagcgattccacgatgtcgcataggatggagttcttctccgcgccgccctgctcggcttctccgtgacccagcagaatgtaggggcccaccttgagcttggttttggcgatggcgctcagcgcgtcttcggagacggccttggcgcgcatcttggccagttgcccctcggtcatatccgggtgaatggtgaacagcgtttcagtggagaccagttcgagcaccgcgtctcccaggaattcgaggcgttcgtaattggccacgccggggtgctcatgcgagaaggaacggtgggtgagtgcctgcacgagcagatccgggctgagagtggtgcccaacgcttcaagaagctcgttggccggcgtcggctgctgtggggtttcattactcatgattgttgtatggtccttcacgcgatggtgatgtgttgtgttgtgttgtgttgtgttgtttgcgatgcgatggtgtacgcaatggtgcacttatgcgaagaccccgccacccgtcgatggcagggccttcattcaagccgttatcgcaggactcacttggtgtgagccggctggatggcggagcggtaggtgcggccgcggtagttaccgcagctcgggcaagccatgtgcggcagggccggagcgccacagttcgggcagttcacggtcgcagcagcggtggccttccagttcgcgcgacgcgaatgcgtgttggcgcgcgaggtcttgtacttaggcagtgccatttgagtatcctctatttcgttcgaacaattgagcttaagcgtccgttatcttaacgcacggctcgtacaaacttcgttcaggcgcgcgtcacttggcctgctcgccgttctgctcggcctcgagctgggctttgagccccgccaatccggcaaaacggatatccgtcacatcgtgatgatggtcgggatcctcgttcagatcggcaccgcactgcgagcacagacccctgcaatccggtcggcacagtggttgcaacggcagcgattcgaccagcgtgtcgcggatcatcgcctcgatgtccgcgaatgcgccgttctccagcagcggatacgtgtcttccgactcgtcctcgccggcgatgatgtcgatttcgtcgtccttcttgctcttgccgcccttgccgttggccttgtcctgacccgactcgtacgggaagaacaccgtcacatcaaccggccagtcctcgtcaatcggcttcaggcagcgcgtgcactcgctgacgaatggcgcgaccaggcggccggtgaagatcaggccgtccacaatcgaatcgaactgcccgctcacgtgtacgggctcaccttccttgatgccgacaatgctgtcgccaatgccggaaggtgccgggaaatcggcgtcaatcggcttggattgaccggcgcgcgaagcaatctgcgctaccggaatggcccacggggaatcttcaactcgtgccatggtatgttcttggtgcctttcgtatgttggctggagttattcgttactggcgttatttcgcgttactgatgttgccggcgttgctggcgttactgggcttcgggatagtcgttcagcgtcaggtgcggcatctgttcgcgggccgcgcgctggcgctcttccagcacgttaagaccggcctgcacatcctgactgagtttgccgagctgctgggacagcccttccatcaccgtagtgcagtactggtccgcgccttgggtcagatggtcggctttggtctgtgcctggtcaagaatcgcgcgcgctttctgccgtgcaagctcggtgacgttctcttggccggccaggaactgtgcctgttcgttggcgtccctgatcatgttggctgcgcggctttgtgcggaggcgacgatggcgttggactgggtctgtgccgattccagacggcgctcggcctcgcgcatgagggcggaggcgcgctccaactgcaccggcagcattttcttcaactcggaaagctggtcggtgaattcgtcgcggtcaaccttcaccatgccggggacgaatatgctggacttcgcttcgcccagtgccgcctcgagctggtcgatgatgtcatacaccgtggtgaattcctcgtggctcttgaccgtggccgggtcgtcgtccgtggtttctcgcaggtcgggcatttcgttcatgaacgaggggcgaatgccggcggcctgagcggtctgagcctgtgcccgggtctgctgagctgcttgggcctgcgctttggcctgcatttgtgccggagtaggggtaggcgcggcgggcggcgatccggcgagaacatcggcctcttcggtgggtgccggcgcggcttgcgtagacgcgggcggttccggggcggacggctccggagtggacgatgcggcgtccgcattcggtttggtcagatcgacgtatccagtagggtggtcatcgctcatagtcattagtgcatcagtccttccgctgacgttcctcggccagggcatcggccagcatcggcacgacgcaatcgggcaccatgccggtcacgtcgcctccatggcgggccacgtccttgacgatggaactggagatgtgttcaagaatcggatcggccggcaaaaacagggtttcgatgccagcgagcttgcgattgaccagcgccatgccgagctcggcttcatagtcgccgttctggcgcagacccttgatgataacggtggcgccgaccttcttgcagtagtcggtgatcaggccgtcggtggaagaaacggtgacgttcttgcaaccggctttgtcaagggcgcggcggatcacgtcgactctggtggcttcggaaaacatcggtgttttcgcggcgttgacggccaccaccacatgcacctcgtcgaaaaaccgcgccgagcgctcgattacatccaagtgtccggcggtaacggggtcatacgagccggggcatactgcgatagtcatgctttatagcctaccgctagtggtgtgcttcgtgctgccgagcgtgcattgttgtcgcgtcggcgtatgaggcagtgtgtgcggtgccgtatgtggcgtcggtgtggcgtcgtgtgcggcattgtatgtggcattgtatgtggcggggtggcgtgatgcgcgacatgggtgtgtggaggtgtgcggattacgcgccaatgggtttcgcgggtaacgacgggaatctatgatggagtgcagtcgaatcgttgaatacgaggaaagaagtgcaccatgacttttgccgagatgttcgttgatgatgccgaaccgctgcgcaacccggaccaaggtgccggcacgtcggtgctggagcgtccggagaccaaggagtcgccggttcgtgacgatggtggcgacgccgatcgttttgcgcactacgtatccaaggaccgtatcgctgaatcgcgtgcgaccggccgcccggtggtggccctgtgcggtaaggtttgggtgcccaagcacgatccgtccaagtacccggtttgccccgactgcaagcggatttacgaggaaatgacgcgctaaaggtggtacttggctcccctcagcgaggggagccaaaatggtcaccgagccgaaatctcgtcgatcagcttgagctcctcgtcgctgaagtgggtgttcttcagtgcgccgatgttgtcgagaatctgctgcggcttggaggctccggtcagcacggaggtcaccttgccgtcgtgcagcagccatgccaggctcatctcggccagcgtctggccgcgttcggcggccagattgttcaggtccacaacctgcttgtgcagtttctcggtcagggcggaatcgttgaggaatcgcggatcgtgagccatgcggctgtcggccggaatgccgttgagatagcggttggtcagcaggccctgagccagcgggcagaaggtgataaggcctttgcccagcttgaaggcggtctctttcaggccgttcttttcaacggtgcggtcgaggatgttgtacttgttctggttgatgatgaacggcacgtgcagttctgccagaattgcggcggccttttccatcgtcggaccatcgtagttggacagacccacgtacagggccttgccggagttcacggcctgagccagcgcgcccatcgtctcctcaagcggggtttccgggtccgggtggtgatggtagaagatgtccacataatccaagcccaagcgttcgagcgactggtcgaggctggcgagcaggtacttgcggctgccgaggtcgccatacgggcctgcccacatttcatagccggccttggtggagatgacgagttcgtcgcggtggtgcttgaagtacttggcgagcagcaggccgcagttcttctcggcctggccgggctcgggaccgtagttgttggccagatcgaagtgggtgatgccgttgtcgaaggcggtgaagaccagggacttcatctggtcgaatggcgtgatgtcgccgaagttgtgccagaagccgagtgagacggccggcaacttgaggccggaggtgccggcacggttgtaggtcatcgtgtcgtaacggtgcgggttgggagcgtaggtggtggttggctcgaacattgagtctccttacaatgtcatttttgttcttacgaatgctggtctgcgatgggcaaaccgacgccgatcgagtggtattcgtaagtgttcttagatactaaggttccagttcaagtgaacttgaatgcaaacggctgcgacgcttcggcgtgtcgccgcagtaaggagtcatgatgtcctacaccattcgtcaggtggccacgcagttccatatgcagccctctacgctgcgctattacgaggatcagggattgctgaccaacgtggagcgcaccgaaaccggccagcgtatatacgaagactgccatatcgaccgtctgcgcgcgatctgctgcttcaagaacgccggcatgaccattgacgatcttaaaaagttcttcgtgtatgagtccaatgagcccgagcatatcgacgaaatccttgatctgctggaatctcgccgcgaatccttggacgagcagcgccgaaccctcaacgaggcggccatgcacgtgcagcgcaagctccattactatggcgacatcaagcgtgccatcgacgccggtgaagactggccggattggcgcgagtacaaaaaccgcgcctattccattgaatgttgagaccatcgaatgttgagaccatcgaatgttgaggccatcgagtgctgagctggatgccggctgggcactaagaccaatgcgcgtcgatcgtgggcgcgtctatccgagtaaggccttgctcggcagtgcgcggtcgagcagccagacaacgagcgatatcacgaagaacgctatggccagcttgccgcagctaatgccgaacccttgccagccgagtgcgtcgaggttgatgaagtcgtacggatacggactgccgccggccgccggtccggaccccggccaaatcgccgcacgggccagcacgaagaccaagtatgcagggaagtacgccagccacgagaacatgtaatgccagcggaaacgccggtgcgggtcgaatagcacgaaatcgataaccgccataatcggggcgattttgtgcagcatcgtattggtcatgatgccaataacctgtggcacgtatgccgggtcgtccggaggcgtcaggaagaacgccaccagtgcggtgactatggcgtacacagtcaggcaccccttaagccatgcaggcggctgaatacctttgagcagtgtggccgcgccggaccacagcatcacgatgcccagcacgaaaccggtctggaacgtgaaatacacccagaactgcggtttggaccatgcctcatatgtgcccacgaagcagaaaccggcgatcgcaaagcgccacaacgccacgatgaatctcatgcatcgagtctaccgcttcgccagtgggccgtatggtgcggctggcgtattggctggtcgtgatgattatggtcggtgtgaccgaccgccatagtgccgatgaatatgacgatactgaacccggcaatatcgaatctggcgatacgagaataagacgagcccttcccgcacggctttgcccggactacacttaggtgcaacttcaccacttatgtaggaaaggccttgcaatggtcgattattcgccggctctgatgaccgacatgtatgaatacacgatgctcgacgccgctctgaaagacggtaccgccgaccgcaagtgcgtgttcgaggtgttcacgcgtcacttgcccgaaggccgtcgctatggcgtggtggccggcaccggccgcattctggatgcgctggaacatttccacttggatgaagcggatctgaagttcctggccgaccgtcacgtggtaagccccgagaccattaagtggctggagaacttccacttttccggtacgattcgcggttaccgcgaaggtgagatgttcttcccgaactccccaattttgcaggtcgaaggcacgttcggcgaatgcacgctactggagacgttgattctatccgtgctgaactacgattccgcagtggcctccgccgcctcacgtatggcgtcggcagccaaggatcgtccttgcatggatatgggcggacgccgcactaacgagtgggccgccgtggccgccgctcgagctgccgtagtgggcggattcaagggtaccgccaatctgctggccgcccagctgtatggtctgaaggccattggcaccgccgcgcattgcttcacgttggtgcatgattccgagcgtgacgcctttgaatcgcagatcgaggcattgggcaagaacaccacgctgctggtggacacctacaacatcgaggaagccgtgaaaaccgccgtcgaagtggccggtcccgaactgggtggcgtgcgcatcgactccggcgacttggccgccatggcccagcgtgtgcgcaaccagctggacgccctgggtgccacgaacaccaccattaccgtgaccaacgatttggatgagtacgcgctcgccgcattgcagaccgcgccggtcgactcctatggcgtgggcaccatgctggtcaccggctccggcgctcccacttgtgcgatggtgtacaagctcaccgagcgtgaaggcgctgacggcacgatggttccggtcatgaagaagtccaaggataaggccacagtgcccggtcgcaagttggcattccgctcctacgaatacgcgctagccgaagccgaacacgtgatttccggctcggaagagaagctggccggtttcacgcccgaaccgacgtggaagaacctgctggtcgatttcgtggaccacggccatatcgatgcgcagtggcagggccatgacgctatcatggccgcccacgactaccacgccaaggcgttgtccgaactgcccatcaccgcgcagagcctcatgaagggcgagccagtgattcctacggagactcaggttctctgacgagaactttcgtctccataggaatccgtcgcagcatagctgctccctttacctacggacagcccactgggctgtccgcttaacggttcgaccacagagaccaaagtcctctggccgtatctcactggccgcatccctctggttacattggctactcttccctctggatgagtgaaactctcaatggtgataacgcggcgggcaacgatgacgtatcagagcggcgcgatgtagttcgatgatggttgacgagttgctatccaggcatagaacggatggcgtatgctggggcgcatggttgaaatcaaagacatgcttggcaatcaccaaataattcgtgccgacggccgcaaggtcgacgaactgcgccctgtgcgcatcacccgccacttcaccgacgcccccgaaggctccgtgctcatcgaatgcggtaacacgcgcgtgatgtgcaccgccacttttactcccggtgtgccgcgttggcgcaaggactccggcctcggctgggtcaccgccgaatactcgatgctgccgcgtgccaccgccgaacgcaccgaccgtgaatccgtacgtggcaaaatcggtggccgtacccacgaaatcagccgactgattggccgctgcctgcgtggcgtcatcgatatgaaggcgctcggcgagaatcagattcagcttgactgcgatgtgcttcaggccgatggtggtactcgcacggcttccgtaaccggtgcgtacgtggctttggtcgacgcagttaattgggcggagaagcaccgccatatcaagtccgccagccgcgtgcttaaggactatgtgtccgccgtatcggtgggcgtgatcaacggcactccgatgcttgacctgccatacattgaagacagtcaggccatgaccgacatgaacgtggccatgaccggttccggcaccttcatcgagattcagggcaccgcagaacaccgtccgttcaaccgtgccgaactcggcaccctgcttgacttggccgaaaagggcaacaaggaactgcaagccgcccagcgtgccgctctgtccctagactaagccagctcccctgacaaggggagccttcttaaaggagaacctcatgcaaatcgtcgtcgcaacccataacgaaggcaagcttgtggaaatccgccgcattctcgaagaggatcttggcgcggatgccgaaaacatcgaactggtgtccgctggcagccttcacctgccggatccggtggaaactggcgtcaccttccaggagaacgcgctactcaaggcccgcgctgtggccatccgtaccggtctgcccgctgtcgcggatgattcaggtctcatcgtcgatgtgatgggtaacgctccgggcattctgtctgctcgctgggcgggtgctcacggccacgacaaggccaataatgcgctgctgctcgcccaaatcgaagatattccggatgacaagcgtaccgcgcgcttccgttgcgccgccgcgctggtggtcccggacaccgagaccggtgccgacgtgaccggtggagtggctgccgacggcatcaccgttcacaccacggctgccgatgggagccctgccccggtgcatgctcgatacgccatcaagtcggagacagtggagctcggcgacatgccgggtcgcatcatccgcgaggctcgtggcgtacacggtttcggttacgatccgctgtttgtcccggacgatcagcctgccggtcgcgtcagcactgagcctgaccatgaaggcgagccgctgaccagcgccgagatgactccggccgagaagaatgcgatttcccaccgaggcaaggcgctgaaagccttggtccccgccatcgaggccctgctgcactaagtcgtctaggctgtctagctgcactgagccgcgactaagccacagttgagtcgcggctcagcactcagcccccgaatcgggcgagtgtctagcaagcgcctatgacctagcaagggcgatacgaaagaaggccggcgcttagtgcgtcggccttcttgatgaacaagagccacccgatagaatcgaactaccgaccttcccacgaacgagggggatgctctaccactgagctaaggtggcgtggcttcaagagccaagtagagaatatagcactgcgtttgattcactgcaagccggacattcatcatctttgggccattgttctttggaccatcgtggcggcaatagtgcgaacgatgtgcacacctcatctgctcggccgccattcgtcgtgtgcgcgctatgctagcatggtgagcctgattgactcggaggcaaagggaagcatgcgtgattttgtgctggtgaagttgacagacgaggagttcgatgatttctccgccagacatccacaaggcaatttccaacaaacctcggcgatgggacgccttcgcaccgcgcaggggatcgacgtcgaatatttggccctcaaggagggcgagaagatcgtcgcggcggcactgttcgaaactcaccgctctcgattctctacatttgcggtcatccatgatggcccgatgtgcgactatcacgacaccgaagcattgaccttcttcatggatgtgctgaaacgccatgccaaggcaaagggtgcttcacagctggaaatcacccctgaatccccgtatcggcttcgcgacaccaatggagcttctttgccggatgaccagaatggcgctcccgacaataagctgatagaacagctcgaggcgatcggcttcactcatggcggtttcaccgtgggctacacggcggttccgcgttggcgctacctcaaggatctgaccggcattaccgatgagaaaagtctgctgaagtcctatgacaagcgcacccagtggagcgtgaagcgtgcccaatcgatgggtgtgcacgtgcgtgagctgtcggacgacgagctgggggtattcgcacgaatcgagcagcaaaccgctgaacgccgtagcttcgaataccgtggcgaagcatatttccaccgtttcaaggaagcgttcggcagcaaagcgcattttatggttgccgagatccacatcgacgaatacgtagcggacatgacgtccaagcgtgaagcgctttcggccaaggtggcggcattgaccgccaaaaacgccgaacaccccaccaccaaaaccgaacgtcagctgggggaggagacccgcaatctggcggcagccgaaaagcgcctgaacgaggcggccgagttcgccaaagacggggatgtactgccggctgcggcatcactattcgtggagcatccgcgcgaggtcatctacctgttctccggtagcgtcgagcagtacaagcccttctacgcctccgcgctgattcagcatgacgcgatgctgcatttctgcgtggaacacgggctgtctcgctacaacttctacggcatcgacggcgtctttgatgatcccgatgacgaggggcgtggtgtactggagttcaagcagggcttcaacggatatgtcgaggaacttccgggcgagttcgtgctgccggtcaaaccggtcgcctatgccatgaagcaatttgcgcacaagctgctgtcgcggtaaacggacgcagcacacaggccattccagagcccagagtaacgatcagagtaacgacaagtaagaaggttcgattatgacgcaatccgatgcaggcgtcgcctcgctcacccctaccaagatcactcctgccgagctggatgcgttctccgcagctcaagtgcaaggtagtttccagcagacctcgcagatggccgccatgggtgcgttcaacggtccggtggactatgtgggtgtcaagcgcggtgacaagctgattgccgcctgctacgtggtgtacacgcggtcccgtttcggtttggaaggctcggtctggtgcggaccgctgtgcgattatgacaatccacaggtggttgaggcgatgaccgaagccctgcgtcgttcagccaaggcccatcacgccatcagcgtatcctgctggccggccgcagtctaccgtctgcatgatctggacggcaagccgaccagcgacccggacaccacgatgatggacaacatggcccgcttcggttggaaacatggcggcttcaccgtgggctacgaatccgtggtgaaccgctggaacttcgtcaaggggcttgactgcattcatgacgagaaggaactgctggcctcgttctccaagtaccgccgtaagaacatccgcatcgcccaggattccggtctgcgcgtgcgccgactggaacgcggcgaactgagcactttcgtcaagctgtgcgatatgagcgccgcacgtcaaggcttcaagagccgcgatctggcctactatgagcgtctgttcgataccttcggcgacctgatcgagttcaaggtggtcgaaacccatttcgacgaatatctggacaccctgcaatccaagctgaatgcggcctccaaagacaagcgcaacctcgaacgcctgctccagcgcgcgcaacagcagccggaaggcacggccaagaagggtgcctccgacccggcaacgctggaaaagcgcatcgccaccgcagacaagaagatcacggcgctggaaaagaccatcggcgaagtcaatggcatcatcgcctcggacggcccggtcattccggtggaagccggtgtctacttctggcatccgaacgaggtcgtctgcctgtccagcggcgaggacgatcgtttcatggattactacccgtcttccctaatccacttcgaggcgatgcttgactgcatcgcccgtggcgtggagcgcttcaacttctacggcatttccggcattttcgacgccaacgatccttcctacggcgtctggcagttcaagactcgcttcggcggattcgtggaagagcttccgggcaagttcacgctgccggtggacggactgcgcttcggtgtatccgaagccgcacacaagctgctgcatcgctgacaaacagtggcgagcacggacacagaaataaggcacaggtgacgacgagatgagcgcgactgcgaatcgaacagatacgacgtatacgtttggcgtgattacgcccgaagagttcgaccggctttccgaagccacaagccagggcagctttcagcaatggtccgggcaggtccgtcttgccaagattcgtgggcatgaagccgaatgcgttggcgtgtgcgacgcatccggcaatctggtagccggctgcgtgattctgtacctcaatggtcgtttcggtgcagatggctccgtatatttcggccccatcggcattagcgatgatccggctctgctgcgggccataaccgaggcgattcgtgaatcggcccgtcgccaccatgctgtttccgtggcatgctggcctaacgtcgcctaccgtctgtattcctcggacgggcagcccgacggcgagccgaacgatgcactgctgaccggattcaccgatgccggctggacgcatggcggattccataccggttatgacgtggtctgccagtggatgtacgtcaaggatctcaccggcatcaccaacggcaaggaactgctggcatcattcggcaaacgcgctcaatggagcgtcaagcgggcgcagtcgatgggcgtgcacgttcgcgaaatcggccccgacgagttcgacgtgttcgccgatatcgaacggcggaccggtgaacgccgcgggttcgcgacgcgcggcgcggactatttccgccagttcaagcaggcgtatggcgcggatgcgcatttcatgctcgcggaaatccacatcgccgaatatgtggcggatatgaccgccaagcgcgaggccttgcagaccaaggtcgcacagctgcagacgaaatacgatgaacgtccgaccacgcgcatcgaacgtcagctgggggaggaatcgcgcaatctcgcggccgccgacaagcgtctggctgaggtggagggatatgccaagaagggcgatgtgctgccggcagcggcttcaatgttcgtcagtcaccccaatgaggtggtctatcagtattccggttcgttggaggagtacaagccgttctacgcctcggcgctgattcagtacgaagcgatgctgcacctgtgtgtggaacagggtgtgagccgttacaacttctacggcatttccggcgtgttcgacgatccgaacgacgagggccgcggcgtgctggaattcaagcagggcttcaacggctacgtcgagcagatggtaggcaaattcacgttgccggtggacaagttccgcttcggcgtgagcaatctggcgcacaagctgctgcaccggtagcagctggcggccgggggacgaacctatgtgggctgcgtctcgcctgaccgtgcgcccgccgtgcgcctacttgcgcatttgctcacacgcccatcagcgcgtgagccacagccatcatcaccagtgaaatcatcgcggtgattgccagcgagaagccggccagtttggcgttgccgagtactttgtcggtgaacagcgtggagaaaatggcgatcggagccaacgcgcagatcaccatcacggcgcgaatcgaagccgagaacggcagcaggagccacgcgatcaacgcgaaggcgacgctgaacggtatacgccaagcgatgacggccatgacttccttcacgtcatgcttggattggggcaggtccatgagcatgcccaccatcagcatcgacaccagcgcgttggcgccgctcaatggctgggttatagaggcgatccaatcgggaatcttcacgttggcgacggtcaacacgatcatgagcagatacgtgtcgaacggcaccgagccgaagaagctcttgccgatggtgcgcagcaatgcgcggcgggcaagccgtttggcgtcgcgatccttgggcttttcgtacggtagggtgggagccgaaccggcgtgttgttcggcaagtgttttgccgggctgaatatgcagcagttgctgggtgagcacattggtgccggcggccaccatcacgcagttgccgatatcgaacatcgcagccggcaccaccgcgcccgcaccccagaatgactggacgaccgggaaagaaaaacagccgagattgaagccggcaccgttgagcatcaggaaggcgcggtcggtcacattgcgcttgcgggtggccagaaagatgaacacgaccgggataaaagcaaacaggaatgcgaataccgaaataagcagcagcgagatgtcatgcggattggtggcgaacgagtatacgatggcaccgggcagcacgatgttgaattccgcggtttgcagcacgcgataatccttctgcccgaacaggccgaaccgcttgaacagatagccggcgaggatgatcagcaacagaccaaccggcgtaagaatggcggacatacacttctctccttgactcacacaggctcatggcgcacaggctcagacccgcaatgctgtggcccattatatttgccgccttggcattgccatatgtagaggtgtccgcaagggcttgcagctgccgcgcgcatatacgaaaagcctcccggaagcgttggcaatccaatgcttccaagaggctcaagccggtgcgcgagatgggacttgaacccacacgtcaaagacacaggaacctaaatcctgcgcgtctaccaattccgccactcgcgcgtgcatatccgcgtttccacaggtgtggaagatatgtaaaaccctaggccggacagccattacagaccagccagcctagggcatccgagccacttgtcagaatcgaactgacgacctgctcattacgagtgagccgctctaccgactgagctaaagtggcttggttcgcggaaggcatttcgccagccgcgcacaagaagttaagtataagacatccccacgaaaagtccaatcggcggattggcggttgtgtcgcgaccgctcagtcgaagatgacggttgcgccgcgccgtgaactgttcgataatgcaaacgatggcaatccgacatcgctgactcattttgttctgttcatgtccgaatttgtgagtattctgtttggtgatacggagcgcatccgagccgtgtgcaagggcgctccagtcactgatgaaaggaatggaatcctatggccatcaatccgcccgttgacgccacccagacccctgagtgggctgccctgcagaagcactatgacgagcttcaggtcgaaggcgtgagcctcaagaagtggttcgccgaggacgccgagcgcgtcgagaagctgtccttcgacgccggcgacctgcacttcgatctgtccaagaacctgatcaagccggaaaccctccagctgttcgccaaccttgccaaggccgtcaagctcgatgagcgcaccaaggctatgtacacaggcgtgcacatcaacaacaccgaagaccgcgccgtgctgcacaccgcgctgcgccgcccggtcgaagacgagggcaagtacatcgttgacggtcaggacaccgtcaaggacgtgcgcgagacactcgacaagatctacgctttcgctgacgacgtgcgttccggcaagtggaccggtgtgaccggccgcaagatcgagaccgtggtcaacatcggcatcggcggctccgacctgggccccgtcatggtgtacgaagctctgaagccgtacgctgacgctggcatctccgcccgctacatctccaacatcgacccgaacgacctggccgagaagaccaagggcctcgacccggagaccaccctgttcatcatcgtctccaagaccttcaccaccctggagaccctgaccaacgctcgcgaagcccgcacctggctgctcgaagagctcaccgccaacggcgccatcgccgagggcgacgaggctcagaaggccgaggccatcaagaagcacttcgtcgccgtctccaccaacctggagaaggtcgaggagttcggcatcgacccgaacaacgcgttcggcttctggaactgggtcggcggccgttactccgtcgattccgccgtcggcacctccctgaccgtgatcttcggcccggcccgtttcgaggagttcctgcacggcttccacgagatcgacgagtacttcgccaacaccccgttcgagaagaacgtcgtggtgctgctcggcatgctgaacgtctggtaccgcaacttcttcaaggttgcttcccacgccgtgctgccgtacgaccagtacctgcaccgcttcccggcttacctgcagcagctgaccatggagtccaacggcaagtccgtgcgttgggacggcacccccgtcacctccgagaccggcgagatcttctggggcgagcctggcaccaacggccagcacgccttctaccagctgattcaccagggcacccagctcattccggccgacttcatcgcgttcgtcaacaccccgaacccgaccaaggacggcgaccaggacgtgcacgagctgttcctgggcaactacttcgctcagaccaaggctctggcattcggcaagaccgctgacgaggttcgcgccgagggtactccggaagagatcgttccggcccgcgtgttctccggcaaccgtccgaccacctccatcttcggtgtggctctgaccccgttcgcactcggcgagctcatcgccctgtacgagcacatcaccttcgtggaaggcaccgtctggggcctcgactcctacgaccagtggggcgtcgagctcggcaagcagcttgccaagcagatcaccccggccatctcccaggacgacgacgccctcgccgcccaggacgcctccacccagagcctgatcaagttctaccgcgcaaatcgcgaattctgattcgctttgctcggtcagaattcgtgattcgcgcgaccgcggctgtgctgtctggtgggcagtctggcgactgcccacgttgcgaattctgattcgcttttctagctcccctcaatactgaggggagctgtcagcgaagctgactgagagggagttatggaacgctccgtatgctccccccctcaactatgactgttgccggcggcgaaactactggaataatcaccgtccatcggactctcaccttcttcaagccgtgcgctgaaacgccaaatcaataccatcgtcggtatccatgcgaccagcaggagggacggaaagtattcgaatccgccatccgtgctgcctcggccaaactgatgcgttaataacggagagagacgacgacacgccgatactgtccgcaagaatccgtacaataatcgattgctgtgtcgagaagtgggccgccgcataagcccgcgtctccgtgggtccagtccgaacggccgcaaggcctggcttttggcggatcggcaggcttcccaagggcaaactcgagggataacgagaacaggtcaacgcgcgcgatgcgcaatcgcgtggatggccccagatctgtggctgatatgcggcagcactgaaggaaaacaatggttaacgctgttgaggcttttgacgccaagcacatgaagccggccgaggaaatcccggccttccgtcccggcgacaccgtcgacgtgaacgtgaagatccaggaaggcaacaactcccgtatccagaccttcaccggcgtggtgatcgctcgtaagggcgctggcgtgcgtgagaccttcgtggtccgcaagatcagcttcggcactggtgtggagcgtcgcttcccggtgcactccccgtccatcgactccatcaagctcgtgcgtaagggccgtgtgcgccgcgccaagctgtactacctgcgcgctctgcgcggtaaggccgctcgtattgccgagcgccgcgacaactccgctaagtgagtcgattcgcgggtgcaatcgtgagcctgatgatgcaggcacgcgaataaaccgtgaaattcagcccggaaccgtttcggtttcgggctgttttcgtattttccacgtatgatggacgggcgccggcacccctcatatccggcagcatgaatcgcgaggagatggtatgcaggacgatcaggataacggcgaattcccggtttccgacaatccggagagcaaccagacctcgtatgatgacgaggccgatgcccgcgattcccgcacgttccaagtcgctgaccatggcatcgccctgtccccggttcccccggcaccggcgcgcccggcgcacgccgcttcttccgctggcgcgggtgcagccgctggcgcgaatgccgcggcagcatcatcgtcagatgatgaccacttcaccctacgcgactttttcctgtggtgcggcgttcccgtgcttatcgtgctgctgattcgcattttcgccgtcggcttttacgagattccttcgcgctcgatgatggacaccacggtgcccggcgatcgcgtggtgaccagcaagctcacccccaagatcttcgatctgcagcgcggcgacgtcgtggtattcaaagatcccaacaactggttgaacgaggagcagagcagtgctcccggtggcgggtatctcatcaagcgactgatcggcctgcccggtgacgtggtcgaatgcaagggcgcgggccagccggtgaccatcaacggcgtggccatcaatgagacctcctacattcgccccggcgtggacccgagcgccttcccgttctcggtaaccgtgaccgagggccgcgtgttcgtcatgggcgacaatcgcgccaattccgccgactcccgctatcatcaggatgacggcgatcgcggcttggttcccatctccgatgtggtcggagtcggaatcgcgaaatactggccgcttgaccggcttggtgcgattgatgaccaccacgaagtcttcaaggacgtgcctgacgcttccggctcgaattcctgagtctttttttgaaccgtgtgagtctttgaactgattgagttccgggccgtctgaatcctgaaccatatgaatcctgaaccgtctgaatcctaaccattgtgagacgatgggagccgcgcatgattaccccgacacttgacttggaacgcatccttgcggcccagggctatgaccttatcgctggattcgatgaagtcggccgcggcgcgctcgccggtccggtgatggtcgggtgcgccgccatttgggcccgtgatttggagccgttggatggcgatgatgccgtcgaactgtccgggcggacctacctcggcgtgccggacggcgtggccgactccaaaatgctcaccgaacataggcgcgaggcgattttcgacgaactgcgcgactggtgcgcggcctacgccgtaggccaggccagcaacaccgagatcgacgaatggggcatcacctacgcgcttggcgtggccgccctgcgcgcgctcagccaagtcgaacgcgaacttggcttacgacttggaggggaatcgacgataaaaaaggcttcgggggagtctgcggggaagattgtggaaggtcgtccgggaggctccgtaggggaatccattggaaattgcgagggaagcgttcgcgctctgcccaaagtcgccggaattctcgacgggccgagcgattacatcaccaaggcgctcaacacgttcgacgcgccggacgtgccgattccagccgacataacgaccaaagtcaaaggcgaccagcattgcgccaccgtcgccaccgcggcggtcatcgccaaagtgacccgagaccggctgatggtcgacctcgcgcaaagcaacccacgttacgccgcctacgaatgggctcataacaagggctatggttccgccgcacaccgtgccgccatcgccgagcacgggccgactccgctccatcgtgtctcatggcacctgacctgagccgcgtgcgacacgacagtgtgagcgctaacgcaaaactgttgtggacgcgctaaagtcagtattgattaaggtacaagactggccgtgcatggatgccggccgccagcggggaggttaggcaatatggtgaccagccgcaagccaagcaaacgtccgtccatgttcgaagtggccaagctcgccggagtcagccaccaaaccgtctcccgtgtgatcaatgactcgccggacgtttccgacgccacccgtgcgcgagtccagaccgccattgaccaactcggctaccgcccctccaactccgcgcgcgcactggcttcccgccgttcgcgcaccatagggctgatcgccggaggcctcaaattcttcggcccgatttcctccatctcctccatcgaatccatggcccgcgagcacggtctgttcatgagcgtgatgatggtccacgaggccttgtgcgcgcaggccgacttcgacaacctgtgcgacaccttcaacgagcagaacgtcgacgccttcatcttcctgaccccgaccgacgtgatgttcgccgccgcctgccgtgcacgagtcactcagccgcgcgtcatcgtcaccgccacccacggccaaatgaccgtgcgtgagggattgggccttatctccaccgaaaacaagcgtcgcactgcgctggtcggtatcgaccagtggggtgcaatggccaaagtggtggccttgctgggcgaatacgggcacaaatcggctctgtattttgccggtcccaacgaatggcgcgacgcccacacccgactggatgcgtggcgcaagctcgccgcctcccgatccatcgattcacagatcgtgcgctgccatacgtgggatgcctctgaggcatatgcgcacatgaatcatctcattgatgagtatgggcgtcgaggcgcggcgttgcccaccgcggtcgtcgccgcgaacgacaatcaggccgtcggcatcatgcgcgcgttgcatgagcatgggcttcggattccgcaagacatcagcgtggtcggattcgacgacatgtctggcgtggataacatgtacccaccgctgaccaccgtgcatcccgatttcgaggggctcggcgtggccgccatgcgagagacgctgcgcttgctgggggagggcggcgagccgaccttcctgaccacccagcacggcatggggctgattcccgccgaggtgcgtgctcggcggtccttggggccggctcctcggcggtaaattggccctgttatcaaaccgttatgatgcgtgacacggtataagttgtgtcgaatgcaggttatcggtacaatgttttttgggaaattgtgagcgctaacaccctccccaaggaaggggataacaacgccggcgctccaaggcaaaggaaagatatggcagcaaccgacaacgcggccgagcaggtcgcccacatcgccgagaagattcgcgctggcaagaccacgctgggcatcgaattcggctccacccgcatcaaggccgtcctcatcgacgacaacttccagaccatcgcctccggcgactacagctgggcctctcacttggaggatggtctgtggagctacaccaccgaggagatctggggcggtttgcagtccgcttacgcctccatggccaacgacgtcgagaccgcctatggcgagaagctcacgcacgtcggccacatcggcttctccgccatgatgcacggttacctcgcattcgacgaggccggcgaactgctggtgccgttccgcacctggcagaacaccaacacctccgaagctcacaagaagctctccgagctgttccagtacaacatccccgagcgttggtccatcgctcacctgtaccaggccgtgctcaacaaggaagagcacgtctccaaggtggcttacttcaccacactcgccggttacgtgcactggaagctcaccggtaagaaggtcctcggcgtgggcgatgcctccggcatgttcccgattgacccgaccactcacacttacgaaaccgcattcattgagaagttcgacgctctacctgaggtcgcagcccagccgtggaagctggagaacctgcttcctgagccgcttgtggccggcactccggctggcgagctgaccgaggaaggcgccaagctgctcgatccgtccggcgccctgaagcccggcatcgtgctcgccccgcctgagggcgacgccggtactggcatggtagccaccaactccgtgcgcgtacgcactggtaacgtctccgccggcacctccatcttcgccatggtggttctggagcacaagctcaaggccctccaccctgaggttgacttggtcaccaccccggccggcgatctggccggtatgagccacgccaacaacttcacctccgacctcaacgcttgggtcggcctgttcggccagttcgccaaggctatcggccagccggttgacgcaggtatgctgtacggcaccctgttccgcgcggccatcgccgacgacgtggacgccaactgcggcggcctgctgaactacccgttccgttccggcgaattcctggccggtctgcctgaaggtcgcccgctgttcgcccgcagccccgaagccaacatgaccctcggcaacttcatgcgcgcccagctgttctccgcgttctccccggtcaagatcggcatggacgtgatgaccaagcaggagcgcgtgcaggtcgactctctcgtgggccacggcggcatcttcgccactccgaaggtggctcagaagattctcgccgctgccttcaacaccccgatcaaggtcatgtccaccgccgccgaaggtggtgcctggggtatggccgtgctcgccaactacctgtggaacaccaacgaggatcacagcaacctcgctgacttccttgatggtttcgtgttcaaggacgcccagtccaccactgagaagccggtggcttccgatgtggttggtttcgaggacttcttcgcccgcttcaccaagggcctgcccatcgagcacgctgccatcgaaaccatcaacctcgaagataagtaagcctttctgacctccctctattgagagaggtccttgagattttgaaaaaacgtccatccagcacagtggaaaggaaaaccaataatggcaactttggctgattacggccccgaggttcgcgccgaggtcaagcaggttcgtgaggtcgtctccaacctgcaccagcagctgatcaagtggaacctggtcgtgtggaccgcgggcaacgtttcccagcgtctgcacaccgccgacctgttcgtcatcaagccctccggcctgcgctacgagtacctgaccccgtcctccatggtcgtgtgcgaccttgacggcaacgtggtcgacggtgccgaagccccgtcctcggacaccgcttcccacgcctacatctaccgcaacatgcccgacgtctacggtgtcgtgcacacccattccacctacgccaccgcttgggctgccactggtcagaacatcccgtgcggcctgacgatgatgggcgacgagttcggcggcccggtgccggtcggcccgttccgtctgatcggctcggaggcgatcggcaagggtgtcgtcgagaccctcaagaagtacccgaagtccccggccgtcctcatgcagaaccatggccccttcaccatcggcaaggatgctgaaggcgccgtcaaggccgctgccatgaccgaggaagtcgctcacaccatgtgggccgcccgtcagctcggtgacatcatcgagatcgaccaggccgacatcgataagctcaacgaccgctaccagaacgtctacggtcagcactgatttgatggagtgtccgccgcgttacggaaggcccgacgtaccttcgtacgccttcgccttccgcgccttgcggacacacacatcaaatcagcgctgactccgccagcacggtggtgtcttggctcccctctctgaggggagctgtcagcgatagctgactgaggggagcctcggtcggcgaatgaaacttaaacaaacccccataaacaaagaagtaaaggaagtaaccctatggttatggaaaaccccttcgagggcaaggaaatctggttcggcgttggttcgcaggacctgtacggcgaagaagccctgcgccaggtcgccattcactccgctgaaatggtcgactacctgaacaacaccggcaagattccggccaagatcgtcctcaaacccaccctgaagtcctccgacggtgtcaaggagttcatggtcgaggcttccgccaacccgaacgtcatcggcgtcatcacctggtgccacaccttctccccggccaagatgtggattcgcggcctcgaagtgctgaccaagccgctgctgcagctggccacccagcaccacaaggaaatcccgtgggagaccatcgacatggacttcatgaacctgaaccaggccgcccacggcgaccgtgagttcggttacatcgtctcccgcctcggcatcaagcgcaaggttgtcgtcggtcactacaccgatcccgaggtcgccgagaagctcggcacctgggcccgcgcctgcgccggctgggatgcctccaacaacatgaaggtcatgcgctggggcgacaacatgcgtaacgtcgccgtcaccgagggcgacaagaccgaggctgagcgcgtgttcggcgcctccatcaacacttgggccgtcaacgagctcgtcgctgcgtacgacgccgtcaaggacgaccaggtcaaggagatcatcgaggactacaaggccaagtacgacgtcgacccggctctgctggacgccaagtacgactccctgttcatcgccgccaaggaagaggccgcgatggtcaacatgatgcgcgccaacggctgcaccgccggcgtcgacaacttcgaggacctcggcgctctgccgcagctgccgggcgttggcccgcagcgcttcccgtccgagtacggctggggcttctccgctgaaggcgactggaagaccgccgtcctcgtgcgcatcggtgccgtcatgggctacggccttgagggtggcgcctccctcatggaggactactcctacaacttcaccgagggtgacgagctcgacatgggctcccacatgctcgaggtttccccgtccatcggcaccatcgccaagccgaagctggagatccacccgctgggcatcggcggcaaggccgacccggtccgcctggtcttctccggcaagcccgccaaggacgccgtcgtggtctccatgtccgacgttcgcgaacgcttccgcctgctcatggacgtcgtcgacgtcgttgagccgcagggctccctcaaggagcttccgtgcgcccgcgccgtctgggagccgaagccgagcctgaagaccgctgttgagtgctggatcaccgccggtggttctcaccacacctgcatgaccacctccgttggtcgtgaggcttgggaagacttcgcccgcatcgccggtgttgagctcgccgtcatcgacgagaacaccaccgctcgccagttcgagaaggaactggagctgtccgagatgtaccaccgtctcaacaaccagcactgattggcggagcgtataccgcctttcctcaggttcgacgtaccttcgtgcgccttcgccttcggacggcggtctccgcacgcgccaatcagcgctggcaagccagcaccgatgactaaatcagtctgctgactgctaccgctgaaaaggggctgttccgggaaaccggagcagccccttttgctgttatcggcaactccccacaaacgcatcaaaaatcgcctgcgagcgtggatctaccttgtagagaaactcgggatgccactgcacggcccacaggaagtggcttgccggccggtacagggcctcgatcacgccgtcgggcgcgacggccatgacctcgagtccagcagcaggctcacgaaccgcctgatggtgatagctattcaccgcaatctcagtctgccctgcgaacaatgaagccaggggagtgccgggcaccaaggaaacgttatgtccgaacgcatcgtacggcggattcatatggtgttcgatatcgctcggatgctggcttggcagatcctgccacaacgtgccgcgcagcgctgcgttgatgaactgaatgccacggcagatgcccagaatcggcttgtcccaagccattacagctggcagcagaatcgattccattcggtcgcgctcaggagagagcacctcgctacggccggtggcggaggccgctgcaccaaccatcggtcccacatccggcccgcccgtaaacagaaacgcgtcaaaccgttcggcgcattgcgcaagaatgtcggtgtcatcggtcagcggcaacatgacgggcgtaccgccggcccgcattatcgcctccatatatccgggcagcatccacagactatcgcgcccgtaatccatcagcggagtcaccgcaatgagcggtcgattcgtagtcatgcctgcctcttttcgcccaggtgttgttttcgtcgttctgccgcgaatcgcttgattcagtggccgataatgccgccactgtaccgaaccaatgtaaccggtcggccaacattatttcgtcagccagccgcgacgagatcgcacaatgtgccaatgatgggggcattcggtgtgaccttgtcaatgttcgggccattgcactttcagcggggaaagcatgccccgtccgcgcatcatgatgaacgagtaaggttgacggggagggagaatcacatgaaccaggcatgcgtacgcaacgacaccatcgacgcgggcaaccatcatggccgaccgcaataccggtcgttcctgcgatttctgacatcgcaggaacgcaacgtcatttggctgttgctggccattgcttttcttccggtggacggcaccacgcttggcctgtacgcgccgttctggtcgccaatcagtccggcgctgttcgccgtgtactgcctatgcaattggcggcaactgcgcatcgcagccaaccggtacctgccaatgttcctcctaccggtggcctgcataatcctgtccatcccgggatggctgaagttcggcatccacctcaacgccgcgttcatgagcatcaccggattgctgggcgtgctcgccactttgggggcgatcgcccttgcgttcgacatcaaacgcattccgtggcgtacgccattgcggattctcatcgcatcatactgggtttccttcggagtgggcgtcgtgcaatggctgtccatccgtctgcacgccaaaccgttgaccgactatttctcgcacctcatgtaccggcaatacatcagcgacaactcggtgtggggcggcggccgtccgcagttcctgttcgccgagcctagctatatcggcatgcacctgttcggcatactgcttccgctcatgtggctcatgcgcgggcgcgaccgcatctacgccaaacggctgcgtgacctcatcgtcacgtatgccgtcggcgcggtgctcatgcaagccggcaccagaatcgtcatcgattccgtcgtggcgttgctgatcgcccttgtggcgcgcaccgattggcatgacggcgcacgccgcgtccggggcatgctgcagattctcggcgcatgcgcactgggcctgctgggtgtgctggcggattccagactctccgccatcgcggaaaacggggccgagggagacggctcgttcttcgcgcggatctaccaaagcctcgatccgatatgcggattgctcacccatccgtggacgctgctcaccggttatggcgcgggcaacatcatcaatgcggtgtgggccggcgcggccaaagccggacggctgctggacggtcttggcatgaacggcggcgcggccacgggattcgcggccggcgtgaacgcggacacggtgtggacgatgtgcgcgtataccagcgtcatcgccgaatacgggctgatcgggctgggcatgctggtcggagcctcgatggtctgcatgacgcgcgggaggacggtatgccgtggcggtgcggatggcgcatcgtccgacgagctggcgcacggtgtttgtgtcgccgacgttgccgacgttgctgatgttgccgggggtaatagtggtggtggcgttgccggcgcgggttcgggcgaatccggcgtctggcacaagaccgtcatctgctggctcgtcctggtcgcatacctgtacatccaatgcgagaactatgcgttcgccgctctgccgcttcttgtgttcgccgcctcgaaggtgaggcgcgagcctgatttctcgcgggccgacgcatcgacgcggcccgagatggaccaaaatccagaataaccgacattcgccgctgttccgtttttcgctcaaggcgtatatctcccgtatcttgaggtgcatcatgtatcgtcgcggctaactaatcggcgaaacgcggcatgtttcgcattttgggcgaaaagcccaagtcccacaggaggtattgatgacgttcgttgcacggtcggtgcgctatgtgctcagaaaacgagtgcgaaccatagtgctccttataatactgaccatcataacggcgagcatgctatccacgatcgcggtttctcgggcagctcaacaggccgccggacgaatcgagaaggaagcggtcggtggattcgtgctgtccagcaacatgcagggcagcatgctcacgcctcgcggaggcggcatggtgcgccccgccgacgtgcgcaggatcgcccaactgcccggggtcgattcgtatatggtccgtcagaacgccaccgccgatctcgtgggggcgaatgtggcgaaggtccccggcggcgatgattacgatgcgacccaggagcagcagtttggcaacgccgccaacgtcatgggcacgaatgattcgtcgaaactcaacgtgttcacgtcgcgcacgctcggcatggccgaaggacgacatctgaaggcctccgacaagtacacgtcgatgatccatgaggatctcgccaaagccaacgggctcaaagtcggagacacgctcacgctcaaggccaacgcctacgacgccgacaacgaatcacattcgacggcgaccgtcaagaccaccatcgtgggcatattcaagggcgacagcgccagaaaggtatccagccgagcggaactcaccgccaacaccatctacaccgatctggataccacacgcgatctgtaccagtacaagggcggcaaggaaatataccaggacgccaccttcgtgctgtccaagggcgttgacgtggagaagaccatggacgccgcaaagaaactcccggtggattggaacaactatcagatcacgcgcaacgaccagtattcgtcgagcatgctgcatgccgcccgcggcgtgcgctccatgatgcgcggcgccctgatcggcgtgaccgtctcggccgtgctcgtgctcagtctcatgctgctgctgtggatgaacgaccgccgtcaggagatgggcatactggtgtcccttggcgtcggcaagccctcactggtcgcccaatacctcgccgagatgatgctgatcggtctgccgtcccttgccctcggctggctgtgcgcgcagggaatggcccaatggctcggcaccacggcgctccattccgtgaacgcctccgcggcgaaggagctgagcagcatggggcaggtcggcggcgatcttgaatccagcatgtcggtgcgcaccctggattcgctcacggtgtcggtcgatgggaccgccatgctgtacgtggcgctcggcctgttggcggtgatgctggtgtgcgtcgcggtggcgtgcatgccgatgctgcgtaaatcgccgcgagacctgtcggagattcgatgatgagcatgaatgtgtggaagcgtgccacgttggcgatcgtacgcaagccggtacgcagcggtatcatcggtctgctgatgctgatggtcttcacgagcctggtggcgcaggtcggagtctcgacggccctgcgtaccatgtccgacagcatcggcgcgggcatgggcatagggtttaccgtcagcgccggcgagaatcccatcagcgccgaggaggcgagccggttctcgcgtatccccggtgtgacgaagaccgcctatgcgacgaagaccttggcgcaggtggatggcgcgcgcccggtcatgccccggcagggcccccggctggactccgatctggccatgcaggtcagcgtgctgggcaccaccgattcctcattgtcagaggaattccagagcggcctgtaccgcctggagcagggccgccatatctcgggcgacggcgacgatgtgctggtccaccgcgacttcgcgctgcagaacggcctatcgatcggctcgacattccgtctccggcaggaggggcgcaacgccacggtgcgtgtggccgggatcttctccggcaacgtgcaggcccaaagccccctgccctcggacacttccgagaacctcatctattcgggcaggcgagtgacctccgctctgaccggaaacgaccagatcggcatgatccgatgcctgtcggataatccgcaggacctgtccgcggcggtcagtcaggccaagaccatgaccggtggcaagtacgacgtcaccgacgattcggcccggctctccggcgtcctgcaatccgtgcagacggtgcgtgatctggtgcgcatggtgctgctgtccgtctgcctcgcggacgtactggtgctggcgatggcgctggtcttctggattcgctcacgcatccatgagataggcacgcttctggccctcggcatcgacaagatgcggataatcgcacaactcgccatcgaaaccggactcatggcggcggtcgccgccctgtgttcgctgggcaccggcgccatgctgtcgggatacgtgtcttcccgactgttgcgcgattcgggcgtcgcgccattggaatcgttgcacgtggaggccttgccgcctgagcagacggtgctcatcctgctgctcggatgcgcggtcatcgccgtggcccttgccgtgtcatgcgccgccgtgctgtccaaatccccgaaatccattctttcctctatgcgttaggagtcaccaatcatgtctaactgtctgcaactggaccatgtcgattacgcctacggcgcggcgaagatccttgttctctcggatgtcagcgcggatttcgaatccgggaagatgtatgcgatcaccggcccgtccggcgccggcaagagcacgctgctgtctctgctggccggcctggacgccccctcccggggagtggtccgcttcgagggggaggacatcgccgcttcgggctatgcgaagcaccgtcgggagcacgtgtccctggtgttccaggaccataacctgatcgactacctcacccccgaagagaacctgcggctggtcagcaccaaggccgatatgaagatcctcgaggaactgggtttgagccgtgaggaatccaagcgcaacatcatgcacctgtcgggcggccagcgtcaacgggtggcggtcggccgcgcgctggtcgccccgggccgcgcgatcctcgcggacgagccgacgggcagcctcgacccggagatgaccgacgaggtgattcatctgctgcagcatgccgcccatcagctcggcaaatgcgtaatcgtggtgacgcattccaagcgtgtcgccgactccgccgatgtcgtgctgcgtctcaggagcaagaaactgacccgggcgtgacctacctgggccgggcggcacccatacaccgcttcggcatttcggcaccccggcgaccgggcactccggtatcccggcccttcggcattctggcacccccgcgctccggcaccccggcgacccactcgcattgccggggtgccgtattcgctctgcgccataatgtgcgtgataatggaaccatgccagtgatgaatgatgaagtgcccggcgaggttgaaccgcaccccgattgttggactggagtaatccagattcgatgatcggaggtgcggttcaaaaggcccttttttgtgtcggattacgaaccgcgcgtttcaccgcttgccgttgtagatctcgttgtcgatcacatcggcgaacacgcggttgacggccgggcgcactaccttcagcgacggcgtcaggcacttgttctcctgcgtgaactgcgtatccagcacggcgaacttgcgcacggactcggcgcgcgaaaccgtcgcgttcgctttatccacgtactgctggatctcttcgcgcactgcggcgttcgtggcgagccggtcaaccggcgtctccgtggacagtccgtgtgcgggcagccagatggccagcgactccgggtcgagcgtcaccagcgcgccgatgaacgggcgctgatcgcccaccaccacgcaatgctccacaatcgggcacttggcaatctcctcctccagtggaatgggggagacgttcttgccgccggcggtaataataatgtccttgattcgaccggtgatgatgatgcggccggcgtcatcgatctcggccaagtcgccggtcctgagccagccgtcggcggtgaatgcctcggccgtcttctccggcagattgtggtagccgcggaacacgttcgggcccttgacctgcagttcgccttcgtcggaaatgcgaatcgaggagccgggcgcgggctggcctacggtgccgatcacattgtcggtcacgcgcgtggcggcgaacggggcggcggtttcggtcatgccgtaaccctgaatcatcggcagaccgatgccgttgtagaaatgcgccaaatcaagcgacagcggtgcgccgccgcaggccacgtacttgatcttcgggcccagagcgccgcgcaccgtgcggtagacgagcgtttcgtacttggcgcgctcggcgatttcggcaaatgtgtgctgctcgccggcctgctccttgcggctccagatgcgcgcggcctcggcggctttgacaaacaggcggcccttccagccggcaccggccttatgcgaggcggcgttgtacaccttctcgaacacgcgtggcacgccaagcaggtaggtcggttcaaacgaacgcaggtccggcagcagggttttggtgtccggcagataaccgaccacgccgtcatcggaggcgatggaggcgtactggataaatcgtgcgaagcagtgggccagcggcaggaagagcagcaggcgtggatggtcgtcaagcaccacttcatgaagcgcctgcgaagcggtgatggtgatggacacgaagttcttatgggtcagttcggcacccttcgggttgccggtggagcccgaggtgtagacgatggtggccagatcgtcggcgcgcacggtggccacgcgctcgttcagttcctcgtccgaaacagccacgcccagaccttcgagcgcgcccagtgcattgccctcgagcatgagaatctgcttcaaggcagggcagtggtccttgaccgagtcgagccggtcgaagcgctcgcgattgtcggcaaaggccagcttgaccaccgaatcgttcatgatgcgctgggcctgcggggcggagtcggtgtcatagatcggcacgcttaccgcgcccaccgcggccagtgcgaaatcgagaatgccccattccagacgggtggaggaaaagatggtcaccgcgtcgcccttggcgatgccgagcgcgatcaggcccttggcggccgagaccacgcgctcgtggaattcgccggtggtgacgttctgccagcggccggggccgattttcttggcggcgattaccgtgtccgcgccggtgcgggcaaggcgatcggtaagtagggagtagatggtctggttgtcgcggatttcgatggattcgccaggcgtggtgtagtggtcaagcataagcgggccgtgtccttacgtgcgttgcgtgatggctgttgacaaaatcgagccattctgacaagttaggttacgctggcgtaaggttgcgcgcgttgtgggcaatggagaagttgtctgtctggttttgtggattgtatacaacgccgtgtctaaccggtttgctctacggttatgacaccgtgtccatttcgggagccatcgacttcctgcaggacaagtacgcgctgaacccggccctgcagggtctggtcatcagctccatcatgatcggcggcgtgatcggcgccggcttctccggcttcctgtccgataagtacggccgccgccgaagcactggtcgccgcgcaaaaagcagcactaggccgcgtttgctgcgtctattggcgaattgatcatatgggtcgtctgcgtgcagacgacccttttgcgttccgtcggcttctgacaccgtagaaacgtgctttctcggcttcgaggggctgattttgccttatctggaagtctacttccacttcgaggggctgatgcccaagtagacacggccctaaaacggcggaatgacgttgacgtgtagccgtttatacttccgattacatggatgaggagcccctcgaagcggagatagacttccggcaaatgcgaaatcagccccttgaaacggaagtaggcctccggcaaacgcaaaaattagcctcctcgaaacggataaatgcacgtattgggtgtagtggatgcttcagcccctgatatcgaagcatattttttctggttggcgcgtctagcatgcgcactccgcaatcgataattctgtggcctctctcactttaaaagtctggcgtgtgcgagggcgttcgcttaaggtgaatgggattgcgcggaatgtggagcgcagggtcatgaccatgcgcgtgctgcagatccagctgcgctcgctgaccgccatggatatcgtggcctacggcggtgcggcggccggcattggtgtggctctatggcagtatgcgcataccaccgcagccgccgcaggagccagcaccgccggctggtcgccgatcatgctcgccgcccacctgcccggcgcattcgcctacctggcctacggcctgcaatacctgatgccgttcggtgcgggcttcccgctcaccctcgccggactgctgctgattgtgctgctgtccgccgaattctttattcccatgcgtcagcttggctcgttcttccacgtggcgatgaacggcatgacctccaccaagcgcatcttcgctctgctggacaccccggagcccgagcatggcacggcgaccctgccggccaacgattccgattccgctgacgacggtctgacggtccgcttcgaccacgtcggctattcctatgatgatgccgggcacggcgactccaagtccgcatccgcaaagaccgataagcaaggtgaaaccagccccaattccgccgtcgctcctgcgctcaccaacatcaccttcgccgcacggcccggtcagttcaccgccattgttggcatctccggttccggcaagtccacggccacctcgctgctcgccggtacactggccggttaccgaggttcgctcacgctgaacggcgtcgaggtatccgatttgtcaggcgaaacactggccggagccgtcactgtgattggtgccagcagccatctgtttgcgggcgcattgcgcgagaatcttctgatggccttgcccgatgacgagattcctgattcgccggattccgtggactcccgtctgtggtccgcgctcgagcaggcgcgcattgccgacttcgtgcacgcacagccgaacggactgggcatgccgattgagtccgatgccgccaacctgtccggcggccaacgccagcgcatcgccatcgcccgcgcgctcctgcatgattcgccggtatttgtgttcgatgaggcgaccagcagcgttgacatggaatccgaagagctgatcctggatacaattcgcgaattggcgcaatcccgcggcaagacggttattatgatcacccatcgcatggccaacgccgaacacgctgatcaagtggtggtgctcgaacacggcaagtcggttgagaggggcacccataccgagctgatgacggcggacggcgtctacgccaagctgtttaccacgcaggcagatattgagaacttcggagaaggccatgctcggcgtgtgctgcaggttggttcccgcaagcaggagctgtccgacgacagtcggactgagggtggcgcagcgcgcgtaagcgcagaggcgggtatgacggttgaccgcctgcagtcagctttgccgacggcttccgttggcgggagtgagcaggcctcggctgagactccggctggtgttgcaaatagcgattcgtcttccaaaatgagcacattccaagtgatcaggcgactgcttaaggaagcccgacctctggcaggactgatggcagcggcctccaccgccggcaccatcggccatctttcggccactttcctgcccgtgttcggcattatcgcggcatttgcacttaccggtaatctggtgtggggcatgggtgttgcgcccgccgtcatcatgatgattatctgtgctcttctgcgtggcatcacccgatacattgaacaatatctgaaccacaatgtggcattccatctgctcgcactcttccgttccaaggcgttcgccgcgttgcgcagactggcgccggccaagctcgcgggcaaaggtaagggcaaccttatcgccatgctgaccaccgatgtggaactgcttgagatcttctttgcccacaccatcagtcaggtggccatcgcggtaacctccaccatcatctacacgattgtggccgccaccctaagcccatggatggcgctggcgttgattgccgcccacctggttatcggcatccttgtgccgcgattctttgccaccggcgtacgtaaccttggccctgccatccgtggcgctgccggagaactcgacgatgtgatactcgatgacatgcgcggcctggacgaaatcatccgatttggccgcggcgaggaacgtgcgcaggccatcgaggaccgtacccatgcgttgtggaaggatcacgccaaactcagcaaggtcaacggccgtttcaccggaatcagcggactcttggtggctgtgctcacagcggcttcggtcgccgtggctattgcctgtgccggcgcgaacccgcagagcattccggctctgattgccgctttcgtgctgttcgccggctcgttcgaaccgactttggcgctcgccgccttgcccgctaacctgactcagaccttcgcgtccgctagccgactgttcggactgatggacgaggtgcccgctgtgaccgagaacggcactgttgcgccgcaggagtatatgggcatgcgtcttgatgacgtcacctttgcatatgcgggggagcatgaagtcctgtccgacttctcgcttgacgtgccgcagcatggcgtgctgggtatccaggggccgtccggccgaggcaagtccaccatgctcaagctgctgctgcgctactgggatccgcagcgcggtcaggtgacgttgtccggcacgccgttgcccgaggtcgatgtgcatgctcgccgacgtattcaggccatgatgagccaggaaacccacccgtttgatggctctatccgagacaatctgctgattgctttgcctgagtccgaggttgaagctgcaaatgttgcaggcaatggggaagtgggtgccaagaccgttgattcccgacagcagcggttggcggcgcaatcggcagagggcgatgccgttcaggtggcagcatctgacggtctcgacgctcgtttgcgtcaggctctcgccaaggcctccgtgcttgatctcattgattccctgcccgatggccttgatactcaggtaggcgagctgggcgaccgtctatccgaaggtgaacgccagcgtatcggtttggctcgtgtgttcctgcgcaatgctgatctggtgcttttcgacgagccgaccagccgtttggatgctttgaacgaggctattattctacgttccattcacgctatggccgtgggtgagcagcatgcagacaaggagcgcggcgcggctgtggtgctggtctcccaccgcgaatccgccatgcgcattgctgatgcggtactcaatctgtaactgcctgtaactacgcgggaatcacatcgcattgcgttacgttaccgcgttgcactgcggttcctcgcgggtggcggcgatgccatctccggtcgtcattgcgttgctgcgtttgtgttgcgatatgtgatgcggcaacgcagcaatgcggcaatgcaatgtgatgtggcaacgtggcaacgtagcgatgcaataacgcggtaacgtgacaacgtagcgatgcaataacgcggtaacatggcaacatggcaatgcagtaacgcaacgcagcattcacgccttgatcaaagcgccgatgatgagcgccttctgcagccctgggcggaacaggtcgtgaaattcatgcgacatttcggtttcgagtttgaccgatgcatggatgtcgtcagtgcgaaggcgtgcctgttcggtgccgatgatgtgctcgagcaccgcgaatccctcttcggttttgccggcttgaatgaggaatcgtgggctttccggtgctcgcaccatggagagcaggaacgcggcggccggaatcgcacccagcctcagcatccaacgccaaccggcgttgacatcccagcttctggaaccgtaggaggcgatgatgtagttgatgacattggtcaggaagatgccgcataccgcgaggagctgataggaaaaggcaagcagaccgcggatattgaccggcgcttaaggccagaccgaacgtatatttgcccgatccgtgagtacgtatggttggtcccaagggattgcgctgcttggaagtagcttgaaacaggcccgccatgtgctttttcctctcaatacagctatggggggctgttcatactagtcagattcttgtcatatggcgttgaatatctacaaatgtgggcactggtgaggcggctgagtggtggaatcgcgccgtggtgtgtgggtgttggggactcacgagcatgctgcgcgttatttggtggtgtgctgagagtcgggacctactcacgttgggggaggggatgaagagcctctgagacaagtcgctgttcgactggagatttgctcacgtggaaagcatggaaaaggcgaaaaaaatcaggcgtgtcgggtgatttgacaaattggtacacaggtgtatcatcttaggtattggtacacgggtgtaccaaagaaaacaccccaaggaaaggtggccagaggagacttcgcaagcggccaaacgaattgaaatccaacgcagcagtcgattcgtttttggcaatcggaaggcagtcgtcaacaatcggaaggcagccaaagacagccggaagataaccgagaagtaaccggacgaaaaccggaagccagtcggaagaaagccaaccacccgcaagtcaactccaatggtccagaaggagataacatgcgcaacaccaagaaggtcatcgcggcaacggcagccgtggccacgctcgtcggtctcgccgcctgcggcagcagcaacgacaacggcgccaacaagggtgacgctgacaaggccgaactcgtgttctggggctgggattccggcaactcgatgaaggaaatcctcgctgacttcgagaaggccaaccccggcatcaccgtcaagttcaacaacaccggcaccgccgagaagacctccaccgcgctctccaacgccatcgccgcaggcaacggcgcccctgacgtcgtgatgctcgaagatccgaccgtcacccagttcgccgtcaccgatggcctcgtggacctgagcgaattcggcgccgacaaactcgccgacgacttcgccgccggcccgtggaacaagctccagtacaacaacaagccgtacgctctgccgattgattccggccccgaaatgttcttctacaacaaggcagtgttcgacaaggccggcgtggacggcgagtccatcaagacctggaacgactactacgaggccgccaagaagatccgtgccaccggctcctacatcaccaatctggccggtacctccaacgactatcagccgttcaccgcccagatctggcaggccggtgcccagccgtggaaggtcgatggcgagaacatcaccatcaacatgaccaaggacgagggcatgcagcgctatatccaattcgtccagaagctcatcgacgaagacctcgtggacgccaagaccccgaactggtccgacgattggaaccgcgagctcaacgatggcaccctcgcctccctgaccatcggcgcttggatgccgatcaacctcatgaccggcgcccccgatcaggccggcaactggcgcgtcgcccagctgccgcagtgggaggaaggcaaggaagtctccgccgaagacggtggctctgcacttgccgtcacctcgcagtccaagaaccaggccgctgcctacaagctcgttgagtacatgactcatggcgagggcgctcagaccatggccgacaccggtaccttcccgtccctgaagaagatcctccggtccgactccttcaccgacccgaccaccgagtccaacaagaagaccaacgactacttcggcggtcagaacgtcaacgaagtcctttccgccgcggctcagcgcccgaccgagaagttccagtacctgccgtacaacccgtacgcccagaccgcttacggcgacgaagtctccaaggcctactccggcgacatcaccctggagaaggcgcttgaaaactatgccaacaagctcgccgagcaaggcaagcagcagggctacaacgtcaccgtcaagtgacgcaaccgatctattgccggtacatccggcactgaccaacaatcaaaacctgcggctaggccactctccttccgcctagccgcccgatctcccaaagcggggatgctccccagtgtccccgctttcccgtgccctcgcctgacgtgaccgctccaatcgagcgaccccctggtagcgggcgcagcacagcaatccgtattccaagaaagcaatcgattatgtccgatcaaacaatggccgcagccccgcagccaacggtgggaatcctgcctgaggaggcggatctgcacacggccgaggcccgcgtcaacaagcacaaggccgactggcgcggctggaagttcatgtggccgttcgccgtggtgttcgtcttcgtgttcatcatcccaattgtgtacgccatttacatctccttcttcaagaagcagatggtcggcggcaccaagttcgtcggcttcgagaactacgcccgactgattcaggatccgcagttctggagctcggtgggccgcgtcactatcttcaccgtattccaggtgccgatcatgctgtttctggctgcagccatggccctcgctttggattcgatgaagctgcatggcaccaagttcttccgcatctccacattcctgccctatgcggtgcccgcagtggtctccaccatgatttggggtttcgtgtatggcgccaaatacggtctggtcggctccctcaacgacttcctcggcaccaacatcgatgtgctcaaccccgacgtgctgcttgcatccatcgcgaacatcaacacgtgggaatatgccggctacaacatgctgattttttacagctccctaagcaccattccacacagcttgtatgaggccgcctccatcgacggcgcttcggagtggcagattgttaagaagatcaagctgccggagctgaagggctcgctggccatcacggtgatcttctcgatcatcggcagcttccagctgttcaacgagccgagcattttgcagaacatggttccgggcaacgcgatcaccacgtactacacgccgaacatgtacgcctacaacctgagcttcaccggcaatcagagcaactatgccgcagctctggccatcgtgatggccatcatcaccatggccattgcgtatgtcgtccagcttaagagtatgaaggagcagatgaagtaattatgagcactgcaaccatgacttcaacaacaaccatgaccctggccgatctcaaggctcaggaaaaggccgccaagaaggccgagaaggagcgtcagaagcgcatcgacgccgacgagaaggccgagcgcaagcgcgccgccaaaaccggtttctccaacccggcgaacccgacccgctcgatggccctgaccatcgtgtgcgcgattttcgcggtctactgcctcttcccgtttgtctacctgatgattaacgccaccaagacccagtccgacttcacttcgacgttcggcctcggtttcggcaaaacgttcgccctgttcgacaacatcgccacggtgttcacctatcaggacggtatcttcggccgctggttcgtcaacacgattctgtatgtggtggtcggcgccggcggtgccaccttgctggccatcatgggcggctatgcgctggccaagttccgcttccccggccgtaagctgtgcttcgtgatcatcatcggcgccatttcggtgccgggtatcgcgctggccgtgccgcagttcctgctgttcgccaagatgggcctcacgaacaccccgtggtcgatgattatcccgagtttggtatccacgtttggtctgtatctgatgtggatcttctccgatcaggccgtgccggatgagctgcttgaagccgcgcgcgtggatggtgccggcgagttccgcaccttcttccagatttccctgccgctgttggcacccggcatcgtgaccactgcattgttcgccattgtagcgacgtggaacaactacttcctgccgttgatcatgttgaaggattccaactggtacccgttgacgatcggtctgaaccagtggaaggaccaggcttcaaccgcaggcggtcaagctatccaaaacctcgtgattaccggttcgctgatcacgatcatccctctggtgattgcgttcctgtgcctgcagaagtactggcagtcaggcctcgccgcaggcgccgtcaaggagtaacctctggctccctctgacgggagctggccgcggagcggactgagggtggtcatatggggattcgactggcgaccacccccagtcagcttcgctgacagccccgccagcgggggcggcctctctggtgttcacaacctgcaagcacagcacttcccgcaaaccgatacaataaaggatttgattaatatgactactcatagagcatttaggtggccgtccctgctgacggaatccggccgcggcatcgcgttcggcggcgactacaacccggaccagtggcccgaggagacgctggacgaggatatccgtctcatgggtgaggccggcgtgaacgtcgtatcgctggcaattttcagctgggacaagatcgagccggtcgagggcgcgttcacgttcgagtggctcgaccatgtgatcgacaggctcggcagagccggcatcgccgtggacttggcctccgccacagccgccgcgccgctgtggctgtacgaatcccatccagaggtgctgccggtagaccggtatggtcataccgtcaacgcgggctcacgccagtcgtggcagcccacaagcccggtgttcaaggaatacgcgctgcgcctgtgccgcagacttgccgaacactacaaggacaacccgtatgtgaccgcctggcacatgggcaacgaatacggctggaacaaccgctacgactactccgacaacgccttggccgcgttccgcacgtggtgcgaggccaagtacggtaccatcgacgcgttgaacgaggcgtggggcacggccttctggtcgcagcacgtgaacagtttcgacgaggtgctgctgccacgtcacatgggcggcgacgccatggtcaacccgtcgcagcagttggattacgagcggttcggcaacgacatgctgctcgacttctacaaagccgaacgcgacgccatcgagcagatctgccccgacaagccgttcaccacgaacttcatggtctccaccgaccagtgcgtcatgaactacgccaaatgggcggatgaggtggacttcgtgtccaacgatcactacttccatgagggcgaatcccacctggacgaactcgcctgctcggacgcgctcatggactccctcgcgctgggcaagccgtggtacgtgatggagcactccacctcagccgtgcagtggaagccgctgaacacacgcaaacgggccggcgaactcatgcgcgactccctggcccacgtggccatgggcgccgacgccatctgctttttccaatggcggcaatccaagtcgggcgccgaggcgttccactccgccatgctgccccacgcgggtgccgattccaaggtcttccgcggcgtatgcgagctcggtaaggcgctgaagaccctctccgacgccgggctgcagggcactgagctcgagcgtgccggcacggcgatcctgttcagcgcggaatccgaatgggccacacgctccgaaaccctgcccagcatgaaactcaaccactggcacgacgtgcgcgactggtaccgcggcttcctggatgccgggctgcgcgcggacgtggtgccgctcgcctacgactggaccggctacaaaaccatcgtgctgcccaccgtgctcagcctgtccgacgaagacgttctccgtatcgccgacttcgcgaaggccggcggaaccgtcatcgtcggctatgccgccggcctgatcgacgagcacttccacatcggcctcggcggctaccccggcgccggcaacgggctcctacgcgacatgctcggcatccgctccgaagaattcaacatcctcggtgaagaagccgaaggcgagcccagcgaaatcagcctgtccaatggtctgacgacccgcctgtggcagaacgacgtgacttccgtagccgcggacaccacagtgcttgcctcttacgcaggtgagtccgccgccgactgggagctggagcgcacccccgccatcaccagccgcccctatggcaacggtaccgccatctacgtgggctgcgacctcaaccgtcacgacattgcccagttgctcaaagcacttggctcccgatggcaggagttgtcggcgcagccgactgagagtggtcaaactccaacctatcccaccacagatccccgcatcctgcacaccatccgccgatccgcagacggctccacccgcttcgatttctacctcaaccgctcaaaccagcccgtcgccatcaacggtgtggaaggtgatcccatcatcgcccaccgttgcgagactgacgccgttggatatacgctgaaccgcaacgccattcttatcgctaaaacgtcctgctaaaccgcgctagaatggcaatgttgtccggatagaggagtgcggcatgagcgacgagaaaacagccaagcgtcgagtgacgctacgcgatgtcgctcaggccgccggtgtatcgctcaaaactgcgtcgaacgtgatcaatggctccgggcgtatgacagatgagacccgtgccaaggtcgagtcggtcattaaggacctcgactaccgagtcaacgtggccgcccgcaacctcaaccgcgatcacaccggcttcatcaccctcgccgtgccttcgctgattccgccatatctggccgagctcgccaaccgcaccatcgaggccgcccgtcagcgcgactattccgtatacgtcaccacgtatgcggaaggctccgcgaaaggcgcgcgcgatctgctgaagaagttcaactccacggtgtccgatggcatgatcctttccatgagcgaggtggaaaacatttcgcccgatgatctgaaggttgattttccgctggtcatcgttggcgcgcgtaccacgtggggcattgtggatcacgtgaccccagacgatgtatccgcagccgccatggccgcaggctacctgtatgaccgcggttccaccagacttgcagtgatcggtgcccgtgacgtttacgacgaagatgcattgctgaatgccgtagaaggcaacgcgcagctgcgtctgcgcggcatcatcgaagagacccgtaggcgtgggctctccttggatccgcagctgattggcaacaccgatcaggattggaccatcggagccggtgcccgtgtgacccagcggctcattgattccggcgtgccattcgacggtgtgattgccttgaacgatcagttggccatcggcgcattgaccgctctgcgcaccgctggttatgaggtgcccgtgcaggtgcaggtcatcggcttcgataacaacgaggaagccccctacctgcagattccgctgaccaccatggattcccgccttgactggacggctcccacggcagtggatcgcatcctcggacgcatcgacggcagcatcaccaagtccgaactgctcaccaccgaatcccaggtcatcgcccgcgcctccacacgctgaacgacattgctgtaatgctggtgttgctgtactgggccgtacgaggcgttgatacaccggttgaccaacacggcataaagtgctaaggtgacgattgcgtggtacacagctgtaccgcgtggcgcataaggaaaggaagcgccaagcatcactgggcgttcgttctgagcgttcaccattcaaaggagaaaaagcatgcgccgaaataccgcgcttactcgcattatggcatccggcgtggccgccataatgctctgcgcaggaggcacgttcactgtaaacgccgccgaagaagaaccagttaaagccgacgtctcggtcaaggccatccaaggcttaagcgatgatttcatcggcggtatggacgtctcatccatgctctcgctggaagaaagcggcgtcacgttcaagaacgccaatggcgaggtcgaggatttgttcacgttgctcaaggaatccggcgtgaactatgtgcgtctgcgtgtgtggaacgatccgttcaccgcagacggccaaggatatggcggcggcaacgtcaacgccgatcgcgcactgaccatggccaagcgagccacggcagcagggctgaaagtgctggtcgacttccattactccgatttctgggccgaccccagcaagcagcaggtgcccaaggcgtggaaatcctttgaaggcgacgcggacaaaaccgccgacaccgtatacgactacaccaagcagactctgaccacgttcaaacaagccggcgtggacgtcggcatggtgcaggtcggcaacgaaaccactgcgaaaatcgccggcatctccggctgggacggcatgtccaaagtattctccgcaggttccaaagccatacgcgaagtgctccccgaagccaaggtcgtcattcatttcaccaacccggagaaagccggcacctacgccacttacgccaaacagttgagcaaccacaatgtggattacgatgtgttcgccagctcctactacccgttctggcatggcaccaccgaaaacctcaccagcgtgctcaagaacgtggcctccacttataagaaagatgtgatggtggcggaaacgtcgtgggcatacaccttggatgatggcgacgacgattccaacacagtgcccagtaaagtaaccgccgataacctcaagaaatacgacatcagcccgcaaggccaggccgatgagattcgcgcggtcgccgaggccgtgaacaatatcggcgacaatgatggcgatggcgaaaacgacggcctgggtgtgttctactgggagcccgcatgggtgcccgtgggcaccggcggcaaggataacgccgaactggtggatacgtggaacaagtacggtggcggctgggccactgaagcggccggcgaatacgatcccaatgacgccggcctgtactggggcggctcaggtgtcgataaccaagctttgttcgatttcgatggcaaggcgctcgcctctctgccgacgttcaagtacattcacaccggtgccgtcaccgatcatgtgttcaccaagatagatccagtggagattaccgcgactgactcggattccatcgacgcgatcaaagcgcaattgccgagtgaggtggccgcacactatcaggatggggtggacgagaccgaaaccgtgacctggcaatccgctgcgcttgactggattcgtggcgcaggcacatacaccatcaccggcaccaccaacgctggccacgacgtgaccgtcaccgtcaccgtcaccgccactcccgccaaggattacgtaacggacggcagcttcgagaacgctgagaacgataagaactggaccattgccggcaccggtgcgtccatcaccgaagacagtggcaacgccgccgacggcaagcgtgcgctgaagttttgggcatccgatgcctacagtttctccgccacgcagaccatcaccggactcgagcctggcgaatacgtgctgaccgccatgagccaaggcgcggcagcggacaacgccgctattaccgatggtgtggccctctccgccacaacgggtggcaagaccacgtccgatgcgctggaactcaacggttgggttaagttcgataccgccaccgtgcctgtcaccgtgggtgctgatggcacagcgaccatcaccatcacgggcaacctgcctgccgacgcatggggcaatgtggacaaggtctcactcgtcaaaaagaccgaaactccggtgaagccatccacggagaacctggacaaggccgtggccgaagccgggaaaatcaatcgcgatgagtacaccaacgagtcgctcgccaaactcgatcaggcgcttgccgccgctgacgtgctgcttgccggcagcacctacaccgagcaggacgtgaacgatgtgatcaagcttgttgccgatgccattgccggcctcgcccaaaaggaggtctccagcctgaccgtcacgccaagcaaaaccacctatcaggtgggcgatgccatcgatgccgaccatgatctcaaggtcgtgggcaactattccgcaggcatgggcaacgtgacgctttccgccgaccagttcacgctcgattacgatttctccgctcccgctgatgcggcgaaggttaccgtaacgctcaagtcgaatccgaatgtcaccgaaacctatacggttgcggttaccgctcgggccgaaggtggttccggcaacggctcggacggtgcgggtaatggcggggctactatcaatcccgatacgggcgagggcgataagaccaacggtgcgaatggcgacaagatcactggtgtgctgagcaataccggtagcgcggtgactgccgtgggtcttgcggttgtcgttctcggcgtggccggcggggtctcgcttgctttgcgtcgtaagcgctcctgatagagactgatgcggcattatgatgcggttgccggcagccggcaaccggctgccagatgccatctgtcggctgtcgtttatcggttgtcggctgtcagatgcgtctgtctcggcgcagcgatgcgattctgtcccggttcgtgcatcaatcgtttgatgtgggtaccaggacagaaatcactgtcctggtttgcgaaaacgggtgtttttcgcgtaccgggacaattcccgttgccccggtttgcacgtcaatcgttctacgtgagaaccgggacagtatgttgatttcgggattggctgtattccgccgattctgtttgtcggggtatgtggactttggggattgtcttgtcctggttctcgaaaatggcctgaaattgcgtaccgggacaacgatttctgccccggtgcaaacgtcaatcgattgacgcctgtaccggggcaaattcgcgcccgggaacaatagggcgagggccggtcgcaggagtagagcgtgatgttgtcatgattgcgcttggctctcccacacggaaggccgggcgcaatcatgccgtttggttgcagcacccgcacatcgcctgcataaccgtgtacagtggcgtgtagttgcagtacatgaaggagcatcacaagccatgaccaacggacacatcaatcccgccaacgtgccggacatcgccttgaaagacggccattccattccgcaggtcggccttggcatgctacgtatcgatgacgagggcgtggcccctgtcgtcgaatctgcgctggaagccggataccgccacatcgatggcgccgccggatacaacaacgaggccggcgtgggtcgtgcgctcgccgcttccggatacaacaccggcgccaagcgcgagaccctgtgggtcaccaccaagctgcgcgactccgagcagggctacgactccgcgctcaaggcattcgacaactccctgaaactcctccagctcgattacgtggacatgtacatgatccattggcccacgccgttcgactggcgcagcaccgacacctggaaggcgttcgtcaagctgcgcgacgaaggcatggcacgcacgctcggcgtatgcaacttcatgcccgccgatctgaagcgtctgcacgaggagaccggcgcatggccggccgtcaatcagattgagctgcaccccacgtggcagcagcgcgaagtggtggcgttctgcaaggagcacggcatcgccgtggaggcctactcgccgatggcgcgtggcgccgacctcaacgccggcgacggcaccatcgagaagatcgccgccgcccatgaggtcagcccggcccaggtgattctgcgctggcacatcgaaaacggcacgatcatcatccccaagtccgtgcatgctgaccgccagaaggagaatctcaacctgttcggcttcgccctgaccgccgatgaacacgctgccatcgacgccctcgacggccccacccgcgccggccacgaccccctcaccttcacctatgcgtgattgatggcacgtcgtaacacccacttccgccgtcgtttcaacgcctctggaccgctggagcgcgtgctgattctcatcgttctcgccgtagcaatcggcgtgaccatcggcctgctactgccgcaggtcagctccgacgcggccaaaatcaccggtggctacactgccaccggttcagccgccgacactttgaacgcgctcgccgtagacgacaaccaaagctcctccggctacgaccgcgattccttcggtttccgcaccaccgacgtcgacggcaatggctgcgacgtacgcgacgacgtgctcgcccgtgatctcacggacatcacctacaaatacgccggttcctgtgtggtcgagtccggcacactggccgatccgtacaccgctcagaccatccattttgtacgtggccgcgccaccagcgccaaagtgcagatcgaccatgtggtggcccttgaaaacgcttggcaatccggtgcgcgcgactggtccactgccaaacgccatgaattcggcaatgacccctacaacctgctggccgtcgacggcccggccaatcaggagaagggttcggcttccgccgcctactggctacccaccaacgccgactaccgttgcgactacgtggcccgccagattggcgtcaaagacaagtaccagctcaccgtcacctcccaagaaaaggacgccatgctcgccgtcctccacacctgcccgggccaggccgtgcccgcagacgaataggggctaccgttcaggattgttgagcataggtgcctgcccctcgtcataagcgcgcaggagccgtcggagcaaaaatgtggtgaagtatggtgcggtgaacacgtgttcgctgctaccgatattgccggcggatagtttcacgccgaactgaatttccggataagaatccgaagcgattagcgtccgcatggatttggcggtgccttttttcgatttcacctccaccggcaccagccattcgcgcgtgcggacgaagaaatcctgttccagtgtggaatcctcttttttgtagtagtacaggtcatagccggatttccgtagcgcttcagagacgatgctctcgtacatagcacccttatagacaccaagattacgattggcccgcagatcatcactggcctcgtcgtcaagcatcgctacgaacagaccggtatcgccgaaatatatcttgaacttgttttcgtcgtaattgcctttcaacggcagttcaggataggacatacatcggcagatattcaccattcccgaggtttcaagccattccacgcatcctcgatagtctttgaaacgcgctccgctggcaaccttgctgatttggaacttcttgttttccttggcgagttgcacgggaatatggttgaacacgttgagaattcgtgcctgatcgagtccttgcgcgtatttgcggatatcctcctggtagtccaaaataagctggcgctgcaattgcagtgttccctcgaacgtgccagtgcgtatatgggaggcgacaaccgcaggcatgccgccaagcacgcagtaatccataaatgccgtggagaagacgttcatttccacttcagagaatggcgtagcatcacacaggtgggtgaacatgctttcgatgacggcctcatcgtatccgcgagcccacagaaattcttcgaagtccaacgatcgcatttcgtagtcggtcttatatcccacgctattgctttcgatttgcttatagctgatgcccagcattgaaccgctgcaaatcacatcatatttgccgtcgattttaaagaacttcagtgcagtggcgatatcaggatgggcctggatttcgtcgaaaaagatgagcgtatcgcccggaatgaactttttggctgggtcgatcagggaaatattgcggacgatggtatccgcgccataaccgtccgcagtgattgcacgatatttcggttcctcaacgaagttgatttccactaccgaacggtagttgtgtgcggcaaagtaatcgatagtctctgtcttgcctacttgacgaggacccttgatgattagcggggagcgattcgggtcggatttccatgcattgagataggcatcggctttgcgtttgagatacatgaggagcccctttccgaattactgctatagcaatgattttacactttcatgagcgagttttctaccgtctggcacatttcatgagcgagttttcggcggtttgtcacatttcatgagcgagatggcggggaatgccagctgccagtccgccagtcatccatcaatcgtccgcagattgtccgtctgttgacgtgagaaacatgcccgcgctataactgagcccggtatgaagggagaagggaataggaacagacgatatggcagtaacacacaccgcagcagatgccactgcggcaaccactatgacgaacgccgtggcagacatcgaacaggaaacaccggaaatcgagaaggaacgccagcttgccggagtcggagccggagctggaaccgtggcaaacggcaagaaaaagccgcatgaccatgcgctggccagcatcctcggccccgcgttcgtggcggccgtggcttacgtcgatcctggcaacgtggcggccaacatcacctccggcgcgcgatacggctacctgttgatgtgggtgctggtgttcgccaacgccatgagcgtgctcatccagtatcagtccgcaaaactcggcatcgtgaccaacaaatccctgccggaactgctgggtgagcgtatgagcgatgctggccgcttcatgttcttcatgcaggctgaagtcatcgccatcgccaccgatctggccgaggtgatcggcggcgccatcgccctgaacctgctgttcggattgccgctgttcatcggcggtctggtgatcggcgcaatctccacggtgatgctgtggttccaaggtggcaagacgcaaaccacgttcgagcgcatcatcatcgtgatgctgctgattatcacattcggcttcatcgcaggcctgttcgtggacccgccgagccccggcgaagtggtcaagggcatgattccacgcttccaaggcaccgactcggtgctgatggccgcctcgattctgggcgccaccgtgatgcctcacgccatctacctgcactccacgctggtgaacgaccattacgcaggcggcgaaaagccgtcgatcaaaacgcagctgaaaggctcgaaaatcgatgtggtctgggcgctgttgctggccggcaccgtgaatctggcgatgctggtgctcgccgccaactcgctgcacggcatgtctggcacggattccatcgacggcgcacaacgggcgatcgcgcaggtgcttggcccggtgatcggcacgatcttctccatcggcctgctggcttcgtcgctgagctccacgtcggtcggcacgtatgccggctcggaaatcatgcacggtctgctgcacgttaacgctccgatgtgggcctgccgcgtggtcacgctggtgccggcactgattgtgctgtggttcgccaaggacccgactcaggcgctggtcatcggccaggtggtgctttccattggcatcccgttcgccgtgattccgctgatgcgatacacgcataacaaggaactcatgggcaagtgggctgatggaaccgtcaagcacgtgatttttatgattgtggtggcactgattgtggcgctcaacgtgctgctgattgtcctgacgctgatgggcagggcgtaatagactccagctgaaatcctgcgatagcacaacataataagaagccccggtgctggaaccggggtttctcattatgttgagaatggttgaatctgccgtcagttcgcagccatacgccgcgcacgccgttcgcgcagcgcgcgcaaggaaataatgtctcgcgtacgaccggcaccgtcgcccttgacgccgaagaacaccatcaacaccattgccaggcagatcattgcggagatgcgcagcgcccattgaatgccgaaaatcgaagcggcgacggcggaggcgccgccctgcttatgcaaagcggcaaacgtttccatcagaatcaccaacacgggtgcgcccacagcgcccgcaatctgacgcgcggtattcgtcaccgatgatccggcggacacttcgctcggcccgttcaggcaattcagggaccacgtggtaatcggcatcagcaggaaacccatgccgatctgacggatgaactggcagatcgatacccaccagatccacgtatccatcgccaccagcgacatgcccaaggtgccaagggtcaacacaatcgaaccgaacaaagccaccgggcgcgcgccgaaccgatccatcgcgcggccgccgaagaactgggagacgcactggccgatagcgcccggcagcatgatcagaccgctcatcgtggccgaatagccgcggtcagtctggatgtagagcggcatgatgaccaaaatcgaactgaaggcgaaaaatgccagcgacgcggtaatggtgccgacggtgaacgaagggttcttcagcacttccaagtccagcagcggcggctgggggagtgccgactcgtccttggctacggcctcgcgataccgcttgccagcgcgcaggttgcgcatcacaaaccacacgatgccgaccagccccacaaccatcggcccccacgtgaccggtgccgcgaatccataggtctctgaattggtgaagccgaacataagcccgccaaagccgatcaccgacaggcatgccgagaagaagtccgcgcgggccgaagggtcgtgtgaaccgaaattatgcagtccgaacatggccgccagcagcgagattacgccaatgatggtcatggtcaggaagatcgagcgccagccgttggcatcggtctgccagccgcccaaggtggggccgatggcaggcgccacgctcatggccatgcccaccgtgcccatggcaaacccgcggcgagacagcgggtagatggagaacacggtgatttgcagcaccggccacatcacgcctgtgccggcagcttcgagcacgcgcccgaccaacacccatacgaagtttggccccaaccatgccagcacggagccgattgtgaacaccgccatcgagcagatgacgatctggcgggtggagaagcgtcgggtcagaaacgcggtcagcggcaccatcacgcccatgaccagctggaacacggaggtgagccactgcccggtggttacggagatgtggaattcggaaacgataatcggcagcgcggaactcagctgcaactgcgtgaagttgcccacgaaggtaataaaggtcaatatcgcgatggagatgaacgccgcccggctgagtttgccgtctacatatgattcctcgcggctcagcacccgctgcagttcgccgcgacgatttttgattccccgagctccgttcattccactcacgtgcatactccactctcgctgatcgaccgcaacaacgcatcaggcagtttctcaaagcaaccccaacacgctacacccaggggtagtccgtcgagatgcaatgccgagatgactggccgcccggttgcagagcaaattagtcccgttattcgagacgtcaaaatgaacgtagttactatccgatcacgttcgctatgtggttttccaacacccccccccccctagcggttaggggtgtgatgtctgtaccatgttgaaggggtaaccccgtatacacccgtacacaggggaatccagagaagtgagagccgcgagacctgaggtatacggttgaaaaggaagaattggtgtttgagatgtcatctctgagcagtaacggtcagccgtctacacgcagcagacaggccaatagcggtgaccgaaccaccgctcagctcagtgatatccgccaaaagcagctcagccacgtgctgtactggcgattcttcgtcaatctcgccctcatgcttatcgacgccgccatgtacatcatcgccggagctacggtgctcaatctgcgccatgaggcaacgccgctctattcgagcagattcaatttcacgattgactccaccgtttaccttattattatggcctgcttctgggtgtggtcgctctatgttgccggcatttatcaccgccatgttatgggtgacggttaccagctcaacgtgctgctggtcaaaggcatggtcgtgtgctgggtggtgcagtgcgcgttcaactacttcttcaatctgggtctgaccctcacgtcgctctgcttggtggtgattgccggatggttgctcaccatggtggaacgcattgccagccgtgcattcattacgcgtagtcgtcgcaagggcgcctacgcttatggcacggtgatcatcggttccccgcacggcattggtcgcacgctacaattcctcggtcagcgtcggcaactcaactaccgcccggtggcagtatgcccgattcatctcaatcccgataccggattgattgaacagagcgccgaccatgagacactccgtgaggagatgcaaaagaacaagggctgccagctgcccgtactcgagtacagcgatcataatcttgctgaacagattattgacatgaacgcgcagaccgttatggtggctgacgagctgcgtcgctattcggataattacgatatcttctccgtgcgcatggaatcgttcggtctggagattgccatgctggcttccgccgctgacacttctaaccatgagattcaggttcgatccatccaaggcaccacggttatcacgcagcgtcttgcgcaatacacgccagcccgtcgtttgaccaaacgcttgtttgatttggtgatttcttcactggcgattatctgttcgctgattatcaccattccggtggcgatcgccatcaaagtcacggacggcggaccggtgttctacaagcagacccgtatgggcctgcgcggcaagccgttccagatgtacaagttccgctcgatggtagtgaacgccgacgcgctcaagaaggagctcgcaaaagaaaccggtcagaccgaccgcttcatcttcaagatgaagaacgatccacgcatcaccaaggtggggcacttcattcgccgcttctccattgacgagttgccccagttcctcaacgtatggatgggcgatatgtccgtagtggggccgcgcccgccgctgcctgaggaatatgcccgttacaaccgtctgtacgccacccgcatgctggtcaagcccggcatcaccggtccgtggcaagtgtccggccgctccgatctgtccgccgaggaaagcgaggcccttgatgtggcttacgtgcagaactggtcgattatgggagacatcgtgctgctgttccgcacggtgggtgcagtgctgagccataagggagcgtactgattccttcccgtttcgccgtcacagttttgccgcgcccttgccacaccgcccttgaacgtgattacagaaagataagtcgatatatctatgactgattcgaacataccagaaatacctcagccgccggcaccctccgagcggtcgaaaaacgcggatgatcgccaagtgatacagccgtatgttgaccccgaggtacttgctgaagacgtccgagcggcagaacggcgtaagcaccgccggcgtatgagccatgaacatatcaggcggatcaagcgcaaaaagcgcattcggatggtgctgattgtaatcggcgcactgctgttgattattgcagcgctcgcggcgtggctcggcctttccgcgctcaaagcgaaaaatgaagtggaagcagcgattcaggccgcaagccgcatccaatcacaagttcaagccggcgacaccgacaaagcgcaagccagcattgaagcattctcccagcatatcgacgctacgtatgcgcagaccaagcagccggtatggaaactggccacattggtgccctattacggttctgacgtgaaggccgcgcgagacatggtgcacattttggaagacgtgtcgaacaacgcattgccgaagcttgccaaggcggcacaggccttggatttcaacagcatcggtatcaaagacggcacgattcagctgggggatatggccagcgtgactcaggatcttgccgccgccaatggagtagtggcggatgccagcgtagacatgggcaagattggtgatacgcatattccgcagattaccgaggcggtgcagcaggggcgtagcaagttcaaggagcttgccagcctgacggatacggccagtcggctgacggatgtgctgcccaagatgttcgacttggatagcagtgatggaggtggtagcggcagaggcccgcgaacctacctggtgctggcacagaacaatgctgagctgcgtgccacgggaggcattccaactgcgtgggccacgctcaccgtcgatacaggcaaaatcagcatgagcacgttcggcgatccgcctcggaatggtctgttcagccaggatgaagccgcgagcgtactgacggcggaagaacgcaatctcttctccaccaagatggccacggactacccggacatcaatttcactcccgatttcccccgcgtcgctgatatcgcgagtcagatctggcatcgagccggtcatgacgatgtggatggcgtcatcagcgtggacccggtgttcctgcagcggttattgaaggttgccggccccgtgacgctctccgatggcacggtgatgagcggcgacaatgccgagcagcggattctgaaccagatttatattgataccgatacgcaggcggagcaaaccgacttcttcacgatggcggccagtgagatcttcacgcatgtgctcaagaatgtggacggcaagaatcagcagctggtgcaaacgttccaggagtccgtatccgacggccatctgtatgtatggagtgctcatgaggatgagcagcggcgtatcttgggtacgaccatcgccggcgaattgcagtcgaaaccggctcattcggttacgggtgtgtacttcaacgatgccactatgggcaagatggactggtacctgaagcgtgaagtgaccagtacatatgacaaaacctatcccagtggcgccaagcaatacaccgttcacatcaaactgacgaatacggccgatgccgccgaggtgaatgccgctccggatctgttgcgcggctatgaccataacggcaacccccgtacgggggagatcgaaacggtgctgtacgtctacgcccccgatgaagggcgcattgtggattggacccaggatttcgatcagttcgctgtgcacgatggactgacggtgggtgtgaaaaccgtgacattgcggccgggggaaagtttcgagaccacggtgcatgtgctggccagtcccgcggccgatgaaaatgaaatgattttgagacagacccccttggttgattaaaggggcaacccctatacattaaggtggaaccgtgaataaggaagaacggagcatagctgtggatgaagctgaacaggtgcaggacggtaatggagtcaccattctcgatttattcaatgcggtaagaaagcatgtgattaccgcagtggtcacgctggtcattgtgatggtggcaatctgcgcgtacacctttacccgcactccgcaatacaccgcaacttccgaactcttggccacttatcgcagttcagcggctgcgtcgggcgcatccagcaatgcaagcgagctgagctctggcgccaattacatcaatagccagattcaaacgtatccgcagttggtaaaaaccgagtctgtattgcagccggttattgatgatttgggtcttgacaccacggtaaaggaattggctgagggcgttaccgcttccaacccggatggcaccatgctggtggatatttcggttaatgatccagacccgaagcaggcgtccagcattgccaattcggttgccgaaaacctgagaaaacaggttacttccacgatttacagcgatgagggcgataagatcatctctcccgtcaacctaactgtggtgcagcaggcgtacgctccggcttcccccagttcacctaacgtcaagctcaatttggcggcaggtcttgcggtcggtgtcattctcggcatcgtggttgcctttatcaaggatttgctggacacccgtgttcgccgcgattctgatgttaccgctgttatcgatgctcccgtactggggtcgctgagccgcaatgaggcttatgccggtacgtcgccggtgattatctcccgcccggcctcccgcgaggcagaagagattcgacgcctgcgcaccaatgtgatgttcgtgctgcccgatgagccgttatccaatgtaattgtggtgacttccaccggcccgtccgaaggcaagaccacgctgagcgtgaacctggcgactgcattcgccgaaaacggcagcaaggtactgctgatcgacgccgatgtgcgcaacccctcggtgagcaaggccctaggcattgagggtgcagtgggcttgacccatctgattaccaaccgtgtatcgtcgcatgatgcgattcaacgctactggaagccgaacttccacgtgcttcctgctggaaaacaaaccatgaaccccagcattctgctgaattcccgcgctatgaaggcactggttgagcaggtttccggagcctatgactatgtgattatcgataccgcccccatgcaggtggccaatgatgccgccgtattcgccaaggaagggccagaactgctgctggtggccggcttgggagtgacggaaaagaaactgctccggcagaccgggcacgaactgagcacactgagcatcgatcccgtgggcttggccatgaattacggcgagacggagaagccccagaagggtggctattactactacggcgacgagtccgacgacaacggcaagaagcgccaaatccagcacaaaaagagcgagaaaacgaagaaggactgaggccatgaggatcgcgttcatcggccacaaacgcattccgtctcgcgaaggtggcattgagattgttgtggacgaactggctacacgtatggttgcacgcggggagcaggtcgtggtgtacaaccgcaaaggccacaacgtggccggcgaggagttcgacaaccagtcgagcaccagcgacaagccgtatatgtaccggggagtgaaggtcattcccgtcacgaccatcgacgccaagggactggccgccctcacgtcctctttcttcgccacgttgaaggcgatcaaggcccgtccggatgtgatccactaccatgcggagggcccgtgcgtgccgcttcgtctggcgcattggttcggcatccgcaccgtcgccacgattcacggcctcgactggcagcgcgcgaaatggggacgtttcgcctccacgtatctcaagctgggcgagcgcacggccgcgaaatgcgcggacgaggtgatcgtgctgagccgtggtgtgcagcagtatttcaaagacacatacgggcgggagacacgtttcattcccaacggcattgcgccggtagaatccgtttctcctgacgtgattgctgacaagtggagtctggagaaggattcctacattctgttcttgggacgcatcgtaccggaaaagggcgtgcattacctcatcgaagcgttcaagcgattagacactgacaagaagctcgtgatcgcgggcggcgcatcggattccgccgaatactacgagtcgattaagcaggccgctaccggagatcagcgcattattctgaccgggtttattgaaggacgtgaactcgaagaactgtatagcaacgcatacatatatgtattgcccagtgatttggaaggtatgccaatgagcctattggaggcattggcttacggctgctgctgcctgacctccaatatcgctgaatgtgctgatgtgctgtgtgatgagtccggaatgatgcatggagtcacgttccgacatggcgatgtgaacgatttggccgacaaactcggtgagttgctcgtagacgtgggtaaggtacgaaaaatcaagaccggcgcggccggctatatcactggccgctatagctgggacaaggttgttcaagcgaccctcaagctctaccgaggagcagataaatgaggattttactggtcaacaaatatttctaccgcaaaggcggtgctgaaacatatttcttcgcgcttgcggagggattgaaagcactcggccatgaggttgcgttcttctccatgcagcacccaaacaatgagccgagttattggagcaagtatttcgtatccgaaaaggactacgtcggcaagatttccgcgttcaaaaaagtgaaggaagcggcgacgttggtgtattccttcgaagcgaagcgcaagtttgaggcgctgctcgaagaattccagccagacattattcatataaataatgtgcatcgccagctcactttgtcgattctggatgcgccttatttgaagaagcaccgtgttccggtggtgtatacagcgcacgactatattctgctgtgcccggcttacacgatggtggacggttccggcaaggtttgcgacgattgccttgactgtcacttcttccatgcggtgaagaaaacttgtgtgaaaggatcgaaagcgaagagtggtctggcgttccttgaagcggaattcctgaagaaccatcattcctacgacaagatcgacaaaatcatcgcccccagtgaattcatgaagcacaagctggatgagggtggatatgccggcagaaccgtggccatgcagaacttcctgaccaccagccaaatggacatggcgcataaggtagccaacacgaataagttcaataccgttgagccgtatttcttgttctttggtcgactttccaaagaaaaaggcatccttacattggtgagggcgttcctgcgggctgcaggcttgatgaatagtggggttgcaggcagcaaactcctcccagccaattggaccttgcatatcgtcggcgatggtcctgagcgccaggctatcgaaaatctcatcaaatcagccggccctgaagctgaacgccgtatcaaactccttggctacaagaccggagaggatcttcagcgcgaggttggcaatgctcgcttcagcgtgctgtgctccgaatggcgggagaacatgccttattcaggtttggaatccctggcagcgcagactccaataatcggcgcgaatatcggaggaattcccgagcttgtggtggaagggaaaaccggattcaggtttgaatccgggcagttagatgatttggcaaaccatctattgcaagcgtcagcactcaatggtgatgaatatgcagtcatgcaacaggaatgcggcgactatatcaatcgcagagctcaacaaagcctttatatccgttctcttggggaactatacatgcgctgtttgcagattccaacccagcaaagggatgtcgaggaggagaaatgaagaacacaattgatttgcataatgccgctgtactggtcactggcgctgcgggattcatcggctcgaatcttgcaaagcaactgcttgattctattgaagggattcatgttatcggtttcgataatgtaaatgattattacgatgtgcgtcttaaggaatatcgccttaaccagctctctcattatgaagggttcactttcatcaaagctgatttggcagataaagacgcagtaaatgatgtattcgagcaataccgacctaccgttgtggtgaatcttgccgctcaagctggtgtgcgatattccatcacgcatcctgatgcttatattcagtcgaatctgattggtttttataacattcttgaggcttgtcgccatcatccggtggatcatcttgtgtatgcatctagctcctccgtatatgggtccaataagaaggttccatattccacggatgacaaggtagataatccagtgagcctatacgctgctacgaaaaagtctgatgagctgttggcacatgcctactcaaagctgtatgacattccttctacgggcctgcgtttctttaccgtgtatggacctgccggacgccctgatatggcgtatttcggtttcaccaataagcttcgcgcaggagaaacaatcaagattttcaactatggcaattgccgacgtgactttacctatgttgatgacattgttgagggcattctgcgcgtgatgcaaggtgcgccttcgaagcagacaggagaagatggtctgccggttccgccttatgcggtgtacaacattggtaacgggcatccggaaaacctgctcgaattcgtcactattctgcaggaggagcttctacgagccaaagtgcttcctgcagattacgacttcgaatctcataaagagctggtccccatgcaaccaggcgatgtgccggtcacgtatgcggatactgcggccttagaacgcgattttggctatagaccttcaactccgctgcgtgaaggcttgcgtcgatttgccgagtggtacaagaccttctacctcgatgactctgataaatagggcattcgattcgctattccagtcattcacgtagttcataacatattttacaagaagggatgaaaaaagagatgaaggattttgattcattgaagattgccgttgctggtaccggttacgttggcttgagcttggctacgcttttggcgcagcatcatcaggttaccgcggtggatattgttcctgcgaaggtcgacatgatcaacgcccgtaagtccccgatccaggacgattacatcgagaagtactttgcggagaaggagttggacctcactgccacgctggatggtgaaagcgcataccgcgacgccgatttcgtgatcatcgcgactcccaccaactacgacagcacgaagaactttttcgacacctctgcggtggaggccgtcatcaacctggtgatgaaggtgaatccgggcgcgatcatggttatcaagtccaccatcccggtcggttacaccaagtcgattcgtgagaagaccggttccaggaacatcatcttcagcccggagttcctgcgcgaatccaaggcactgtacgacaacctgtacccgagccgcatcgtggtcggcaccgacccggaggaccggcatctcgtcgaggcggccgagacgttcgccaagctgctgcagcagggggccatcgaggagaacatccacacgctgctcatgggcttcaccgaggccgaggccgtgaagctgttcgccaacacgtatctggcactgcgcgtctcctacttcaacgagctcgacacctacgccgagtcgaagggcctgaacacgcgcgagatcatcgacggcgtgtgcctcgacccgcgcatcggcacgcattacaacaacccgagcttcggttacggcggctactgcctgccgaaggacacgaagcagctgctcgccaactaccaggacgtgccggagaacctcatccaggcgatcgtggattcgaacaccacccgtaaagacttcatcgccgaccgcgtactcgagcttgctggtgcctatggccccaacagcgaatgggatgccagcaaggaacatgagaccgtggttggtgtgtatcgcttgaccatgaagtccaactccgacaacttccgccagagctccattcagggtgtgatgaagcgcatcaaggccaagggtgcgacggttatcatctatgaacccacgctcgaaaacggctctaccttctttggctccgaagtggtcaacgaccttgatgagttcaagaagcgctcgcactccattgtcgcgaaccgttatgactcttgcctcgatgacgtaaaggacaaggtctacacccgcgacctgttccgcagggactaaacagcacatataccaatataagcaaggacgtatcgatatgggtgagagtatatgtttcattatgccaactatggacggtggcggtgccgaacgagtggtctctattctctctggcgaattcgctcgtagtggatgtgatgtgacgttgttcttaactaacagcactcataccgcgtatgctttggacaagcgcgtccatgtcgatacatcctgcgcggaaagcaacccgaattcccttgatcagattaaagctattcgggcgaagatgagagcgatgccgaatacggtatttatttccttcatggatagtcaaaatttgttcactctaatagcgggaattggtatgcggaaccgcataattatctcccagcgtaatgatccacaccgtgcttttggaaagcgtcggctggttagggctattcatccgtggctatacgctcttgcggactgcgtggtattccaaacacaggatgcacttgagtattaccccaaatatgcggctggtaagtaccgtgtgattcttaatcctctcaataatagcatgctgccacgctatgaaggtgaacgatccaagcgagtggttaccgtttgtcgtttgaatgagcagaagaatttgccgctcgccattgatgcgtttgcagaattccgcacacggttctgcgactataccttcgagatttacggcgaaggcgcactggaaaatgatctaaagcgttatgcagtttcccgaggggttggcgatagcgttcatttctgcggcttccggaaggatgttcatgcctgcattttcgatgccgccatgtttgtcatttcctcggattttgagggactctcgaattcaatgattgaagctattgcgttgggaattccgacgattgctacggactgcccaatcggtggggcccgcatggtcattgacaatggcgtaaatggatatcttgttccggttcggaacaaggagcgcatggttacggctatgtgcagtattgcaggcgatactggtgtgcaggaacgctttagcaaagctggcgtgcggttgcgtgaacgtttgtcggttgactctatttcgaagcagtggctttcggccattaaagagaaataagacatcaagaatatcaaggagaaaatcatgaagattttggttaccggtgctaatggatatttagggcgcggtgtggttgatgagttgcttaagcgtggaaacgaggtaatcgccacagacttcgcctgtgaccatgtgaattctgcggctcattgcgtgcccggagacatcttctcgattgaagatccctatacgtacttcggcgagcccgatgtggtgttgcatctggcttggcgtgatggttttgtacacaattcgaatgcgcactttgaggatttgcctaagcatgttgcattcctgaaaaaactgtgcgaatccggaatccagcaagtggcgtgcatgggatcgatgcatgaaatcggattccatgaaggcagcatcaacgctcacaccccatgctggccgatgagcatgtatggaatcgccaaggatgcgctccgtaacgcattgcagaccatagcgttgcagaacaaagtaaagttccagtggcttcgtggatattacatcgtcagcgatacgcaatatggcagctccattttctcaaaaatcgttgcggcggagatcgaaggtaagaaagagttcccgttcaccacaggtcagaaccagtatgattttctagattatcccgatttctgtcatcaagttgccgcggcggtgaatcaggatgaagtgttggggattatcaatatctgttccggtaagcccgaaaaacttgctgatagggtggaacggtttattgccgagaatgggttctccatcaaattgaaatatggtgcattccctgatcggccctatgactccaaagccgcgtggggcgatgctttgaagattacccgaatcctcgatacggaacattgattttccattttttcgcaaaggattgaggataacaatgggtactttgctcgagcaggataagtatcgatacgccgttgagaaaatgcctagattccagcggttatttcgttgttgccaagagtgcaggttcaagcctatgcagttggtgtatcgactgctgtttcgctggtgccgtcagaggaatttcatcgagttaagccatcaaacggttatcggtggtggcctgtatatcggacatccttattgcatcaccatcaatcctcaagccgttattgggcggaatgtcaatatccatcgaggggttgttattggccaggagaatcgtggaaagagaaaaggtgctctaacgcttggtgatgacatttggattggaatcaatgcgtcaatagtgggaggagtgaaggtcgggaacgacgtaatgattgctcctggggcctttgtgaatcgcgacgtgccaagtcactcggtagttattggcaatccttgcattatcaagcataaggatcatgccaccgagggatatatcaatcataaaagtcagtgacgtggtattgcaaaaaagcagggaatgaaatgggagctcacaatagcattagacgctatcttcaccgcattggtgaggaaatacgatctacggcggaaatagcgaaattgacttcatggccggctgcagtggaaacgcttattgctaaggcggatatccaaattatgtgccgtaatgggtatgcggaaccgccgaatgcgcgtcgtcgtctgattcgtaagcatgaaacactgcttaagtatttcgagaaacgatatggagatttcgcttctggctatcgctataaggtaaatcttccagccgtaccggaggaactcaaaggttgcatctggttatgctggtggcaagggcttgaccatgctccgcgtatcgtccaacgctgtgtagaatcgattcgcgaatatgcgggagatcgacgtgtgattgtgattaccgaggacaattatcgtgattatgtgaccttccctgactggatgatgcgcaaatatcatgaaggcactattgctcgcacacatttgtcggacttgctgcgtttatcgttgctggctcagtatggcggattgtggttggacgcgacgttctattgcgctggcgatattgaagactgttttggccagccattgttctctatcaagcgccccgagtatttgcatgcaagtgtggcgcagggatattttgcaaattactcttttggatgtgatgccgaccatcgttggatatttgccgtgatacgtgatttcttgcttgaatattggcgtacaaatgattttatggtcgactacttgttcttggattatttaatcgtactagtgcaacgacattgcactgcggttaaggaggcgtttgcagcaatcacccccaataatccacaatgcgatgacctgttcaagtgtttaggtgatgtctttaatgagcgtcattgggagtcattaattgccgatacatcattgttcaaattgacatggaagcaagagtttcccaccgaaatcaatggtgtcgaaacttattatggaagattgctcaacggcaatttgcgtcgaaattagttttttccagaggtgttgatgattcgcataacgaagaccaaaacactccagtacgcgtggctgtaccttatgttactgattccgggcagctgcgcgatgtcacgctatctgaataccacattggtgtatggcgtgattattgctatatatgccctgcttgcgttgttgagcgcaaaatataggaatgtttatgtgctgtcgttttgccttttgcttgcattggcaacgattgttatccgattgaaaacaggaggtgtggggcccctaagttttctttccaacgcagcgatgctggttgtcacctatatcgcaatgactattgatcggagaatgtttcttacccgattcgtaagaattgtttgtttctttggcatcatcagtgtgctattttgggcggcgttttgcattaacccttcgctggtgaatgcatggcctgcaacatcattctggacgcagaacttggggacgggtcaatgggccactgtgcttcatggaaaaggactctggctttactcgtatcttgaaatacacgcaacccgtaattgtggtttctacactgaacctggcgtgtatcagattgtactcaatgctgttttattcgtcctgttattttggaaaaagaaattatattttgataacgagaagcaatatcgtacggcgaccgtcattgtcttgctcacactgattacttgccagtcgacgaccggttatctttctatgatggtcatcttgttgtgcttcttctttatgcgtggcagagagcgaggcatacgtacgctgaaacaaaagcttgcagtgctagtggtcgccattacggcggtgctgatcactgattatttgcttcgcggggaagagagtctcctttatgttcaagtgctgaacaagctatttggtggaggcattggcggtggtgtcaatttagaggatagcacgggacaatatcgttggattacagtgatggctagtttgaaggctctttccatggacccgttcggtatcggttttgacgcattctatgcgatacgagactcatttgacccagctgcagttgccgctagcattgcgacctatgccgcagtgtatggaatgattttctggctgacgatgatgattatgattttctatccaatgattcgacgggaaccaaagaaaatactcattgccgtatttgcttttatgtttatcaattccacggttagcgagacgtatttgttctatccgggtctcatgatgttcccgatttatctcagctcctatttcacacataagcagtccagtgtcgttggacatgcgattgctacatgtaatcctcgccattcgctaatggtttccaatctgatgaatgctaaagaggtgatgtaatggaacggactctgctgcttgttcccagcggtagcttctattatttcaatagtatgaaacttcctaatgtggtggttttccctgtgttccgcgaagttcatggcgcgtccgaaatggtttggaaagcaatgaggaagctgaggcttgctgccagctcgctgttctatactgattggtacaaggatttgcagtcgttttccaagatcattgtttttgattttacggtatggctggatccggcgttattgcgcaacattaatagacataaaaatcctgacgcgaaatgttatctatattcctggaatattgttcgcgacaagcaggttgtccttggtcatcttacggcgtgcaggaagtatggtttctcatattattcgtatgacgaaaatgactgcaagcaatatggattccgcttcaacaccatcatgtatgacgagaacttgcgtctcccggaacgtgctctgacgtcagatatcctgtttcttggttttctcaaggatcgcaaggcaaaaatgcttgctttgcatcaaatcatctccgatgctggcatgaaaccggaattcgtaattgttgaaaacggtaatcagcatgaagatttgccattcaccattaggcactcatatgttaattatgcggattatctcgatatggtttcgcaaagcaaggcgattttggatatcacgcagcaaggtcagaacggattctctatgcgcgtgatggaatccattttcctcaacaagaaactcgtttcgactaacatggctctattgtcagcgaatttttatgatcccaataatattctggtcattgatttgcagaaccctgatgaagaagagcttaccgtgttcctgcgttccgagtttcacccatattctcaagagacaagacactactattccgtcggctcatggatcaatcgtttccaacaatgatggtgcagacgaataatggcaaaacacattaaaaaacatttttggaataagcggccatccgagggtatgaaatcggcggtagcatacacattcgcatcgctgttttctaaaggtttggcctttgttactgtgccaatttttacccgaatcatgtcaacttctgagatgggcacagtcaatctgtacaattcttggcagtcgatactgacggttgtggcgacgctctcgttgacttacggcggatatatggtcgcgttgaaggaatatgagcatgagcgcgataggtacgaatcttcagtgctgacgctcacgacgttcacatcaatcgtattctttgccgtatattccgttgctcccaatttttggagtcgcatacttggcctagacaaatcgctgttgctgctgatgctagttggtttcctattgctgccggctacggagttctggctggcaagacagcgttacgagtataagtacaaggcagcaacactggtgacgattggctccgcaattgtggcatcagcactttccattgtcgctgtattgtatatgcgaggaagcggaaaagcggccgaaggacgattgttcgcgaattatgccgtgctatatgctgttgctcttgtgctatgggtatacatcatggtgcgagggcgcaagttcatttccatgcggtattggaaattctcacttgctctgagtgtgcctcttattgcgaatcagttcgccacgcagattctgaataattccggtcgcgtgatgattggttggttcgttgataattccgctgtgggcatttatggcacactttcctcggtgagtaccgtttccgcaatcgtatggtcggcaattaattcttcgtttatcccattcctctatcggaatattgatgattccgaaggcaagaaaagagttcggagcctcgcttcgattctgctgctcacctatgctgcggtatgcgtattgatgactttcctagctcctgaggtggtcaagataatcgcaactgatgaatatatggcagcgatttacatcatgccgccaatttctgcagccattttccagaacgctatttccaatatgtatgcaaacgtgttgttgtatcacaaaaaatcttcatacataatgattgcctctatttgtggcgcagtactgaatattgtactgaatgcagtactgattcctctatttggataccaggcagcggcctattcgatgttgattgcattcgtattcttgtcgtatgtgcaaatgcgtgtgtccaaaaaactgcacttcactatcacgggaaccaaggaaaccgtatatgatgacaaagtcattatcggtatacaatggctggtaattgtgctttccgccattgcgattcctctatatcacttcacgattattcgttatatagcagcatttgtcctgatggttgcctccttgttcctatacaaaaagagcaaaatatctgtctgatatagaaaggaaccgcattgtttgagaaattaatgaatcatttccgtaatgctgagaaaaatgctgctcattaccgaaagctgggtttaaagctgggggggggcttcgagattctcaatggctgggattttggaagtgaaccgtggttgattgagatcggcgataatgtcaggattacatctggtgttagatttgtgactcatgacggtggcgtgtgggtattgcgtcataagtatcctgagttatccgatatcgatctctttgggaaaattcgaatcggcaataacgtgcatattggttttaatgccattattatgccgggggtaacaatcggagataattgcattatcggatgcggcactattgttacgcatgatattcctgcaaattccatcgtagtgggtgtgccgggtagggtgatcgagtccgttggtgaatatgcggctaaacatgatgatgattttatgcatactaaaaagatggctactgatgagaaaaaagctttcgtacttggccatctaagatgatgtgaatttttttaatgagattgttcttggaactggccgaagcaatatagcattatgcttcggccaaggttctagatgcttactttcgaataaacattcctgaacgttccatctctgtaagggattgttcgtaacgactgttgtcggtttcttgtcccagcacccattcgcaaaactcggtcaaaccttcctgcagggaaatcgacggagtgaaatcaagcagctttcgtgccttttgggtatcagcgacattatgtgcgatgtctccgatacggaaatcaccggtaacgttcagattgctggtactgccatagattcgtttcaatgtctcagctatttcgatgacacttgttccgattccgctgcccaggttgatgatttctccgttcgatgcggccgtattgatagatttgatgaccgcggaagcaacatcctttacgtggatgaagtcgcggctttccttgccgtcttcaaagatattgatgtctttattgtccaaaagcaatgaggagaagatggaaagaatgccagtgtaaggattcttcaatgattggcctgctccgtacacattttggaaacggaagatggtgtaatcaatatccatcgcagggcacattgtctgaatcatcatctcttgtgaaagcttggtgaacgcataaagagaatttggggtggttttgctgtcttcggtggtgggcattaaggtcaaggcggtattgcacttgtcgcaatgcatagtgaaatcgccttgcatcatatctttagttttgcgtccacgggggtagactacgccacagtttgggcattgatactcgccttcgccatacacagaacgcgatgacgacaggatgactttgcgtatagtgttgctttcccccttgagcgatagtgcttgaaaaatatttgacaaacccatgacattgacctcgttgtactggttgatcatgtacatggattgcccggtaccggtttctgccgcaagatgcaaaacaacatctaccccttcaagggctttctggactgttgtgaaatcacgcacgtctccacggatgaaatcacaacaatcttttatggattggaaaagatatgacttttcaggattgttgccatgaatttgtttggtcaatgcatctagaacgcgaatttcgtattcatcatgagcgctcagttgttttacgatctcgctaccaataaaacctgcgccgcctgttaccagaatcttcgctgtcatatgtcttgaaccgttcttttgtagaaacttgccctagaaggagagtatgctttcagtgtagttcaaactatctcatttgatattaagcaatataacccctctaccaatctttgggaatctatcagaacaaacaacgaggtcgatagagctgcttcgaaaacgatgtgaattcgattggttttgtcgtaagcctttatgcccatcaagagaattcaacagactgttcccttacgtatattggattggcaacggtgtgttggactgtttctagagggtttttccttgttgtgtgaactccacggggctcaggtacccgagggtcgagtggagccgttggtggttgtaccaccacacgtaccggttgacgtccgagcgtggttgctccacgttcgtgtagacgttcctgtggatgagttccttcctgacgagccggttggtggattcgaccaccgcgctgtcgtacgggttgcccggcctggaaagggaacgcgtgacgccgaacacgtcgagcacgcgttcgacgcgttccccggcgaacccgccgccgcggtccgtgtggaacacctcgatctcatccagcgggaagcgcagcgcggcgaacgcggccaacacgagatcggcgtcgtgcccgacgccgaccgaatggccggcgatctgccggttggccaggtcgccgggcaggcagacgtacgcccacgaactgccgaccctcacgtaggccgggtcggaggccagatgggtgcgcggcgcatagccattgaactcgcgggcgaggatgtcgggagccgggtcgtcgtccggcctggccgggcgtggcctataggcggccttggaacaggagccggccatgccgttccccttcatgatccggttgacgcggcggcgggacagcgtcacgccctcgtgccccagggcgtgcctgatcttcctggccccgtacaccttgccgctgtccctccacacgcgctccacatccttctcgtaagggtcggcgcgctcggcctcggggtgttcgagcacccagtagcaggtcgacttggcaacgcccaggatcccgcactgcgccgataccgggcagcggccggcgtcggaccgtatcacgcctgctttcgtgcgaataccggcgccgcttgttctgaaacatcgacctccatctccagctgcctgtcgcgtttccgcaattcgatcagctcgttctcctcgggagtgcggttgtcggccgctttcgtggagccgctgttacgtatcccctgcacccaacgccgcagcgtggaacgcgggatgccgtactccgccctgatctgcgacgacggcttgccgttcccgttacgactgcacgatctgcctcttgaactcctcctcgtaatgacggggacgattcggatcggccatgatgatcaactccttcgttgtcatgtcccgcatgaaccagtccgatacattgtagccaatccagtcgtcgctcacatggaagacatccacacgctcacacggcccactttctattgaatagacacactccaaggaaggattcaccgacaacatgaaacgtctggccgaagaggacgatgccgtccgactcgtctcgttcgatgatgaagcctatgttcggtttaccgtaacccgaggagggtgtttccgcggggtgcccccctccttgtaggatatgggggtatggctgatgaagttttctctccgaagaacgttattgtgaccggtggctgtggttttatcggttcaaatttcgtgcattacgtgtatgaccatcatcctgatgtgcatgtgacggtcctggatgcgttgacgtatgcgggcaacctggagaacatcaggggcatcctgggcgaccgcgtggagttcgtgcacggcaacatctgcgacgcggaactgctcgacaagttggttcctggtcatgatgcgatcgtgcattacgcggcggagtcgcataacgacaactcgatcgcgaatccggagccgttcctgaagaccaacgtggagggcacgttccgcctgttggaggcggcccgcaagtacgatgtgcgctaccatcacgtgagcacggacgaggtgtacggcgacctggccctggacgatccggccaagttcacggaggagaccccgtatcatccctcgagcccgtacagctcgacgaaggcgagctcggacctgctggtgcgtgcctggcaccgcacgttcggcatccgcgccacgatctcgaactgctcgaacaactacggcccgtaccagcatgtggagaagttcattccccgtcagatcacgaacatcctcgaggggctgaagccgaagctgtacggcaacggggagaacgtgcgtgactggatccacacggacgaccattcgacgggcgtgtgggcgatcctgacgaagggccgtatcggcgagacgtacctgatcggcgcggacggcgaacgcaacaacatcaccgtgctgcgtgacatcctgaccgtgatgggcaagtcacccgatgatttcgattgggtgaaggaccgtccgggtcatgaccgccgttacgcgatcgattcgacgaagctcaggaccgaactgggttgggagccgacgcatacggacttccagaagggcctggagcgcacgatcgagtggtatacggagaaccgcgcgtggtgggagcccgcgaaggccgccaccgaggccaagtacaagcagcagggacagtgatcgggtatggcgtttgatttcgagaaggagctgaaggtcacggagacgaacatcccggggcttttggtgttcgatctgccggttcatggcgataaccgcggctggttcaaggagaactggcagcgtgcgaagatgatgggtctgggtctgccggatttcggcccggtgcagaacaacatcagcttcaacgcgacgaagggcgtgacgcgcggcatccacgcggagccatgggacaagtacatcagcatcgcgaccggtgagatattcggcgcgtgggtcgatttgcgtccgggcgagagcttcggccaggtgtacacgacccgtttggacccgtccaaggcaatctacgtgcctcgcggcgtgggcaacagcttccaggccttgcaggacgggaccgtgtacacgtatctggtgaacgcgcactggagtctggaacagaagaagacgtacacgttcgtgaacctcgcggacccggagctgggcatcgagtggccgattccgttggaggagtccgaacgctccgaggcggacctgcatcacccgatgctcaaggacgccaagccgatggagccgaagcgcacgctggtgacgggctgcaacggccagttgggccgtgcggtccgcgcgtacgcggaggcgcatggtctgcgtggtttcgaatacacggacatcaacgagttcgacttctccgatccggccgcgtacgacgagtacgattggagcctgtacggcacgatcatcaacgccgaggaactatccgcggacaagtgcgaaatcggggagaaccatgctcgggcatggaccatcaacgcccaagggcccgcgctgttgtctcgtgcggcgaaggatcatcacgtcacattggtgcatgcgagcaccgataaggtttacggagccgattcggaagccaaagcgatcgccccggagagcgtctacgggcagacgaaggctgcgggcgacatcgcggtggcgaatgcgccggaacactacatcctgcgacgctcggaatccgccgattcccggaacatcgtggacacgctgttccagctgctcgattctcacgccgaatacggcgtctatgccgtcggtgactgactggacagcccggaaacatcaggaccaaggaaggacaagcgtatgaagggcatcattctcgccggaggttccggcacccgcctttacccgctgaccaccgtcacgtcgaagcagttgctgccggtgtatgacaagccgatgatctactatccgctcagcgtgctcatgcttgcgggcatccgtgacatcctgatcatctccacgccgaaggacctgccgaacttcgaaaagctcctcggcgacggttcgcattacggcgtgcatttttcctataaggtgcagcccagcccggatggtttggcgcaggcattcctcttgggagaggagttcatcgacggcgagccgtgcgcgctcgtgctgggcgacaacatcttctacggtaacggtctgggcgccacattgcgcaaggccgtcgctaaggccgaaggcggcgagggcgcaagtgtgttcggctactatgtcgacgatccggaacgctatggtgtggtcgagttcgacgagcataaaaaggccgtctccatcgaggagaagccgaaggagccgaagtcgcattacgcggtgacgggtctgtacttctatgacgagcgtgtggtcgagttcgccaagcgggtcaggccgtcggctcgtggcgaactggagatcacggacctgaacaagatgtatttggaggacggctccctgaacgtgcgaacgctgggtcgtggttacgcatggctggatacgggtaccatggattccctgtacgaggcgggcgagttcgtgcgcaccgtgcagcgcgcccagggcctgcccatcgccatcgtggaggaaatcgcctacgaaaatgggtggatttccaaggaggagctcctcgaatcggccgaacgttacggcaagagcccctacggcaagcatctcaaggatgtggccgaaggcaaagtcgtgattgttcctaacgactgatcgactcggacgaatgcggaaacgccatagtattttgagattaatgctgagtgcgatagcagattacgcatttgccgatgtatatgacgacattgttcatcaatagtaaaagggggctgctgcattgcagtatgcagcagcccattaccatgtttggtaggccctgaccatcgaggcctaccaaacatggtaatgggcggacggaaagttggacgttttggcgtccggattggagtccgcatgttttcgatagaggatcggcgcagggccgttgacctgtatttcacggagggcatgaccatcaggaaggtcgtcgccaagctcggctacccgtccgagggcgcgctggcgaaatgggttcgcgaggacccgcgctgcacggttcctttggccttccataagttctaggtaaaaatatacacttatatacacatatatacatgaatatgtgagttcaagcgaactgatgctacgccggctcgtccccgtccccatcaaacttgtgctcatcctcgtaggcaacgatgtccatatcgcctcgatggagtttcttgagtgtttcagccactcgcgcctgctcatcatcaacaacagggcgctcgccggctaagcatgtgagaccatcggacactgcggaaaaacactgccgaacccgcccaacaaacattgaagcaatacttttttatttgcttcgttactgcgtattctgtacttcacatgtgcgaaacgttggaattccgccaaaattttatttgcctggtatttgcttgggtgggtcgcaaagcgcggttgcggcacgattcttagtggtggtgccttatggcgtcgggctttccttgcaaatcgaggtaaggaaactggcccttaacccggaatttgaaaaagtaaaaggtccctggctgttcaccagccagagacctttttggtaacaactgaggttgaggaaacctcggcagttgggtccaacggggcgaaagtctgtggcgccgccgagaagattgccccgaagctagcgcgacctttctgctacaacacagcataccagcatccatcgaaccttatcttttacgggttccggcccctcgtcttcaatcagggcaccatttcaaggcagaagaatcaggcggcctttttgcggccgcggcgcttcatggtgccagcggtggcattggccacatcgaaaatcacggtcttgctttcggggtaggcggtaccgttgacggactggtaggcgatttcgccttccggagcctcgggcagagtgaagtatgccttcactgcttcaatgagcgtggcttccttgacgcttaccgaagcagcctgcttgccttcggtcttgctgaacttaatggcgttgtcggccttggcggtggtcggggtcacggcgatctgcctggtcttgtcgttaatcagcaccttgacgtacgccgggaatccgagcacttcagcggtggctttgttgaaacgaatggcggaatcggtgacggtcagaacggtcttgcccaccggcttgaccagctgaacctcttcgaatccctgaagcaatgaagccataattgctctccttattgcattggtaacgtgtttttatttacgccactaattgtaaccagctaatttcgcattatacaaaccatatgcatgcatgattgcataattgaagaacatttgacctacgtattgcgctccccgaatagcattgatttaaccaataccaagaaaagaggaaacaagaacccgcaatatcagccgtattgaatatagaaatatgcaatttcaacatcgcaataactgacggtctttttgctggctctattcgccgatatcgcattcaggccacagcgccgagcataatatcgacgccgtgcttgatttccgcatacacgcgttcaaacacctcgcgtgattgacgatgagggtcttcggtttcgagtgccgtaggcaaaaacggccgcagcataggtacgcaatccatgatttcgatgagcctgtctgcggcggtatcgccggcaatcggaccctcggcatgcatatgtttgcaagcgttcacgaagtcattgaacagaaatactttgcgaatagccagtggattctgttcaagcaaatcggaaatttgctcacgctcaaaacacagaatcaggtcggcttgccggctgatatcggtggtgagaggggtggaagaatgggaattcgcgtcaatgccgtcgttcttcagcaaatcgataaccatcggatcagcgggatgcgggggatagtgcagagtacccgcgctgcgcacggtgatattgccgctctgcaagccaattcctcggtcggcaagcttggctcgggtgtagtattcggccatcacggaacggcattgattgccggtgcatacatacatgatttgcataacaacgtcccttctcaagtgttgtgagcattccctcatatattccagtgagcattcctcgcgaatatgcgtgcgttatgtaccgtagcaataacatgaaaaaaccgggaatcatcgactcccggttcagtggtattcgcgaactatgcttcagcgtctactgtttattatgtcagtcacgtcagcgacgagtggtgttcttgcggacggcgaacagggcgatgcccgcggcggcaagcagcacaacggccacaccgtacggtgcgatggccgcaccggtgttggcggtggtagcagtcgtggtaccggactggtcaccggttccggttgccggaacctgaatggtggcggtcttggtaccggatacagcgccaacagccttgaccgcgatggtcttgccagcttggctggccttgaacgtgtacagcaaagtcaaggaaccatctgccttggcagtgaacgtcttggatacttcagcgatcggctggacgtcggcgacgatggcatcatcgtagtacacggtgacggattcgttcggttggaatgtgcctgcagggaacgtcacggtagcggtggtgccgccgtaagtaaccgttgcaccgtaatcatcagccatagcggtattcgttgcaaaaccaaagcccagaactgcggcgataacggccagcacggccataatcttcttcttcataacttcgaacctccacaatagaaccggttactaccgataaaaaatcggttcttatcaatagaaaatcggtcttttttcaattacagcccccaaccatacacccccctttgccggtatataaggggtaattatgttaacgggtaagggggtgtgacaacgtggtcacaccatgtgacaacgttcgaacatattgtcgccgcattaccgttgcggcggggtctcctgacattctgaaaacgttgctattccaacgattgcgctgattggcgatacgtgcatggtaaacaacatgggaaatttttctgcgacacgccgacgggctactcggattctgattcgtactcgtcgtcaaaactgaacaggtcctctacggtggtgccgaacacccgcgccaaatccatggccaggcgcaatgatgggcagtattgcccctgttccagccttcctatggtctcacgtcgcacgttgaccagatcggcgaggtcggattgcttcataccgcgttggagccggtgaagtttcagactagtcttcatcgtcgcctccggtgccggtatcgtgttccagccatagatatcgaatatcggaaatggccagggcgcacatggccaatgcgggcagtagcattggcggaataatgtgaactatcgagcggtcaatcagattcagtgtggtgtagatgaaaccgacaattaccagaatgcccaccaaactgaccagcgcgaattgcatggccgcgctttgatgcatatcggaaagctcgtcgcgtcgcgggttctgccgtcggaatgcagtcatgccccatacttcgccgccgatccacaacagcgccgcgatcgctgccacgattactctgagcaggttattgccaataagagccatcagcatgcaggcaatggcacctatggattcaaggatggcacgaaagcaaatataccgattaaaagtcatggccgtctccgtgaattatgcgagcgatattgaattgcatacgcaattataaagttaggggggtaaccccttgtgtggtggttagaccaaccggcggaggctctttgcgtagaccgagaataatcgcaatcagtaattgttatgggcgatccagtagttgtacgctgcgacgatgccgccgtagcgctgctcgcagtagctgatgaaccacttgaactgggtcttgtagttggtctgccagtccgcgccgaaggaagccatcttgctaccggggtaggcctgacccaagccataagcaccagacgtggggttggtggcggtggggctccaaccggactcgtggttgatgatgtagttcgcagcggtgaagtccgcttcgctatacccgttgtccaacagatactgatgcgcccaggactgcacttctccagccggaacagtggtgccgagatcggccgacgatgatgacgacgtcgacggcgactcggtggaaccagtgcccaccaggatcaccttatccaccggggccttcttgacccatgaggcgaatacgttggaagagatgaccttgtcgccggctcgcttgaccagcgaggtggtctccataatgcccttctggccctcggtctcgaccttttcctgacccttgggcaggctgctggtctccttgcgtacttcattgaaggcgatctcggtatcgttggtctccacatcggcatccgcgcgattaatggtgaccacggtggcctcggtgaccttggatttcagcgagggagatacggcatcatccgggtcaagcgtgatatcacccgtctccagcacgtccttgacggtggtcatgttggctttttcgccaagtactacgcgcgaatcgccattaatcttcaccgtaacgaacgtggtgttcttgtcggcgctgttgattgcgccacgagtggcagaacgggatgcggccgaatcggtggcggagaacgaagtgatggtggaaatcggcttcacatcatcagcatggtagaaactgcgcgacaccaatcccgccgcgccgagcagacctgccgcggccaccacagccgcgatcttcatccactggcgcttgttcaacggtctgagcatacgggtcggcttggcatgtctcgtcattgcgctccttgatcggatttcacactgaccaccatgataggcggcgcagtggatgaaggaaaatcaggctcaggcctgctggtcggcaccggactgggcggccttggcggcggccagatcgagtgccttggcctgggcgatcagatcgtcgagatcggcggcctgcagcgcgccggcctgctggaagatgacctcgccctgcttggcgatcatcagcgtgggcaccgcctggatgccggcggcctgggccagatcctggttggcgtcgatatccaccttgacgaaggcgatgttcgcgttctccggctcgttggaggccgcctcgaaaatcgggccgaacgcgcggcacgggccgcaccatgtggcccagaagtcaacgaacacgatctcgttgtcggtgatggtcttctcgaaatcggcagaggtgatagcggtggttgccatgatgttcccttcttctgtgttttccttggcatcgccgtacggccctcatgcgtggccgccgggcgattgccttattcatgcaatacgtcttggcgcttggagccgtgcggttcgtggccgtcggctccctgctggctaccagcttcccagcaccacccaacatttgtgtcgtattttccgccgccggccaaacgtttcccaagatttcgccgtaaggtgacgcgtggcgtgattttgcgcgcaataatgggatgcatgccagtcatgaatgatgaagtgcccgacgagggcgattatgatgccggccgtggccgcggcgaattcgacaacatcacgcccgaggacttcatccacggaggcggttccggccacggcaacccgccgggctggctgggaccggccgacatcaaccgggcgcgccatcagatgcccatcgcatacgtggagatcgtgcccgtacgcaccgatgagatgggccgcatctcccaggtgggctcgctgctgcgcgtatccgatgacgggtcgatcgaacgcacgctgatcaccggccgtgtgctgtaccacgagacgttgcgcgaggccatcgcccgcaatgtggccaaggatttgggcgatatcgccttgccgctgctgccgatcgggctccagccgttcaccgtggccgaattcttccccacgccgggactaagcgaatactacgatccgcgccagcacgccatcgcactgtgctacgtggtgcctatcgccggcgactgtaagccgcaggatgagacgctggatgtggaatgggtggatcccaagagcgacgtaatggacacgttcgtggcgcagatggtcaacggccatgggcgcatcgtgcgacaggcgttggcctgggccggaatctgacagttgttttgccttccgttggaggggatggcgcgtagcgacggagggcggtccgcgttgagaccgctcccagccgactgtgccgacagctccgccagtggggcgcgaatgtgaaggagtaattcatggcaatcgaattggccaatcatatctaccgcgacggcgaaggcgtgccggtggtgctgatgaacgcctacccggtggaccaccgcatgtgggacgtgtgcgcgaaggcgctcgccgacttcgccgacctgaacgacgtgccggacttcccgatctgggctccggacatggccggctccggcgcatccccggtgccgagcgacgccgattcgggcccccgcatggcgaacggcgcgtacagcgaggcgttggatcgcctggccggagcctacgtggacctgatcaaggccgccggctatgagcaggcgatttgggtcgggctgtcgatgggcggctacgtggcgatggacatccagcgcctgtaccccgaaacggtggccggactggccttgtgcgacacgatggccgcgtccgacggcgtgggcggagagaaccgactgaagatggcggacgccgccgaacagacgaactcggtcgaaccggtgatgcacttcgcgcagccggccgatggcgattccaccgtcaagaagactcctgaattcatcgcgaccatgaccggctggatcaacgaacagaacccggctggtctggcctggcgtcagcgcatgacctacggacgtcctgaactgggggcggtgccggaaacgatcagcgcaccgagcctggtggtatccggcgaactggacccctccagcaatccgagtgtgatgcggccgctcgccgaacgaatcaccggcgctgaattcatcgatattccggactgcggccatttcagtgccgtcgaacatccggataccgtggcgcgagcactgctctcgctcgtcaagcgcgtgcagagcgcgcagaagaacgcataggagacctcgatgaccgctgacattcatttctcgcctctggcactgacccatgcgctgccgttcctgccgctcgcacaaggcgacatcgactatcaggtggaccggcgaagcgaacccggcctgatcgacgagctgctggccgagccgaccaccaaagtcgtgcttacgcgcggcggacttgtcgccgtaccgcgcggccaaggcgagcttgtggactatgagaacgtgaaaatgcggctcgccacgttgccgggcgcctatgtgtccgccgaactggcacgctaccccgaagcggtcgccatgttccttggctcctatgtcggggcgcgcggcgaatccgtggtcgccgtggatatcacgcgcgtgccggaagccggcgttcccggtgttggcgggattgccggtgttggcggtgccgtcggcggcgtgctcggcacccaggattccggcactgtggacggcgcgctgggcaagaacggcatcagcggaggtgctgccgccggaatacggcagccgggaaacgccaagggtaatggcggcgtagccgcagccaaaatcgccgggccgctcggtgtaccggattcggccgggcaaggtgcggacgatgccttcgatgattcggtcggcgcgcccgtacagcccttggccccgaagcccacgctgctgcaacaggccgtgacccggttcgactgggtggacctgcgcggatttgcccctcactccaacgcgcgcgaggccgggcaagccaccagtgccatcaccttaagcatctggcacagccgccagcggttctgtcccacctgtggcgcggcggtccggccggcgctcgccggatgggcgcagcgatgcaccaacgaggcggacggcaaccgtgtgctgttcccacgcgtggagccggcggtcattaccgccatcgtggacgggcacgaccgtctgctgctgcaacacaacgcggcatggaaggattcgaggctgtattcggtgtccgccggatttgtggaggcgggggagaaccttgaacacgcctgccgccgcgaggccatggaagagaccggcatcaagcttggcgaggtgcggtacctgggttcgcagccgtggccgttcccggcttcgctgatgatggcgttcaaggcacatgcgatcaccaccgacgtgcgtgtggacggcgaggagaccatgaccgcgcgatgggtcacacgcgacgaatacacggccgagctcatcgccggccgtatggcggcgccgggccgcgccaccatcgcccgctacatgattgaggaatggctcggtcgcgagctgtgacggaccgcgaagataggttaggcttatgactatgagtgatgacaacgaaaacgaacagccgctgaatctcgacattcccgaccacctcgaatactccgcggaacatgcatgggtggaccgttcggtcgaccccgcaatcatcggcattaccgaatacgccgccgaccagcttggcgaacttgtgttcgtggatctgcctgagcctggcgcccgtgtggaggccggcgacgagatcgtggagcttgaatcctccaaggccgtccagccgctgatcagccccgtggcgggtacggtcaagtatgtgaaccgtgacgtggcggacgacccgtccgtggtcaacggcgatccttacggcgaaggctggctgctgaaggtcgagcttgacgacgatgagccggagctgttgagcgccgacgaatacgcgaaggtcgtgcggtagttctacccatggctcccctcagagaggggagccaagaaaaatgaggcgtatggcctatattggtgtctatgagaagcccacgcgaggattttgaggcggcaggcaagcgactgccttgggatgctgctgctcgcaatgcagcgctgtccgccaccgcgccagtctctgacgtcaaggcatccgccaatggtgccgacaatgccagcaacgctgaacattccgatgacatgcccaccgtgccgattcccgcacgcaaggctgccacgacgttcgacaccccctccaagcgtgagcgcatcgaggtcaagccgccgattacccgattcatacgtcgtgccgtcacccgcgtgttcggcgtatggtcacgcatctccactcaggtggtgcgccaatgggactggtatccgcgagtggaaccctatgtgggttatggtaccggcgattactcgcgtctgatctgccgcacggtatacgcccccaggcacgcgcaatccggcgaactgatccgcggcatccgcggcatgcttgccatacccgcgccgcgcacccacgtgcaggccagcattgatgacatgccgctcaacaccgtgcagatcggcgtctccgaggtctatgacaaggtggaccgcacgcgcgatctcggcagcgaatacgccatctccgattccgccggatacctcgacctcgtggccgagcatcgtctggtgcccggcatccatcgcgtctcctacagcgtggccaaccgcaaacccgtgagcgccaacctgtacaccatccccgccagtgccaaagtcggcatcatctccgatgtggacgacaccatcatgatcacgcaggccccggtgccatggaaggccgcgtacaacctgctgttcctcgaccccaagaagaaagcctccgtgccgggcatgagcgtgctgttcacccgcatcgccgacctgttccccggcgcaccgttcttctatctttcgacatcgccctggaatgtggagagttcgattcgcaacttcatcactgaccatggttttcccgaaggcccgctgctgctgcgcgacctcgacccgaggcccaagaccttcgtacccaccggcccccagcacaaacttgagtttgccgaacaacttatggccgacttcccagacatgaagttcattctggtgggcgatgacgggcagaaagacccgaccacgtacgccaccatcgcccgcagatatcccggacgtgtactggcgatcgtcattcgtgagttgagcccgcgcgaatcaaccggattggcgtcggtgacgggactcacctcgacccagccgactccggtaaccgatgtgccagtattcaccggcaccaccggctcgaacattctgaagaccatgctgccgtatctgaagacggtgttgcgataggcgcggcgtgatgaacactgaatgcgtccccggtgcggtgcctcgcctataatcgcgtggtatgactgacgagagcacaaacgccgcggccgcgatgccgccttacgccaagcgcgagccgaagcgccgcgaattccacggtgacgttttcgaagacgattacgagtggatgcgagacaaagactccgatgatgtgcgcagctacgtagctgccgaaaaccagtactgcgagcgtcgcatggcgcatctggcggatttccggcatacgttgtttgaagagctgaaatcgcatgtggaagagactgatatgtcggttcccacgcgcgtcaatgattactggtacttcacccgcacgcagcagggcaaacagtatggcgtgcaatgccgcatccccgtgcgcgatgccgatgactgggacccgccggtcgtggatccgcaaggcgcgcccggctccatgcccggtgaacaggtcgtttttgatgcgaacaaggaatccgagggacatgacttcttccggctcggcggcttggatctgagcaaggacggccgttggatgctgtacggcgtggatgttgcgggagacgaacgatatgatttccgcattcgcgaccttgccgggctggagaccggggagccggtcagcgaactgcccgaacagttcaccggcattggcagcgcatgcttcacgccggacggccaatgggtgttctgggtggaattggacgattcctggcggccgctcgctgtgtggcggcatcgtgttggcacggcggtcgaatcggatgtgtgcgtgtaccgagaaaccgatgaacggttctgggtgggcgttggcatcagttttgatgagcgcaatatcgtgatcggcaccggttccaaaaccaccaccgaagtgctgatgctgccggtggccacgcctgaaggcgaattccaagctttcattccgcgtcagaacgatattgaatatgatgtgagctttgcctgttttgaaggcgcgggggagaacggtgcggatgtgccactcgccgtggtctatcacaacgccgccaatccgaatttcgaaatcgacgtcattgacatgcgtggccatgagccgccgtaccgactcggcgaaggcgtgtgcattgccgccgggtcgccgtacggctgtgaacatggtgagccggataagccgattaccgaggcatacttcaacgccgtcaatccggcgatattgcagggtgcccacggtctgggcatcgaaggcatcgcgttgcatcgcaactttgtgtccctgagctaccgtgccgacggccagccgcacgtggcatacatgaccaagagcgcggctgccgccgacttcctggccggacggccgtggcggtttacggaattgctgccgcctgccctggaggacgactgggacatggttgccgacgatcgcgaaaacttcaccggcgatcatggcgaaatcttgtggaccgaagatgaggcccccacggatcacacgtcatcttccgatggtgctagcgacgaccacctgcccggtgagacccggcgcttgtacaccatcggcgtcggcggcaacccctcgtatgaggcgccgcgcatgcgctactcgttcgccagctacacccgcccgggcgagttgcacgaaatcgatcccgccaccggtgaagatgcgctgctgaagcgagccaccgtgttgggcaacttcaatccacgcgattacatggaacgccgtgtgtggattaccgcgcgcgacggcgaacgcattcctgtttccctcgtctggcatcgcgattgcccggcgcaggattcgccgatgttcattaccggatatggtgcatacgagatttcctccgatccggggttctcggtctctcgtctgagcatgttggatcgcggtgtgctgtacgccgtgccgcatattcgtggcggcggcgaaatgggacgcgcctggtatgagcaggggcgcagactgaacaagaagcattcctttgaggacttcgtggacgccacacgcgcgctgcagaaggcgcatttggctgatgcttggcgcaccgtggccaacggcggatccgctggcggtctgctgatgggcgcgattgccaatatggcgcccgaatgctacgccggtgttgaggcggatgtgccgttcgtggacgcgttgacctccattcttgacccggacttgccgttgaccgtcaccgaatgggacgaatggggagacccgttgcatgaccctgaggtgtatcagtatatgaagtcgtacacgccatacgagaatgtgccggtcgccgtgctcgagggcggcaacgacgaggctgccggtgacggcagtgctgatggggctgccaccggcgcggtcgccgccgcgcaattcccgagaatcttcattaccacctcgatgaacgacacccgcgtgctgtacgtcgagccgctcaaatggctggcccgtttgcagtccgccggcgtggacgcggtggccaagattgaggtcgaggccggtcacggcggtctatccgggcgttacaagcaatgggaagaggtttcctatgagaacgcttggtgcatggatgtgatggggctcgctcattaggccatgtccactagctgagcgggttcgggccggcaggtgatagcgcgagtaggctccttgaactatggcaaagacatataaaatcgccgttattcccggcgacggtattggcaaggaagtcactccgtgggctcagaaggctttggaaaaggccgctgaaggcgtagctgacttcgagtacgagaacttcgacttgggtgccgagcgctatctgcgcgatggtgcgatcctacccgaggacgaagaggagcgcatcaaggccaacgacgcgattctgctcggtgccgtgggcgatccgcgcatcaaggccggcattctggaacgcggcctgctgctcaagctccgcttcgacctcgaccagtacgtgaacctgcgcccctccaagctgtacaagggcgtcacctcgccgctcgccaaccccggcgacatcgacttcgtggtggtacgtgaaggcaccgaaggtctgtactgcggtgccggcggcgcggtgcgccgcaacaccccgcaggaggtggccaccgaggtgtccatcaacaccgcatacggtgtggagcgtgtggtgcgttacgccttcaagctcgctatgaagcgcaagaagcacgtcaccctggtgcacaagaagaacgtgctcgtcaacgccggtgatatgtggcagcgcatcgtcgacaaggtcggcgaggaataccctgaggtcacccacgactaccagcacattgatgcggccaccatcttcctggtctccgacccgagccgtttcgatgtgattctcaccgacaacctctttggcgacattctgaccgatgaggccggctccgtggtgggcggcgtgggctactccgcctccggctgcatcaacgcctccgacgagttcccgtccatgttcgagccgattcacggttccgctccggacatcgccggtcagaacaaggccaacccgaccgccgccatcctctccgccgccatgctgctcgaacatctcggctttgatgatgcggccaagaagatccataccgccgtcgaagcggacatcgaggagctcggctccaccgtgcgctccaccgaccaggtcggcaaggacattctggcccgcatgtgacctcaaacttggctcccctcgctgaggggagccagaaaactctctatactgagttgcatgcaaatgcgacatggggaatgcaaaaccgttggcagcaaactagtcgccgtgaccgtatccgtcgatgatgacggcaccgcacagtcatgccatatcagcggtgatttctttattgaatcagtttcggatgccgaatctcatgctttgttgcatgacctggaacgagctctaattagcgatgattcattgcggtccgtattggacgcccatcctagttgccaaattatcggcacagatgaaattgccatcaaaaccgcatacagccgagccgtaagcagcaacttacccccgctggcgggggctccagcgcagcgggtgggggtgggcagccccgatgcgccgaacatcccagcatccatcaatacacaaaccaagcagcccgacaaaagctctgaataccgggagcgctggaacgccctcaagcctcaactcaccgtgatccacggccatccgcgtactccggacgagcaaatggccattgacgagacctgggcgcgtgaagtcgcagcaggaacacgacagccgaccatccgattatgggagtgggcgggcccggctgtggtcatcggccgtttccaatcggcccaggacgaggtgaatctggacattgccaagcagctcggcttcgacgtggtacgccgttgcacgggcggcggagcgatgtttatcgaaccgggcaacaccattacctattctctgtatgcgccgctcgatttcgttcagggcgtaagcatcgaagaatcctaccggctttgtgactggtggctggtcgaggcgctgcgcgaacttggtttagatgtgcggttcgcgggcctcaatgatatcgcctcgcagtacggcaagatcgggggagcggcgcagcggcgcttccccgtaggctcaggcggcgcggtgctgcaccatgtgaccatggcatatgacatcgatgcggccaagatgagccgtgtgctcaacaccagtcgcgagaagatgtcagacaaagcggtgaaatcagcggtcaaacgcgtggacccgatgaaaagccagacgggtctcagccgcgaacacatcgtcgagcaccttattgactggtttgcggcgtgatttcaccgatggccgtatacgattttgccgctggccgtgcgcggttttgtcatgggcgagcgcggtagccgcgacagtgccgtttttcgcggtaacgcattcgtcagcatgtcgtacggctatcggatcgtgccacacatgaagtgacgaatgagggcatgctcctgacgaaacctgtggggcgcgttacaatatgacggatgggcgacgacggtcataggacaataaggatggtgcgatgagcttggaaacgccaaacgtttttgctgacgaggagaacatcctgttgcatacggcattgttcaagcaggtatcgccagccgaagccgaggagctgttgccgcatttgaagcatgcgacgttcgataaaggcgactatatcttctccgaaggcgataccgatcagcgcatgtatttactggagcaggggcgcgtcaagctgattcgcacttcttccgatgaccgcgtgcagctgctgtccatccacgcgccgggcgaagtgcttggcgagattccggtattcgaccctcatggtggcccgcgcaccgcgtccgcggtgtccatgagccatggcacgcgcgtggtctggctggagcatgatgccctgttcgcatggcttgatgagcatccgcgtgtggccatcgacatgttgcaggtcatggccagccgccagcgcggcaacaacgaacgcatctccgacttggtattcatggatgtgccggcgcgtctggccaagacattgctcaacttgggctcacgtttcggcgagccggtggaacagggcctcaaagtgccgcatgacctgactcaggaagagctggcccaactggtgggctccagtcgtgagaccgtgaacaaggcgttgatggacttttccaaccgcggatggatcgcacgtgacggccgatcgatcatcatcttccagcccggtatgctgattcgacgctcgcggcgctgaccgttcggctgacttccagccaatgttacgctagtgcgattcttgtgatgatatgttcacgggagctgaccgtaagcccggttggtagggcaccccatttagaatggggcccatgcccaaaaagaagtccctcactctccaacgtgtgcttgttctcctcttggcctatatcatgcttgccgtctgcggcggcgtggcggccagcgtgttgtttgtaccgggtgtgatcggtgccaataaagccgccaaagcggtgattccgtcgctcaaggtagaaaacgtggacttcgacgtgactagtctgccccagaagtcgacgatgtacgcgcgagacggttccaccgttatcgcgacgttctacaaccaaaaccgtatcgtcgtgccgctgaagaagatttccaaaaccatgcagcaggcagtggtggcgcgcgaagaccgtcgattctggactcacgccggcgtcgacgtgcaaggcgtgatgcgtgcgttcgtgcagacctacctcgtcaaaggctcccagcagggtggttcgtcgctgacccagcagtacgtcaagaacgtgctgctgatgcaggcgatcgaggatgacgattcgatcgcccagtaccatgccactgaagacaccatcgcccgtaagattcgcgagatgctgatttccgtgcagatggaaaagaagtattccaaggccgagattctgcagggctatttgaacatcgcccagttcggcaacaacctgtatggcgtggaaaccgcggcccagcgctacttcagcgtgtccgccgccgatttgaacgtggtgcagtccgccaccatcgcggctatcaccaagaacccaagcctgtatgatccgctggtcgaagagaaccagaaggaaagcgaaaaccaacgcaatatcgtgctcaagctgatgctgcaggaaggatacatcacccagaagcagtacaccgaagctgtgaacacgccgttgaaggacacgctgaaagcacaggacgtgaatgtcggctgtcaggacaccggcgattacgcgtacttctgcgattttgtggtgcatcgcatccagaactccgaagaattcggcaagactcgtgccgagcgtaacaagctgctgcaggagggtggcctgaaaatcgtcaccacgctggatgtggaagcgaattccacgatgatggagaccgcgcgtaataccattccaccggacgatcccagcggcatggagatagccatggccgcagtcaaaccgggaaccggcgaagtgctgagctttggcctgaatcgttactatgacgccactccggcagccgcgaacgatcccaccaagacgagccagaactatgccgtcgatttggcggatggcggtggttctggttggaccatcggttcgtcctggaagccgatcaacctgattgcgtggatggaagcgggccattccatcaacgacaacctccagacctcgacgtcataccccactacggacttcgcctgcagtaactattcgggcggtgccgattcgtggaacgtgtcgaacgccatgggcgcaggtacagtgaacccagaaagcccattcctcggtctggtccgttcgcataacactactcaggcttccatgggtgccatcctcaaactgtgcaaggtggcggacaccgcgactgaactgggataccatgacgccgccacgggtgagaccatcgacaaaacccaggtgtatacaccatccatgatgatcggctcggtgaatgtgtccccgctgaccatggcgagcatcttcgccgtatacgcctcgaatggtgtgcaatgcaacccgattgccatcagcaaggtgaccgataaggacggcaacgatctcaaggttccatccgcgaactgccatcaggcggtggataaggacatcatccaaacactcgcttataccctgaaccaaggtacggtgcggccggatggtgccggttggtcattcagattggctgacgggcgtaagtcgtttggtaagaccggtaccagtgaggatcttgcggtgtccggtgggtcgttcattcctaatcagattgcggcgttcgctgtggtcggcgatgcacagaacccgtacaccaaccgtatttccaacattgccatcaacggccggtacaacagctattgggatggttcgacaatcgcggctccggccgttaccaacttcttcaatagctacatttccaagaagaaaataccgattgacaacgattacggccagcccgtctcgaagtacaccacgactggcaagtatctgggcattggcggacgaacgttcagcgtgccgcagaccactacgaatggcaacagccaatcgcagagcagcaacaatcagtctcagtcgcagaacactgggcaaaacaacacccaaacccagggcaccaattcagagcagtcgaatgatggccagtgattggtgattggcgtttgacatttggtgattgcatgccggctgagtctgcgtaacatggccgactgcgatacccaaattacgtagtttgcgggcgttacctgtttcaggtgacgcccgttttacaatacttaatgacaacgccatcgcgttcatcgaatatttgccatgaacgtgcatcggaaaggggaacgatgagcaacgacgatctgacgcatgagaattttgattttcgtggattcgacgtgccggatctcaaagcggtgacgctggcttcgtcttcggacggcgatcagtccaagcagccgaagaccaagcacgaggatgcatcgaagaaccgtaagcacggtaagaagaagtcaaaatccgatgcacggtccaagaagcgggccggcgcgggcaagacgagcgaatcgttcgatgattatgaggattatgaggaaagggaagctgtgagcaaggcagataagaaagtcagcaaggaccgtccggggctgtttgcgccaatgacgctgcgcgaggtgaccgtgcgtaatcgtatttggttgccgccgatgtgcacgtattcgtcgttcgcccgcgatggtaggcccacgccgttccactaccagcattacgtgtctcgcgcgttcggcggattcggcatggtgattgtcgaatccaccgccgtggctcctgaggggcgtatcacgccgtgcgatctgggcctgtgggaagacgggcagattgatgcttggcgctggatcgtggacggtattcgcgaggcgggtgcggtgcctgccatccagctcaaccatgcggggcgtaaggcttcgactggttgctttgccgttggttacgacggtcagagcgtgccggaggaggcgggcggctggcctaccatggcaccgtctgaaatcgcgttcggtgggttgcgtacgccgcgcgcgctgtccgtggatgagattcatggtctggtcggcgcgttcgccgcggcggcgggccgtgcggtggccgccggcttccaggcgattcagattcatgccgcgcatggctatctgatttctcagttccttgacccgctgagcaatgagcgtgatgacgaatatggtggcgatttgaccggtcgctctcggttcctggtcgaggttgtggatgccgtgcgtggggccgtccctgagggcgtgccggttctggtgcgcatttcggccacggattgggccgccggcggttgggatttggaccagaccatcgcactatccaaggtgctgaaggagcatggcgtcgatgtgatggacgtgtctaccggcggcatcatgtcgggagtgtcgattccggtcaagccgaactatcaggtgccgttctccgagcaggtcaaggccaaggccgatattccggtgaccgcggtgggtcttatcaccaagccgaagcaggcggccaagattctggcccatggcgaagccgatgccgtggagattggccgcgccgcattgcgcgatccgtactggccgttgcgtgcagccaacaagctgggcataccgtccaccgagatcccctacgccccgcaatacgtggccggtgcgtactaaatcctcatggggcggtaactttccatggggcggtaaaaccctcatggggcggtaacccaaaacggcggtattctgcggaatgtgaaatttggctaaccgccccatgggacaatcaccgccccatgagggttttaccgccccatgggtaatagggcaatatgtgagttcactccacgtctacgccgacggcgtcggagacgtgctcgaatccgtcgcggcgcagcagctgggccagaccgcgcttcaacacggtaatctgctgcgggcctcggtacatcagcgaactgatgaacatgaccaagctggagccggaacgaatcttcgcataggcttgctcgggggtaaagacgccaccgatgccggcgatagcgaaccggtcgccatactctttatacaccttgcgaatcagctcggtgctggcgttggtgcacgggccgccggacaggccgccctcccaatcgcgcggaatctcgaggccggtgcggtccttctgcagattggcgatggacagcccctgcacattgtgctcggccagcacatcgagcagttccttgtactcgccccacggcttgttcaacggcatcttgaccagcgtgggctgcgggcggtcgatcttgtcgagcgccgtaaacagacggtcgagcgcttccggagtcgcggtgaacggttcgccgacgtgcgtgttcgggcaggagacgttgacctccaccatcgcggtgcggccggcggcgcggcgcattgaaatgcagtaatcctcaatgccttcgtccaaatcgccgcactggtcgtcgttggtgcgggcgatcgacacggacagctgcatctggcgggcctgagtccaagccttctcggcgcgctcgatgaccttgtccgaaccgatgttggcgaggccgacgtgcaccatcatcgaatcgtattcaggcagacggtggaaccacggcttggcgttgcccgggcagggacgcgaggtggtggagcctacggtttcgaagccgaagccggcatggtccagcaccacgggcatctcgcagttcttgtcgaggccggcggacaggccgaacgggttggtgaaatcgacgcccatcacattcgtttccagaatggggtcggtgtagtcgagcatcagctgttcggcgagcagcagcggcgggacgttcttgacgacgtggcagaactcgatcatctgatcgtgtgcctcatcggggcggtggttgaacacgaagttcggtttgatgatgtgcttgtagccgaaggtgaacagatcggtggtggctttgttgacggcgtcgtgccagaagctttcagaaacgtaagtcataccgcctattgtctcacgcttgggccggtgcggctaggtgattccgacctaggcgaattggggaagggggctactgcgtgtcgaggcgcacgcaggcgtcggctcggcagaagatacatgaaccgggacgcaccaggtatcaggcgtgactctccgctgagcaacgcgcgcgggagagtcgtcggtcgtgagctatcgcgctagtggccgctgtgagaatatcggttcgcgcaatgtgcgattttgcgcggttttgtggaaatgacacctgaattgctcggaattttcgagaaattgtccccaaaacgctcaagccggtttggtttgtgagcttttgcgtgcgataatgttcgcatgatttcgtcacaacgtcagcacctcatcttgagcaggttgcgcacacgcggggcagtgcgcattacggcgctatcgaaggaactgggtgtgtcggcgatgaccatccgccgcgatatcgccgaacttgccgacaagggactgttgaagcgcgtccatggcggcgcggtgactaccagtaccttgctcagcgaacccctgttctctgtcaagtctcagatggatatcggcctgaaggacgccatcgcccaggaagccatcaaatatgtggctcccggcgatgtaatcgccatcggcggcggcaccacggcctatgtcttcgcccagcatctgctcgaatcgcagcagtccagcggcatcaccatcctcaccaattcgattcccgtggccgagctggtccaggccctcgaatccaaggatgtggaggtgatcgtcaccggcggcgtgatcacccgatcgaactcgcttgtcggcccgatcgcggacaaggtcgtcgcttcgctgcgtgtcaacaccgtattcctcggcacccactcggtgtcgattccccgtggcttcctgatgccgaattcgctggaagccgcaaccgatatggcgatgatggacatcgccgatcgcaccatagttttgaccgatcacaccaagtggagctgcacgtcgctgtcgctgtttgcgcgcttcgaccaagtggacacggtcattactgacgacgggctcgaccccgactccgccgccaaaaccaaggatttagtaaaggagctcgtgctggcccaccagagcgagaccattgaggaaagtgagcaaacccatggctgatttcgccaactacacccccggggagtatgcgaaggagcatatccgcatcacgccggcgacgcttgccgacggtcgtgacttcttctacctggacgacgaccccgagttcgtctccggtgccaagacccgcgagctcaaggacccgcgcccgctggactaccgtttcgccccgcatctggacgccgacggtaacgaagtgccgtacgccgccccgcagatgcgccgcgacccgctgaccggcgactggatcccgatggccaccgcccgtatgaaccgcccgatcaccgccggccccggcgccaccgccaagggcaacccgctggccgcccgcaagcccggtgacccgtaccaggacggcgaagtgccggacaccgactacaacgtcgtggtgttcgagaaccgcttcccctcgatggtgcgcgtgcccggtgtctccgaggacgtgacctacgttgacggcaacccgctgtgggagaagaagctcgccgccggccgctgcgaagtcatctgcttcgacccgaacgaggacggcctgccggccgatttgccggtctcccgcctgcgcaccgtggttgaggcttgggccttccgtaccgccgaaatctccaagatggaaggcatcgagcagatcttcccgttcgagaaccacggccaggaaatcggcgtctccctcgcccacccgcacggccaggtctactgctacccgttcatcgccccgaagatggagaaggaactccagcacaccgaggcctaccacgagaagaccggtggcaacctgcttaaggacatcatgaacgccgagctcgaagccggcgaacgcatcgtgatgcgcaaccacagctgggtcgcctacgtgccggccgccgcccgttggccccttgaagtccacgtggccccggtgcgcgacgtgctcaccctcgaccagctcaacgacgaagagcgctgggaccttgcctccatgtactcgcacctcctgaagcgcggcaacgccttcttcgacaagggcgacggcaagggcatggacctgccgtacatcgctgcctggcaccaggccccgatccacgacaagcgccgcgagaactaccgcctgaacctgcagttcttctccttccgccgtgccgccaacaagatcaagtacctcgccggctccgaatccggcatggccgcctggatctccgacaccacgccggaactcatcgccaagcgcttccacgagctcggctccatcgacatcgccgactgatagaaagaaaacatcaatgactgctgttgaattcattgagccgctgacccatgaggaaggcgtttcgcaagctaccaagctgttcgtcgacacctacggcgctgcgcccgagggcgtgtgggctgctccgggccgcgtgaacctgatcggtgagcacaccgactacaacgccggcctgtgcctgccgatcgctctgccgcaccgcaccttcatcgccctgaagccgcgcgaagacaccaaggttcgcgtcgtctccgacgtggctcccgacaaggttgccgaagctgatctcgatggcctcaaggcccgtggcgtggacggctggtccgcctacccgaccggcgtggcctgggcgctgcgtgaagccggcttcgacaaggtcaagggctttgacgccgctttcgtctcctgcgtgccgctgggctctggcctgagctcctccgccgccatgacctgctccaccgctctggctctggacgacgtgtacggccttggttacggcgattccgacgccggccgcgtgaccctcatcaacgctgccatcaagtccgagaacgagatggccggcgcttccaccggtggtcttgaccagagcgcctccatgcgttgcaccgaaggccacgcgctgctgctcgactgccgcccggagctcaccccgctggagaacgtctcccagcaggagttcgatctcgacaagtacaacctcgaattgcttgtggtcgatacccaggctccgcaccagctcaacgatggtcagtacgctcagcgccgcgccacctgcgagcaggccgcgaagatcctcggcgtggccaacctgcgcgtcaccgccgacggcatcgccaaggccgacgacccgttccaggcgctcaaggagacgctggacgcgctgccggacgagacgatgaagaagcgcgtgcgccatgtggtcaccgagatcgagcgcgtgcgctccttcgtgcgcgccttcgccagcggcgacatcgaggccgcgggccgcctgttcaacgcctcccatgattcgctggccgcggactacgaggtcactgtgcccgagctcgacgtggccgtggacgtggcccgcaagaacggtgcctacggtgcgcgtatgaccggcggcggcttcggcggctccatcatcgctctggtcgacaagggtcgttcccaggaagtcgctcagaagatcgccgacgaattcgaaaagcaaggcttccacgcaccgcgcgcgcttgccgcgtacgcggcgaaatccgcttcacgcgaggcatgataataaatcacaatgctaaatggcgggtgtcttccctatacttgggtagtcacccgctttttgtatacgaccagggagagccatgaacaaggcaatcatcaccgtcgtcggtcaggacaccgtcggcatcatcgcgcgagtctgcacctacctgtcccagcacaacgtcaacgtgctcgacatctcgcagaccatcatcgacggttacttcaacatgatgatgattgtcgactacgccaacgcggacaaggacttcggcgcgatggtcggcaaccttgaggacctcggcgacgacatcggcgtgcgcatccgctgccagcgtgaggaaatcttcaccaagatgcaccgtatttgaggcggcccgctcagcaggccgcctcacgcgaggaggtggaaagcccggtgggctttccactgacggagccatccttatccctctgatgagggtgaccgccaaactagtctttaaatatcctgtaaggaacaaaccatgctgaacatcatggaggtccacgagaccaatcagatgatcgagcaggagaagctcgacgtccgcaccatcaccatgggcatctcgttgctcgactgcgcctcggacgatgtcgacaagacctgcgacaacatctaccgcaagatcaccacctatgccaaggacctcgtttccaccggcaaggccatcgaacgcgactacggcatcccgatcgtcaacaagcgcatcaccgtcaccccgatctcactggtcggtgccagctcctgcaagacgagcgaggatttcgtcaagatcgcccacgcgcttgacaaggcggccaaggaagtcggcgtcgacctgatcggcggctactccgcactcgtttccaagtccatgaccccggccgaggagctgctcatccgctccctgccgcaggctctctccgagaccgacatcgtctgctcgtccgtgaacgtcggctccaccaagaccggcatcgacatgaacgcggtcgaactgctcggccatatcatcaaggacgttgccgagcgtaccgccgacaacgactcctacggctgcgtcaagttcgtggccttctgcaacgtgcctgacgacaacccgtttatggccggaggcttccacggcgtcaccgagggcgacgcggtcatcaacgtcggtgtctccggccccggcgtggtctcccgcgcactcgatgcggccaagggcaaggacttcgagttcctgtgcgagaccatcaagcgcaccgcgttcaagatcacgcgcgtcggccagcttgtggcccaggaagcatcccgccgcctcggcattccgttcggcatcatcgacctgtcgctcgccccgaccccggctgtgggcgactccgtgggcgaagtgctagagaagatcggcctcgaacaggtcggcgctcccggcaccacggcggcgctcgccatgctcaacgaccaggtcaagaagggcggcatcatggcgtcctcctacgtgggcggcctgtccggcgcgttcatcccggtctccgaagacaagaacatgatcgacgcggcttcttccgattgcctgaccatcgagaagctcgaagccatgacctgcgtgtgctcggtgggcctcgacatgatcgccattccgggcgatacctctgcttccaccatctccggcctgatcgccgacgaggccgccatcggcatggtcaaccagaagactaccgccgtgcgcgtgatcccggttgccggcaagggcgtgggcgagatggcgaacttcggcggcctgatgggctacgcgcccatcatgccggtcaaccagaccagctgcgaggcctttgtgacccgtggcggtcgtattcccgctccgattcacagcttcaagaactgattcagtagggtatctgccttcaaagaggtacatttgcgcagataggtatctgctttcagaggggtacctcaatcaagaaaccccgagtacaagcgttgatatttcaacgcctatactcggggtttcgtcctttaacagcccctcgaagcggcaatagacctccggcagatgccaaatcagcccctcgaagcgccgatagacccattttctgcgatgatggtcgtgctgcgaggctcagggtttcctctctcacgcctgtcggcgttcgttcggcgtcgctactcgaaggcccaccgggccttctcctcagcgccctccagcgaagttgagttggcgccaggcttcgtagatggcgatggacgcgcaattggtgaggttcagggaacgcaaggacgggcgcatgggcagtcgcacttgttcggccacatgagggccctccatgatgtccatcgggtcggggatgtcgccgggctcggggccgaacagcaggatgtcggtcggcttgtattccacctcggtgtacagcttggtagcatgtgcggtgaacgcgatgatgcgcgaattgggcatggactccaccaggttgtcgaaattcgggtgcagcaccacgtgggccatgtcgtggtagtcgaggcctgctcggcgcagcttggtgtcgcgcaggttgaaacccaacggctccaccaaatgcaggatggtgccggtcaccgcgcacaggcggatggccgagccggtgttgccgggaatgcgcggtgagtagtagcacagatgcggtgttacggtttcggtggtggcggccttttcagccgagagcatcgcgtccaccacggagatggggttgccatgcgcgtcggttacgagttcgtccggtccgtaattcgatttacggtacccgtactcgaacatcttctcgacttttgtttcgggattctgtgcgttctgcgaattctgttctgcttcgttcgtcatagctgttaagaataagaacgatgaacgacacagcaatttctttgcgattgggcgcatggtgggaggccaatgcgcgcgatttgccatggcgcttcggccgggccacgccgtggggcgtgctggtatccgaagtcatgagccagcagacgcagatgagccgtgtagtgccgtactggaccgactggatggaacgttggcccgacgcccgcgccctcgccgaggcccccaaggccgaggtgatcaccgcatgggggcggctcggctatccacgccgcgcattgcggttacaggaatgcgcccgcgtggtggctgaagattacgccgacaaactgccgcgcacgtatgacgaactcactgcattgcccggcatcggcgattacaccgcctccgcggtgatgagctttgcgttcggcgaacgaattgccgtgatcgataccaacattcgccgcgtgctgagccgcgtgttcctgggcgtcgaatcgcgcgggggagcgaccagcccggccgaacgcgcgctggcgaaccgcatgctgcccaaagacgagattctcgggtgcgatgctgacgtcgccgataatgccggtagcgccgaacatgtcgtgaacagcactatccgtggcggcaaacgctctcgactgcatcgtggcgagcgcccatcggtcacgtggaaccagtcggtgatggaactgggcgcggtgatctgcacggccaagtcgccgctgtgcgacacctgcccgattgcggacgactgtgcatttctcaaggccggccgccccggactgggggagcgccgcacccgcccacgccaacgattccaaggcacggatcgacaggtgcgcggtctggtgctcgccgcgctgcgcgagcttcccgctggagccacgttgcccagggaagatgccgacaagctttggaaggaccagattcagcttgccgcctgcatcgccagccttgacgatgacggcctgatagagattctggacggcggcctgcgactacccagctgacattgtgaaaaatggtgggctccccaagcgtgtatgggcgtggtgaccgtagactggaagagttatggcagtgcagaggaacacatcaggcgcgagaacggcacgcggagccggcaccggggccaatgggccatccggcgggccctcccaaaacaaccgttccggcaagccgcgcaagcgcaggatcagcaaaaagcagcaggccatctatcgtcgtcggcgtatcgtggccggtacggtgctgctgctgataatcgcgctgattgtattctgcgtgtatagccttggccggggtatcggtgccgtgaactcgatgatccaccatgacgaggtgtatgcgatttcccgcgacgccacgccggcgccgaagaaagtcagcaacgtcaaggattgctcggccagtgatgtgacattgcagctttccgcggcctcccaatccgtgccggtaggaggatcgcttgatttcaccgcgaccatcgtgcacgaggggtcaggcaactgtttagtggacgggtccgattccggccgtgtgctcaccattacttccggtcaggaaacgatttacaagtccgatgtgtgcccggcggattcacgtctgctgctgatggctaagggcgataaggacgttcagaaggtcacgtggaataccaatgcgaacgccacgctcgccaaatgcacggatgagtcaggttgggccaaagtcaatgcgggaaggtacgtggcgcagctgagtttgaaggatcatccgaaggtgaagagcgatccggtgacgtttacggtgcagtaaaagtcttgccttagcgctattcttttgactttgcatgaggtgtgtcatattgcgggcatgccgtcgacaatgaagcgtccgcataggcatatggtggccatgccggcgctcccaggggaattaccacatattagcgagcgataaggaacgtccattggctactgagtctacgacgaacaccaccaccatcatcgcacgcgccgaccagcatgatattgacctgcacaaggcgtcggatcgcgtgaacttcggttccatcaaggaacccatcgatgtgccctacctgctgggcgtgcagaccgacagcttcgattggctgatcggcaacgaacgctggaaggcgcgcgtcgaggaggacgaaaagaacggcactaacaccgtggcccacacctccggcctcgatgaggtcttcaacgagatctctccgatcgagaacttcgctcagaccatgagcctgaccttctccgatccgtacttcgaagagccgcgtcacaccgtgcaggaatgcaaggagaaggattacacctactccgcaccgctgtacgtgaatgccgagttcgagaacggcgacaccggcgagatcaagtcccagaccgtgttcatgggcgatttcccgctgcagaccccgcacggtaccttcatcatcggcggcaccgagcgagtcatcgtctcccagctcgtgcgttctccgggcgtctacttcgaccgccagcaggatcgcacctccgataaggaagtcttcggcgcgaagatcatcccgagccgtggtgcatggctcgagttcgagatcgataagaaagaccagccgcaggtgcgcgtggaccgcaagcgcaagcagtccgccatcgtgttcctcatggccatcggcatgaccaagtccgagatcgcccaggcattcaaggactacccgctggtgctcgacgcactggagaaggaaaccctcgagacccaggacgaggccctcgttgacctctaccgcaagattcgtccggccgacaccccgacccccgaggccggcaagaatctgctggactccttctacttcaacaccaagcgctacgatctggcccgtgttggccgctacaagatcaaccgcaagctgggtgtcgaggccgatttcaacgatcgttccctccaccaggaagacatcatcgccacgatcaagtacctggtggccctgcacgacggtgcggcgaccttcccgggcaagcgcaacggcgaagacgttgacctgcgcgtggacgtcgacgatatcgaccacttcggcaaccgtcgtatccgccaggtcggcgagctgatccagaaccagctgcgtaccggtctgagccgtatggagcgcgtggtgcgcgagcgtatgaccactcaggacgccgaggccatcaccccacagtccctgatcaacatccgcccggtgaacgccaccatcaaggagttcttcggcacttcccagctctcccagttcatggatcagaacaacccgctgtccggtgtgacgaacaagcgtcgtctttccgcactgggccccggcggtctgtcccgcgaccgcgcctccatggaggtgcgcgacgtgcacccgtcccacttcggccgtatgtgcccgatcgagtctcctgaaggcccgaacatcggtctgatcggctccctggcaaccttcggccgcgtcaacccgttcggcttcatcgagaccccgtaccgcaaggtcgtcaacggccacgtgaccgacgaggtcgagtacatgaccgctgaccgcgatcttgaccacgtcattgcccaggccaaccaggagctcgacgagaacggcaacttcgtgcagaagtccgcccttgcccgagtcggcgaagaagaggcggtcgatgtgccggtgagctccgtggactacatggacgtctccccgcgccagatggtctccctcggcgcctccctgattccgttcctggagcatgatgagggccaccgtgcactgatgggtaccaacatgcagcgtcaggccgtgccgctgatcgaatccgagcgcccgttggtgggcaccggctccgaatggcgcgccgccaacgactccggcgacgtcatcaagtccgagaaggacggtgtggtcacctacgtgtccgccgacctgatccgcgtgatgaacgacgacggcaccaccagttcctacaagctggccaagttccaacgttccaaccagaccacctgctacaaccagcgcccgatcgtccacgacggcgagcgtgtggaagccggctcggttatggctgacggccccgccatccagaacggcgacctggccctgggcaagaacctgctcatcgccttcatgccttggaacggctacaactacgaggatgctgtgatcatctcccagcgcctcgtgcaggacgacaccctctcctccatccacatcgaggagtacgagatcgacgcccgcgaaaccaagctgggcgccgaagagatcacccgcgacctgccgaacgtcggcgaggacgccgtggccaacctcgacgagcgcggcatcatccgcattggcgccgaggtcgaggccggcgacatcctggtcggtaaggtcaccccgaagggcgagaccgagctgaccccggaggagcgcctgctgcgcgccatcttcggcgagaagtcccgcgaggtgcgtgacacctccctgcgcgtgccccacggcgagaccggtaccgtcatcggtgtcaaggagatcacccgtgaggatgccgaggaggacggcgacgagctgcccaacggcgtcaaccagatgatccgcgtctacatcgcccagcaccgtaagatcacggtgggcgacaagctctccggccgccacggcaacaagggctgcatctcccgcatcctgccggaagaggacatgccgttcctggctgacggtactccggtcgacatcatgctgaacccgctgggtgtgccttcccgaatgaaccttggccaggtgctcgaactgcacctcggctggattgctcactccggttgggacatctctttggatccgaatctggaagccgagtggaagaagctgattccgtccggtgccgagaaggccgagccgaacaccccggtcgccaccccggtgttcgacggtgtcaagcctgaggtcctgaagggcctgctgtccaccacgctgccgaaccgcgacggcgaccgtctggtcggccccgacggcaaggccaccctgttcgatggccgtaccggtgagccgtacaccaagccgatttccgttggctacatgtacatgctgaagctgcaccacctggtcgacgacaagattcatgctcgttccaccggcccgtactccatgatcacccagcagccgctcggtggtaaggcccagttcggtggccagcgcttcggcgagatggaggtgtgggcccttgaggcctacggcgccgcctacacgctgcacgagatgatgaccaccaagtccgatgacgtcgacggccgcgtgcgtgtctacggtgccatcgtcaagggcgataacctgccgccggcaggcatccccgagtcgttcaaggtgctcctgaaggaaatgcagtccctgtccctgaacgtcgaagtgctcaacgccgaaggcgtggccatcgacatgaaggatgaggatgacgatccggccagctccgctgacgacctcggcttcaacatcggcgcccgccccgacgcggccgccaaggaagaccagaaggccgaagagcccgaataccagtgatccctcgggctgcatgcggtcaatacgccgcgtgtagctccgccaacgtgaaataaataacgtacagagacctttccggtttgcactacccctcagtcagccttggctgacagctcccctgacaaggggagcttgggaaggtctcaagaacagaaacggattaacaagtgctggacgtcaacgcatttgacaagattcgcatcggccttgccaccgccgatgacatccgtggttggagccacggtgaggtcaagaagcctgaaaccatcaactaccgtacgctgaagcctgagaaggacggtctgttcggcgaacagatcttcggcccgacccgtgactgggagtgcgcctgcggcaagtacaagcgcgtgcgcttcaagggcatcgtctgcgagcgatgcggcgtcgaagtgacccgcagccgcgtgcgccgtgagcgcatgggccacatcgagctcgccgccccggtgacgcacatctggttcttcaagggtgtgccttcccgcctcggctacctgctgaacgtcaccccgaaggacctggagcgcgtgatttacttcgcctcctacatggtcaccgaggtgaacgaagacgagcgtcacaacgatctgcccggcctgcaggacgagttcgattccgagatcaagcgccttgagcagcgccgtgactccgacattgaagcccgcgccaagaaggtcgaagaggatctcgccgcccttgaggaggccggcgaggccaagggcccggcccgcaccaagttgcgtaacggtgccgagcgtgatatggctgccatccgcacccgctacaacgaccagatcgcccgtgtggacgccgtcttcgacaagttcaagaagctcaagcccggcgacatggtcgacgacgtggacctgtggcgcgagatgcaggaccgctacggcgattacttcgacggctgcatgggcgccgaagccatcaagaagcgcctgcagtccctcgacctggagaccatctccaaggaactgcgcgaggagatcaaggacgcttccgaacagcgtaagaccaaggccctgaagcgcctcaaggtcgtcaacgccttcctgaccaccggcaacaagccggaggccatggtgctcgacgtgatcccggtcatcccgccggacctgcgcccgatggtccagctcgacggtggccgcttcgccacctccgacctcaacgacctgtaccgccgtgtgatcaaccgtaacaaccgtctgaagcgactgatcgagctcggcgcccctgaaatcatgctcaacaacgagaagcgcatgctccaggaagccgtcgactccctgttcgacaacggccgtcgtggtcgcccggtcaccggtgcctccaaccgtccgctgaagtccctgtccgacatgctcaagggtaagcagggtcgtttccgtcagaacctgctcggtaagcgagtcgactactccggccgttccgtgatcgtggtcggcccgtccctgcgcatgcaccagtgcggtctgccgaagccgatggccctcgagctgttcaagccgttcgtcatcaagcgcctcgtggacctgaactatgcgcagaacatgaagtccgccaagcgtcttgtggaccgcggcgacgccgaagtgtggggcgtgctcgaggaggtcatctccgagcaccccgtgctgctcaaccgtgcacctacgctgcaccgtctgggtattcaggcattcgagccgatcctggtggaaggcaaggccatccacctgccgccgctggcctgcgccgccttcaacgccgacttcgatggtgaccagatggcagtccacctgccgctctccgccgaagcccaggccgaggcccgctcgctgatgatggcttccgacaacatcctgaagccggccgacggccacaccgtgaccatgccgagccaggatatgatcctcggtttgtactacctgtccaccgtgctggaaggcgtcaagggccagggccgcgtgttctcctcgctggaagaggccgaaatggccctcgaccgccacgagatcgacatgcaggccaaggtgctcatccgcctgcccgagagcttcgtgctgccgaagaactgggagcccggcgaagtcaaggtgctcgacccgcgcgaaggcgaggacgaggtcgtcaaggaagaacgcttccacgacggcaccgtgctgttcgccacctcctacggccgcatcctgttcaacgagaccctgccgaccgactacccgttcgtcaacgagcaggtggccaagggccgtctgtccaagatcgtcgatgacatcgccatgcgttactccacccagcaggtggccgccacgctggatgccctgaaggatctcggcttcacccgcgcaccgtggtccggcgtgtccttcgcgttctccgacgtgaacgagccgcccgagcgcgacgagaagatcgccgagtacgaggccaaggccgacaaggtcaacgccaactacgagatgggtctgttgaccgaggaagctcgccgtcaggaactcatcgacctgtggaccgagtgcaccgccgaagtgtccaaggaagtcgaggagaagttcgacccgacctccaacctggccatcatcgtgcagtctggtgcacgaggcaacatgatgcagatcaaccagattgcaggtatgcgaggcctcgtggctaacccgaagggtgagatcattcctcgtcctgtgaagtccaactaccgcgacggcctgtccgtgctggagtacttcatctcccagcacggtgcacgtaagggtctggccgataccgcactgcgtaccgcagaatccggttacctgacccgtcgtctggtcgacgtctcccaggacgtcatcgtgcgcgaagaggactgcggcaccaaggccggtctgcccatccgcgtcgccgagcgcgacaacgacggcaacctggtgctcgtcaaggccgccgacggtggcccgtactcccgtctgctcgccgccgacgtcatcgacccggccgacggacaaaccgtgctgtacaagcgcgacgacgccctgtccatggacgtgctcaacgacctcgtggcccacggcgtcgaggaagtcaagtgccgttccgtgctgacctgcgagtccaagcgcggcgtgtgcgccaagtgctacggctggtccctggccaccaacaagctggtcgatgtcggcgagaccgtcggtatcgtcgccgcccagtccatcggtgagcctggtacccagctgacgctgcgttccttccactccggtggtgtggccgcggcctccgatatcacccagggtcttccccgtgtcaccgagcttttcgaggcccgcaccccgaagggtgaggccccgatcaccgagttcgccggcagcatcaagatcgtggagaacgatcgcggtcgccagatcatcctgaccccggacgccgattccggcgcaccgaaggaagacggcgtgatcaagccgatcacctaccaggtctccaagcgcgtgccgctcaaggttgccgacggcgaccacatcaaggtcggcacccagctggtcgaaggttctgtggaccccaagaagatcctcaccatcctcggcaagcgcgccgcccaggtcaacatcgtggaggaagtgcacaccgtgtaccgctcccagggtgtggatatccacgacaagcacatcgaggtcatcgtgcaccagatgacccgtcgcgtgaccatcatcgactccggcgacaccgacctgctgccgggtgagctggtggacaacgcccgcttccgcgagatcaaccgcaacatcgtcaagaacggtggccgtccggccgtcggtcgtccggcgcttatgggtatcaccaaggcgtcgctggccaccgactcctggctgtccgccgcatccttccaggagaccacccgcgtgctcaccgaagccgccctctccgagaaggtcgacgacctcaagggcctcaaggagaacgtcatcatcggtaagctcatcccggccggtacgggcctcgcgcgctaccgcaacgccgtggtcgagcctgacaaggccatccgcgacaccatctacccgaacttcggtctgggcggcgatggcgatctcggcgacgcgagcttctccgacgccgacctgtctgacctgaacttctcgaacctcgagttcggcgatctgaagctcggcgacgacttcaacccggatgatttctactccgatcagggcggtcagcctgacatcgaggagtaagtgagaaggtcctagaaaggatgccccttctaggactcagatcttgcgttaatcgcaataagatggcccggaactatatcagttccgggccatccgtatatttgccattgtgattttcctgttgaacaagagcaggcagccgctcgttgcttgattactcaagcctgtttttcggtgaactggaagaactggtctccgatacgcaccgtggcaggcgcgctgagcttgagcggtgtgcccttggtgacttgtgtctcttggccattggtgatgatgtaggtgccgttcaacgagccgtagtcctcgatccacagcgcgccatcggtgtcgatgctgatggcggcatggttgcgggatgtggtgcgggtcgggtctacgatacgcaccgccttggcaccctgcggcacatccatggaaggcttgcggcccagcaacgtgctcttatcgatcacgatggtctggccggtgacatcgttatgcagcaggtacgtcttcttcggtgccttggacgtgaacgaggaggagagcacggtgctgtcccaatcctcgatgtcgttttcggcggcgtgcggtgtggtgtctgccggagcggtggcagcgggctcagcggcggcggccgtggcggcaggctctgcggtaaaagcggtattggttgccgcttccgcggtactgggctgcccgtagtcgttctgcggttcggctgtgccaactgcggaatccggggtgccttccaccggatcgtcagaataccaacccagttcaggtgctggagggtagggaagtttggccatgatgatgccgtcctttcactgacgggaagccagagcggcgttgattgccgggtcgccgagctggcccagccattcgatcagtgccggataggtgttgggattacgtgcgatgcaggcgcgtagttcaggcgcgtactgggcaatctgggcgatttgcatctggtcggtggtggtcagggcctgttcggcggtgaaaccgtaaggattggtggccacaggctcctcgaatgccgcctgagccgcgggctgctgagcctgttcggcggcgggctgctgggccgcctgtgccgtggctttctgatcctgaaccgggccgccgaatgcctcggcagtgaacccgtattgcgccagggtctcgcgggcgcgatcgtcaccgaactcggcgatccaacgcttcaagccgggataacagcgcggattcacggcgacattggcaccgaattccggattctcgtaggcgatttttgccagcagaatcggatccgcgttcggatcctgaacggcagcgaccgcagcatcataatcaaccatgggattacctccttatgttcgctcggttatgccgaacgtatggtccgtagtgtttgtagtgttgcgtcttcaatggcgccgatatcctcaccttcgtccagcctgaatgcgctgaacgcatgatgttcgggttcggtcaatggcatatcggccacaatcacagtgatattgtcggttccgcccgcatcaagagcggccgccaccaaggcgtccacggcctcctgcggactggaatgcgccgcggcgatggccgcgatctgttcgtccggcacctcgccatgcaatccatccgaacagatgatgaagcggccggtcagatcggcgacatatacgtcgggcatgatgccatccggatcacccagacattgggtgatgatgttgcgtggaatggtcgcctccgcctcttccggcaacatctgcccggaatcgatggcttcttggcgctgggaatggtctcgcgtgatgcgggtcagcgaagcggcgtcccacacgggaatgatatccgtggcgggagcatcggcatgcgccaacggactgagatggtaggtgcgggaatcgccgacattgaccacataggtctggtccgagaagtcctgatcatcggcgtcactgaacaaagcagcgctgcgggcgctggcggaatccgcatgatcttggggcagtaccaaaccggagcaggttgtgccggccacgccgccaaggcggtctcccagatcgagaatgtcgtgctgggcccgtgccaaggtgtcgtcgatatcctgacgggtgcgtgaaggcatggcggccaattgtgcgaaatgctgggcagccaactggcttgcctgctcgccgcctttgccgccgcccatgccgtcacagaccatgaacacgccttgttgcgcgaatccggtgtcttggttgtttttgcgcctaagacccacgtcactggtcatcgcgatacggatggagcctgtggtcatgacgccttccccttcttacgcgtgcgcttgacatgcgtcgtgtgcggctttgctgcgtgcccatttgacagtatagccacgcttttcagggaaagtcgtgtacgtatcctcctgaaacgcggcaaagaagcgagcattgccttgcgtaattggtcgactcctgtccaatatgtggtggcttggcccgattcaatgtcttgccccgagaacgtggcgtagtcggcttcccggccaagctggatcaaagcctggtcatctgtgccgagttgacgggcgatggcaccggcctgatctcgacgagtgcccttggctgtgatgccgctttgctcggcaagcatgcgtatggcattccaacctgctgccacacgggctttcggactgccatgccgccgcgctcgtgccagcagtatggccttgaacatcagaatcagaccgcaggcgatgagtagggtccacaatgggctgccgtacagggccaccttgcgggtcactcgccagaaccgcgcccagaacaggttggtcggcgaatcatcggcgtcggcgccggccaatgagctttggcccttggcttgcgtctgatcgcgcagcggatcggtcaacggcactggtggttgccggaccagcgtctgcggattcggcggcgtcaggttctggttttcatcaggcatcttggtctccttgggcgtcggatagaacgccacccatcccaggccctgcaatttgatttccacccaagcggtgacatcgttgccggtgaattcgattttggtgccattgcccgaggtcttctccgtgcgggcatcggtgatttcgccatcctcgtttttcggcaggaagcccaggaccacacgggagggcagtcccagatcacgagccatcagtgccatggcggaggcatattgctcggagtcgcccaccatggccgtgcctgccagcagcttgttgatgcggtagttgccatggccggcatcggagggatggtcgccttcaagtccatgagagaaccatccggagtctttcaatgtgtcagccaacgccgtggctgcggcaccgcccgaggactgcccgccggcaatggacgtggccagtttgctggccgaatcgggaacatcctgggcttctggttgggtgatgcgggccgcagccgcactgctgatctgcttatcggtgggcttgcgggcgataatgccggattcggtataggtgaggcctttacgcgtgccggcgggaataatggcggaatcggtatccgtgttgtagtaaaacgtgtcattgccgttgtcggcatcgttggcgaagctcacgccagtggccgctcccgccagcggcagccaggtgtcggtcagttcctgatcgacggtgaaggtcgcagtgaaggatttaccctgctcatccgccttgatcgtggtgcccacgcgatgataattcgaggagtccgtggcttcggaagaatcggacaggttccatactgtgccatcgaatcgatccatcaccgcaagtttgaccggtgttccggccggcagattatgaacggtcagcaacacgtcttttttgtggtccttgatataggatcgcatgccgctgagcgggctggtgtaatcgtaggggcttaacggcggatcgtagcggtcacgcagcacgaaacggtcctgtggcaccagcaacgtgcccccgaaagcaaggccggcagcgagcacgacgatgatcagcgcggatatccagcgcccccattccagcagttcaagacgccaagacagccagataatcagcagcaaggcaaaggcaataccgcagatggcgcgttgccagccgctgtctgtgcccagcagggcacatacggccacggccgccgcaaggggcagcactcccaccagagacaaccatgcgttggcattaatggcaaacacgccggtgaagaacgtaagccacaggccgatggtccataccgccatcagcacgccgtcttgcgtgcccagaggcggatcgacggaaataatgtacttgaacgagccaaacgtcatttcccaacctgaactcaaggtcttcaaggtgggaatcacgtaatgggacgtagtggaactcagcgttaccaccgggccgatgatgaattgggcaaacgccagaaacacgatttgccaccacagtcgcaacgccggcaacatgcccgccagagcgatgatcgcgcccagcaaggtggccggtacagcggcaatcgcccaagtggccacgccgccgtacacgtcgatgagattggcttgcgccagcaacatcatcgccgctatgagtacgaggctggcgattcgtttgccccacggctggcgactgaggcccatgccgcgaagcacattgcctctggtcatccagataaccgaatgtgtggagtcggcccaggagccggtggtggtggaggtcccggtgtacgtgccggaggaagtgccggtgtatgtgccgctcgatccggcgtacgcagcggtattggtattggtgatactggactggtcgaaggtcatgcgagcacccccatgatcagcgggagatcatcgaggtcgccgatggtggccaatgtgaagttggcgaatcttctgatgccgcgattggcgccggcgctggcctgcaataccacgcagctggccgatcggggcaaggccaaggtcatgcgcttgatttgctcgatgtctttcagcgatccaacagtgaaaaaatagaacgaagcatcaggactgtgcttcagcgtgccctcggcgagattcggattatcctcacgatcagactctatggcactggcgttgtcgaggaactccatggcgttgcgcggctggccgtgcgtgttgcccgcgtggcagaacaatggacgatcctgcagcaggcatttgacgccgatggaggagtggatggacaccgccatctcgaattcctcgccgttgacgtattcgtccgggttcacgctgatggtcaccgaggtgtcggtgcggcgcgtggcctcatattggcgaatcatcaacgtgccggttttcgcggagctcagccagtggacgttacgcacgtcgtcgcccggctcgtattcgcgcaatccgtagaagtcgagatcatcatccacgatctggccggatggttggccttccaggtcgcggggcacgccggcattcagagtatcgagacgcacggtacgagggtggatgaatacggtgatgcggtcggccagctccttttcgtgacgcaccagaccgaacgggtctcccttgcggatgcgcaatgggccgatgggcagtattgcgcgcgatacggtacggaactccacatcggtttgcttggattgcccgggagccagcatggggatgttgaatcgttcatgcgcatcgccgattggcagatatccgcgtgccgtggtcgtcggcgttctgccggtgttgtcgatgccgacgataacggatacggtgtctcccacggtcacgcgatgattggatacgacgatggacgcgtggaagcgtgtgttgccgagggaaagcacgattgccgcgagcatcatcaccatcgccacgatgccgaatacgagcagctcataccagcccagaaacgggaacgcaataaggcatgcgatgcctgcgcccgttaccgcccagcccaagggcgagacgtaggatgcgaagaaccgtctgatgcgtcttaccgcgcgcttgaacatgcgttcagcgcgccggcgacggcgtaatgcggcggatgtagatgccatggtcggatacctttccgggccctatcaggaaccgatggtgggggagggaacgtcttcgagcacctgtgcgatcaggctttccggagtcgcgccatcgaaggtggcttccggagtcagcgtgatacggtgtgcgagcacggccactgcaaggtccttgacgtcatccggcaccacgtaggcacggccatcggccgcggcccagatacgggcgcatcgggtcagtgccaaagcgccacgcatggaggagccgaccgtgatcttctcgttgtggcgggtcgcctcgacgagcctgacgatgtattcacgaatcgcatcatccacatagatttcggtggccacctgacgcagccgcatgacatcgtcaccgctcagcaccggggaaatggtctgcgcacggtcggtgatatcgacctgcttgaggatatcgacggacacatcatggcccgggtagccgattgacgtcttgataaggaatcggtccatctgcgcctcaggcagcttataggtaccgagctgctcgatggggttctgggttgcaatcacgataaacggctgcggcacatcatgtgtgacgccgtcaacggtgactttctgctcttccataacctccagaagtgcggactgcgtcttcggcgatgcacggttgatctcatcggccagcacgatggaggcgaaaatcgggccttcgcggaactcaaattctccgcgcttctgatcgtagaaagtcacacccaccacatccgaaggcagcagatcgggcgtgaactgaacacgcttgaaaccggtggaaatggaattggccaagcctcgggccaactgggtcttaccggtgccggggttgtcttcaagcagaatatggccaccgaccatcagtgcggtgacgcattgcttgatagggatggtcttgccgataaccaccttggagacattttcgaccagcgcattgaaggactgctggaaatcccggacctgagccgtgggctggggcagtagtccggaattgatgctggcgggcagtgccgatgcggctgcttgcgcggctttgctcgactgacgctgcggctgggattgtggctgtgattgcgcggtgacctgctgcgggatggctggcgtcgatcccttgcgcggcttgagcacggtgctgtcatcgcccgcaggaatggaggcggcatcagtagtaggagacggcttttctgacggcgcttgtgacggccgctgcggcaggttaggcagcgcaacggactgcggcgccgactcggtgcttggggtcgtgccggtgtgtggtgcggatgccaggtgcgtggcgtcggacaagtgcgtgctgtcggatagctgcgtgctgttggacaggcgggtcgtgtcagacaactgcgtcgcgtcatcgatgttctcgctcatggatgttctcctactgcttgtgaatggtggttgacgatattggggtattgccgaaaccaagaatccaggggttcttggccaaagtggtgacatcggtaccggatttgagcgacttggtcccctccgaggagtcagagggacgtgtgcccgcgacgctgcctccgtccgcagtgttgtcgagaccggagtatcccggcccgccggtgactttgacgctccacgcgtagttgccatcggcggccacggtcaagtcggtgacatccaattgctggccggagttccacgtgaacggttggccattgatgatgatttgtacagtggccgacttgccatagacatcaaccgaaccgccggtgacgttaatgacgtgagcgttgtctgaccagcgcagctcctgcggtttgttgattacagccttcttctcataggtgtaaggagcgccattgtgcgggcctccggtgacggcgtcgctggtagcgccgttgaacacctgttgcaccgatgcggtgttgcatttggcccaaggactcattcggaagtcgagtgagttccggttagtagctgtaccggaatcgatgccatcggcagtcacgctgtaggactgcgcatgtccctgcttggtccaatgcacggtgcatgtactgccggatccggtggtgtagacgtcagtgggcggctggaccttgtactgcgggacaaagctgctcttgcccgtgccggaggaagcatcgcgctgcggcaccacggtggccgttacggtgatttcccgggtgttcaaatcgttctcattgatatcgaacgtagcgccactgtcactgcaatcgatggtgtccttgacgtctcctcccaaggaaattcgccggcagccggcattgcggttattgccgagagtgactttcgccgttaccgtggtgtcgtcgttcgacaacgcaatgttcggcgcatccgggtctccccagatcttctctgacggcgatgcggcggactcggcactccaattgattttgttatgggctttgacggtcgccgtaatggcggtgccatcggaaatgtcgttgttgttgaacgtaaacgacagctcggtggccgtattgccggtttccttggtctgcggagcacctgcaccggtgacggtcactgaatagttgtcgacggcgctgaaatcaccgctcggcgctttccacgtcaccttggcggttttattgccacctgtgaccgtaacatcggtgggagcggacggcaccttgtccggtgtggcttcgacggcggtggacggcttggaccagccgacgtcatttcgcgcggcgacggtgaaggaataggttttgccgttcttcagaccagtgacctggcatgaggtgacggtaccgcaatccttctctccggtgacggcaccggtccaactgaccttgtagttggtgatcgggctgccattggcggcaccgggcgtccatgtgaggctgaccgcgctgtcctgcggttccccggctacgggggagagcagtggcggctcgggcttgtcgatcacggacacggtaatcgatgcggtgacttcacgatccttggacttggtgccgtcttgcacggtgacgagcacggtgttcgtggaagcacctacatcggatgcgacggcgatggtgatgtttccggaggcatcgcatccggcgatggtgagtttggcggcgtcatccgccttgcagctgatgacggtcagcgaggaatcggggaacggattgtacgcgccggtaagcacgttcacggcatcgctggcaccggccttgatcttcaacgtcttgttgccgacgcgtgtcagcggacgggtcgaagacactacgcgcacggtcacaccggcattcacggtgcccgcgccgtatgcgatttgcacgggaatggacgcggtggtgccaggagcggcatccttggtggcggaaacctgcaagctaccggaacgggacaggtttgcggtgatttgcctggatgatgagcttccaccggaatacgtgtattgcttttcgtcgtcatacacgccggacggtgcatgggtgagcgccgtcagatcaacggtcttggggtccgcgcccgcctcgacatcaatagtggaggacgagaacgtgggcggcggcacatcgcggcctatcaccgtgatctggagagtgatcactgcggaattgatgatcttggtcttatccgatccctgcttgccatccacagcggtaaaggtaatggaggcggggcctgcgtagtcttttgccgcagtgaacttcagggtcttgtcgttcacgtagaaatcggagttggaagccttggtggcgctgacggaatcagcgctttcgatatacggttccttgccggcgccgacgcggacatagtcattgatgttgatttcaatggtctcgcgcgagttgaccttcaattccggtgccttgggacgcagcgtgggcggaaagacaccataggccggtacctggatgaacgcggtggaggtgatgttgtatttcgtattggtcaccgtgtaaggcacggctcgcgcctgtgacgtcaggtcgacggtgatggtggtcgaatgctcgccgcccttgacgtgagcgtgagcgctggcggagggatgcacgccgaccttgagctcattggctgtgccggaaggattggcgatccactgggaaacatccacatccacggacttcttatcgatggtggcggcggacggcacacgatagtcgtaggcggtaggcggctcgatggcggcactcggatccacgtttaccgtgagggtggccgtatcggacaagccggccttgtctttgaccgtgtaggcgatatagtcggtggtggcgctgccgggcgtggtgaaggagatcatattgtctttcacgctcaccccgtcgagaccttggacctcgacatgcttgtcgacggtcagattggtgttgtcgccggagatgtcgttctgcgcgaccggcacggttgcggccgtattgggcctcaacgtgatttcgtcatctctggcgtatacgccggagtcggacgatccttggaatacgcccacgcggatctgcgcctgtgcgcgctgaccggtccaatcctccacggcataggagaaggtgtcggtgccggacgaatccggatacgcttcatagaccaagtagtcggaaccgacttcggatatgcggcccagcgtgggtgccttgttgcccagacccaacagctgatcgtcgtcgccatccgtgtctatgccggtcagtgtgatggggatgcggaccttctgcccggcggcaacctgcgcttcggcgtcatgcggggttggcgcggccttgctcgctgcgtcgctcttatgcacggtaatggtgatattggcggaagccacattacccagattgtcttcaaccgtataggtgatggggaagttgccggtctcgctggatgcttggtagcggaccgtgtctccagagacgaaggccagacccttgaacgtccccttgtcgtattgcaggttgttcttgagtttgaccgtggtgccatccgagtaggccacatggtcaagcacatccacggacacgatgccgtcggtacgcacctgggcattgatattgctggccttgggcactgaattcgaggtggccagagccggcggctgcaacacgatggtgcccttggcggttccggaggcgttggccacggtgtaggtaagggcgacgggcttcgtgggcacctgacgcgcggtgatatacacgcgcttatggctgacgagaccaaccttgatgccggagtcggccggtgcgctcaccgtggtgacggacagcacaccgcccatcggatcgacgtcattggtgagcggctccacaatggcggtattatccgcgccaagcagggcgacatcgttggcggcaaccggtttggcggcctcgccggtggcaggctgcacctcgactcgagccaatccggtggccggaatcgaaccttgagtaatgatgtagggcacataataggtgccgggattggtggccttgaacgtcaacgacatatccgccgcattggtggtcgtcgaagcgccgttgggcgtatccacctgagtcagttgtgccggctgcaaggaagtgccatgcacataagaggacagcttgacgacggtatccgtgttgggaacggtggttttcgctaccgggtcgatgaccgcggccaaggtgttcgcgggcttgaccgagaaatacaccatgccggtgccggttgccgtgccgtcggagacggtgacctcgacgcccacacgtcccgacgccagcgcaccggtgttgaacgtaagctggccgtcggctcgggtggacacctgcacctggtcggtgttctgggccacagcggagaccagagtgagcgggtctccatccggatcgttgaagctgctcagcgcattggcggtataactggctccctgctccacatcgatctcgggaggagtgtcgaactgtacgggagcgtggttgcctccatcattcagggttacggtcaccgtggcggaagaggtctggccgcgaccatcggaaatatcgtaagtaaaggtaacggtgcctgcggatgcggcggaggcatcgagttgcagataccggccgtcgtaaatcggcgaaatggtgacgtctttgttgtttggtgcgccaaccttggtgattttcagtacggaacaatcggtctgctcgtcattgcgcagcgcgtcgagaatctgttccgaaccggctcgtgcgccgatttcatcatcctcggctttgatttggccggattgtgcggaacaggtcttggagaagtcgtggtggttgttggccgagtcgttgttctgctgttctttctcggtctgctcggtctgtattttgttccactgtattttgatgactttggtggaatcctcagggttccacacattgccgttaaccgtgtcgttgagcaccacaaggcgatggttggtgcggaacaccaattcggaagtagtattgacggattcgagggtttgcggcttgacgctggtatccgtgggggagcaggcgcgaatgtagttgctggccttctggctccaagccgagtacacgcagcccttggacgataccggtcgtgctggattcgccttgcccccgttggctatgaaattcgccttggcattggacttcaacgggataagcgcaaggcctctcggtgatgccgcggccacccaatcggactgtatgtcatcggtgggaggctcctgaagggtgagggtgccggtcgtgtcgacatcgacgcggccgcccttgaatatgacggttttgccggttgcgattaccggcgtgctcccgatgacggtaaagctttcaacggtctgctgcttgccgtcggtcagcgattcgagggttttggccttggcgctgctgggattgtcaagacgcagcaccataccgtcggatggacggtatccgtagaccttgccatcgtgggttactgcgatgcgcccgccctcgcccagctttattttcggatcggaagtggtgggggtcacggaatcaaggttttccgacaagccggtccacacattgccggtcttctcgttgatcagggctgcggtatccccgccgaccacagtggtggtgttggctttgatgtcggtcttgacaccggtgctgaccgtggatgccttgatggtggaggctttggtcgtttcggtcaggatggtgtcgccattatgctgtgcgatgtcgaatcgtggggcggaggaggagacgccggcgtcagcctccttgttctttacgttgaatcgtgcggccttctggtttttcagcgaagtgacccatacggtgccatcgtccagttgcacatggcggcgcgtgacggtgctcatgatcaccgcgccggcaacaagtcccagaagcagcaggagcgtgattacgggaaccgtccacgtatgccctccggagggcataaggcggcgcaaagccgcgctgatgcgtcggcgacgatcgtatgactgggacgatgtggccatctgaactccctgacccctgttttctctggttgctggtgtaatgacaacgctttacggttccaatacctgccgttcctgttgtccatttggtgaattcgccgctgctgggcgcacgtctgatgcgatacgcaatgccagggtggcatgcccggcagtggcgagcggatcattcttgcggcttggccgcacaggcgatggcggggctgacggacatctggcggttcttgcgcacaatggacacctgaatgcaggtctgcgagccttcctgcgcgttgacggtcaccgtgggatctgacgttgtgacggtttgcgcgctctggtcggtattgctgccctgcactatggcccacgcataggtatcaccgctttgcgggtctggattcgtccaggtgaacgtcacggatgacccatccgccgcataggtgccgttcagattctccggggaaggaatctgggcgttcgcggtatcggtgatcacgtcatcctgattattgcggttgttgtcatcatccttggtgccgggcgtcgccacctgtttggtatctgatccggtggcgctgtccatgcggggaacgaccacgaaggcgaatatcagtgccgctgcggtgatcgccgcaagtataccgacggtaatacccaccggtttgacccatcgccgtgacgaacgggtgatctgatctcgctggtccgtggcccggcgccgacgctcgatgtctttgggataggccggcatcccttccacggtaacgggagtggcatgcccgaaatatgcgaattgcacacgctgcatggcacgtgcgaactccaacgcggagtagtaccgctggtcggggtccttgttcagggcccggcgcagcaccgcttccacatcggccggcacgtcggggcggttgaggcgaggcaatggctggttgacgatcagcgaaatcagttccgattgcgaacgcgggtgataatcgtgctggaatggcgagcagccgacgaacatggcgtacagggtggccgccagtgaatagatgtcggcggcttccgaaccattggtcagatgctgaagcacctcaggcggtgcccacggcggcgagaatccggtttcggtgcggtcatacacatcggtggagataccgaaatcacccagaacaggcaagccctgcgaggtgatgagaatgttgctgggcttgatgtcgtgatggatgatattgctgcgatgcgcggtgaacagcgcgcttgacagcttgatgccgaggtcgagtacctgctcgcaggtcatggaccgggccttcatgatgctgttgtaggtgccgcccggcgcatattcgatgacgatgtagccatggccatcggaggtgacgccggcaccatataccggcagaatgtacgggtgggatgacagcttggccatgaagttggcctcgcggttgaacagggcagcggcccgtgggtcaagggttttggcgctggcctttaccgccaccgggcgtgcgggcatacgctggttatataggtacaccgtggcggtggcaccgcttcccaacatctggacgaaatcatatccgggcagcttcggcggtctcatcggaatgttgtccatctgttccctccctccttggaaaatgcgctctccctgcattcgttctacaggataccgtcaagggtacgattcttcgtcgggttcggtaaaatttttccctctgtgacggtcgggtttaggctggagccatgatgacgagacttgaacctggaacagtgctggacggcatcgaccgtgatggagcggcgaggctgattgtcggcacgcctggaagcggcaaaactgaattcgccttatcggtgttgatggcggggctgcgccgctacggtggcacgcaggcggtgatggccgtatccggccgtgtggccgccgacgcattgggcaatcgggtgattcgtgagctcgggttttccgtgcaggccaggccggtcaccacgctgggtgccgtggcattccgggccatatcggcttcgcgcgagggaactggattgccgtcgcctcgattgctgaacggtgcggaacaggatgctttgctgcgtcaagtcatggccgtgcatctgcgccatgccgtagcgggagatgattgcggcacctgtgatttgctgcgcgtctactttgcccaggatgactgggcgagactcatacgcgatgccggtgccggcgagatgcccggctcggccgcttccgcacaatcaagcctctcgcaacaagggtcggattcgccgtctccgacgtcggcaggcggctcgaccagcgcggataggttcacgcgaggtatttcagatgcgtttatcagccagttgcgcgatatgctggcccgattggatgagctcggtgtaggcgttcacgaagagccacgtctcttggacgccgtgacggaggacgcgcgattgtcggtgcaatggcgtttggctttcgcgttgcgccgtgaatatattgcagcccaaagcgcggtatatccggggcaataccgtttggatgcctcgtatttgctggtggcaggcgctcgtgtggtgcgtgaggcattcgccgccgatcacgcggatgattccgaccggcctatgtgtgtggaggcgttgggcttgccccggctgctggttgtggatgatgttcaagacaccacgctggccggcatgcgcttcttggaggagttggggaatgccggcgtcaagttggtgctggtcggcaacccggatgaatcggtgcagaccttccgcggatcgtatccggaatatctgatgcgccgtgccgtggaagggcggctgaaggccaaggaagaacagctggttggcggtagtgccgtcgctgatcagtcgcacatgacgatggctgatgtgatcgcgtctcgtatttcgctgtcgattccctcgccggaagacgagccgctgcctccggccgagcgtcccggcaagctgaccgccatactgggcggagtcgatgcagcgaattatcaggcggacggcacggtgaccgccggcctgtaccgatcctcacgtgaggagctggatgatgtggtctggcgcatcaagcgggcgcatcttgaccggcatattcggtggaacgacatggcggtcatcacccacgacaatgccgccgtgcggctgttcggcgaacgactgcgccgagatggtgtaccggtgcggtattcgtcggtcacccgtcctttgaaggacgagactttcgtgcagggattgttcgcgcttgtggagcttgcccgattgcgtgccgaggggatggcggaatgccagatgacgttggcttcctgcgcggcatatataaggactagagtggccacgttgatgaacggcccgttggtgagtgccggggccaaacccggtcaggggcgtcccgcaaggcttgcgccgatcgaatcggccatggggtcgttggagtcgctggcgcatctcgccacggatgatgccatgctgacctctctgacgacggcatgggaaacattgcgtgaaacataccatgaaacacggcgtgaaacaggtcgtgaaacatcctcgtcagtggtttcgacgtcagcggtttcgtcgtcagtgacttcgttgccagtgtctgtcgaaatactcggtgaaccgtccggcgatgacttggcctttggcgttgacgcgctgtacgtgatgcttgccattgatgatgccgccgcgccggcgcaggctgcgctcgcatccatccacgcggtgctcggcaacgaccctcaggcccgcgcttttgcgaacctgtggcatctggtgggcagcgttgcttccggcttggagcggctgccggcaagccagcgcgtacagccgcgctatgcgctgtctgttgcgtggaacgccaccggtctggcaccggtctggcagcgtgcggcattattcaacacggcagaggggcatacggccaatgaccggctggacgcggcaatgcgcctgttccagttcgccgatgattccaccgccagtcgagacatcacgtcattcatggcacaggttcggggcatggaagtgcaggccgattccttggcccacataggaccggtggaagacgcggtgacattgactacgccggcaggcgcggccggacgccactgggaatatgcgtggataccggtggtccagcaagacgtgtggccgaacctcgccgggcgcaacaccatgttcggtggtgaagaccttgccgagctcgtgctgaggggagcgcttgaagaaagcgacaaaaccgggcatgatccgcggttcgcggctgtattgtcgggcgagaagaagagtttcctggtcgcgctgacccgtgcacggcgaatcatgatcagcgcggtatggaacgacagcatgagcccctcggactttctcttcgggtatctgccggaatactatccgcgcaaccggcaacaggcgcctttcaccacagtgggggcacatgcgggattcgccgaatatgatctggccggattggacgccgacccacgtgggttggtcagcgccgcccgcgcggttctggccactgctcaaccgcagcaggctgccgcaaaggacgccgcgattgcgttgacactcctgttagagcatggtgtgcgcgccgcaaatccgcagagctgggcgtttgtggaatcgccggcccaatcggatagcgcgtcatctggcggtgcgtcatctggcgatacctcatctgacagtgcctcatccgacagcgcgtcatctggtggtgtacagcctgacggtatccaaacagggaaaggcaagacggatgcgcaggccgcgcccatggtcaccttatctccatcggcggtcgacagcctatgggcgtgcccggtgtgctggatgctggagaaccggttcgccggtcctcgccccagctccgtggccaccagtttcggaaccctcatccatgcggttgcgcagcaaggcagcgaggaagggctggaccatctttcccacaatgcccaggcgttggccgcactgggcttggactccacggccggcgcggaacgtcgcatcgaggctgtctcggcacggcttaatgccatctatcagagcaaacgtcctgatccgaatgccatagccgacacccggaaccgctatgaggccacccgtaaggacgagtccgcggcggataccctgcgcaacatcgccgattactttgtgcgcagcgacgccgatccggaaacgtatcttggcaagaacttcagcaacttcagcattggcgcattggccggtgccgaatgcgaacgggagtttgccgcacgattcgatgtgcgtgacatactcgacgcatacaatgccgtgcccggcctgcacccaatcggtcggaacacgctggtccgtctgatgggagcactggtcggagggtggccggaaggcatggacgagcatctgaccgtgagactgtccgggcgcatcgaccgtatggaaacccgcgtactcgcagacggcggcgaatgcattcgcctcattgactacaaaacaggcagaacgcccacggtcaaacagattttcaatgatttgcagctcgtgtgctatcagcttggcctcgtgttccccgaagacgggccgcgcggtgccaaggcacttgccgcaatgccgcatatcagccaaagcgtgctattccatgtcgggcagaatgcggcaccagccagaagctacgctccggaaggtgccttccagccgccgctgttcactgatggctcgttgaatgccgaaccgttcacgccccgatactggtataaagaccccaaccgtttcttcgacatacccgccatagatccggctactcctcccgaaggtgtgagtgccgaagcgtgggcgcaattcgccgcgctcgccggtacgcagacgttatggtcgctgaccatgatcgcccgcgtattctatgccgcggcggccagcagatcagccatcatcgaggcccatccgcaagacacccatatcggattctgccgtatgaagaacgtctgccctgcctgtgcaggccagatcgacacgattttcgaaacgaggcaagcatgagcacgttcactcccagtgcggaacaggccgccatcatcgatgcgccagtcgatgctgacgtattggtggttgccggtgccggttccggcaaaacctttacgatgacccaacgcatcatcgcgcttatcaatcgaggtgtggcacctgaacgcatcctgggcctgaccttcacacgcaaggccgcaggcgaactgctggaacgcgtctccgccgcagtggccggtgatatggcgggctctacgaccgccacggtgtctgatcgggcattcctcaagccggccattttcacgtatgacgccttcttccagaccatcgtgcgccaatatggactgcttgtcggattcgatcagaacacgcaaccattgagcgcagccggagcgcttcaactggccaccgaagtcatcgacagtcacatggatctggcgttcagtgaggattttggcgccttctccagtttggcgaaccgtgttctggcgttgtcggatgccattggcagtgccatgatcggtgccggctgcaccagcttcgatgatgcgatcaatcgagtacggcaatgggattcggcattcatcaatcgattgcaacaagccgttgcagatgaacccatgcccgaggacgagccgaaaatccccaagatcaaacgactgaagaaagataccgacgccagctggcaagccaagctcgatgaccgtgccgaacatttgcacgcccgctgcacctatcattgcggtgcgctgctggagaccacacgcaaacgcgatattctgctccagctggtggaggcctatgcccaagccaagcgggaacgcaatatggccgaattctccgacttcaccattgccgcgtatcagcttatcgagcgcttcccctccatcggagagcgtacgcgccgcaggtacagccacgtgctgctcgacgaatatcaggacacctccaccacgcaggccgctctgctggcagcactgttccacgtggatgcgtcacagaggtccgccgtcaacgcggtgggtgatccgttccagtcgatttacgcatggcgtggtgccagccctggtgcattccgtatgttccagcaagatttccacctgtctgccggatacaagccattcccgctgtccgtcaccaggcgaaacagccgtatagtgctcgaagccgccaataatctcacgctgccgttgcgctccaatccgtcgcgtccttccagctcattgatgcgtgaggtcgatgtctcatcgctcgaccccatgcctgatgcccccgaaggaacattgggagtactgggcttcgccacggccgggcaggagatcgacgccgtagtgcgtttctgcaagacggccatcgcacggcaccgttccgcagccgaacaacaggaacagatgccgggcgaacagaaagcgccggtcgccgtgctgtttcggtccaaatcacatatgcccgaatatcaggcggcattggaacaggccggattgaccacattcgtggtcggctattccgcgctgttggaacgtccggaaatccgcgatctgatggcgttgctgcacgtggccgccgaccacaccgatacgggatcgctgatgcgcttgctggccacgccacgattcaccatgtccgcagcggatttgaccatgttggcccgttttgctgaagaacagaacacggaacaacgcttccaagcattggtgcaggccggccttgcccaaccggatacaccagcgaatgaatgggcggctgtggtgcgtgagtaccgcgatcaggtggccaatgcggtattcctgccagacgtattgctacgcggcgacctggtaaaactgcttgaacggttgagcgcacacgggcgcaacgccataacccgggccgcggtgatgctccgtcaggtgcatgatgccgtcgggcggccactgggcgacgtgattcgcgccggcatagaagcgttggatcttgacatcgacaccgtattggccggtgtgctgcataatccgcagcaccgcgccaatcccgctttggcgcatatgcctatggatgcgattgtggatttggtggatacgtacacgcaagagattgccgctgagcaaactccctcgttgcatgggttcatcacatgggtggatcatctggcttcggtggaggatgaagccgccagtctccctgacgctccggtggatgtggaactgatgaccgtacaccagtccaaagggttggaatgggatgccgttgcggtagtggggcttaccgccgtcggattccccagcaatcagggcgaccatctcaagatcgtgctggacgagcaccatacgggaggcaccgagcaaggtcactggaccgcacccgaatatcatgagaccgccgactcctggctcaccaaccccaccgccgtacccgtgcctatgcgtgccgatgccggcattctgccgcgattcccccatgatgccgatgtggaagccgaccccatcgcatcgttggcggctttggatgatgtggagcttattgatgatgaagtgttcggctccatgcgcgaattcggcgatggcgtggaagaagtggatgcatccggctggtatttgacgcaggcggaggaatatgggcgccggctgcatgccgacgaacgtcgattgatgtatgtggcgcttacccgtgcgcgagaagatgccctgatgacctattgcgcctatacgggcgaatccgggcgggacccgtcagtggtgcccaaaggctctcgcgccgctcagccatccaatttctggcttgaagtgcatgacgcgctccaagcccgtgaacatgcgatatcggctcaggactgtgtggaacggctgcaagccgccaatgccgggaagcccatgctgatctcggcgcaaggcgaagcgattgccactcccgaagggttctttatcggagagcatgccgcggcatacggtgacgccgtggtgggggaggcatggcagacgccgattacgcagacggatgccgctgtcgaattgccgtggccggctaccctcagcgacgcagtgcatgaacagctgtcacgtggcatcgatgttatcgccgcagattcctcgtcacttgagcagcaccaagacgccggtccactgctgcaacgggcgcaattgctggtggacgacgccgatttgatggccgatgccgccagcggccagtcgcttgatgaggcagtcaaagccaaggcgcaacgcgttctggctgcaggacgccagaacgtgacaagcctgcaagcccgcgtaggtggcatgaacgaacgggaggagcgcctctactggcgtagcattatccgcccgattccgcgcatatcgtctccggcggccgaggccggcacgcagttccatgcgtgggctgagcaattcatcaatgccggtaagccggatgaagcggtactggcatatgaagccgaatcaagtatgccgcatacaggtcaggatgcgggattcgtttcccgggaagccatgttggccgatttggccgaacgggagcggcaatgccgcaagccatccacacggcagcccgctgtcccacagcccacggctcaacaatccgcatccgccgtatccgccgcctccgccacttccataagtagcgacaatgccaccgagtccaagctggtggcgtggcagcgcagactggccgaatcatcgtgggccaagcgcatcccggcgtggacggagcgtgccatcgtcgtggacgtgccgggcgtgggcctggtcaatggcaaactcgatgcggtattcatcggtggacttgacccgtccagcaccaccgcacgctttaccgtggtcgactggaaaaccggtcgtcggcccaccaagccagacgacatcacccgcaaactcgcccagctcgacatgtaccgactgctgctggcagcggtcgaaggtgtggaattggacagtatcgacgccactctctactatgtcagtgagcccgacgagggcttgcgcgagcttcacgcccgcgcgaaaaccaaacaggaaatccttaccgagttgagctccggcattcccgaacaatctgacaacgactgagcccaaaggctcatgacctgtacagcatcggacggccttcaccggcggagagaccttatgcatcgcaaggcatctccgacgatgaagacgactggccacgtaccggtccgcggttgaaacgcgccgcgtgacgttgcttgggaaccgctacccctcggatggcacgtgtgggcgggcgcacgtgccggacaacgcaccagtaaggagttattgtgtccacgactcgcgcggtttcgaagtcgtccgctgcccactcgccctatcagcgcctgttcatgctgcccggagccaaggcgttctgcctgtccggtgcggtggcacgattgccgatctccatgatgagtctcggcatcgttctggcgctcaaccatctctacgacaattggaccatcgccggcaccatgagcgccgcctatgtgctggccatgagctgcgtcaccccgttctacgcccgcgccttcgaccgtttcggccaagcccgcgtgggccggcttgcgctcgccgtgcagatcgtggccatgctcgccttcgccttcgcggcgttggtgcgcgtgccgattccgctgctgttcgctttggccatcatcatgggtctgacgcagttctcattcggcgcattggtccgaacccgttggtcctatgcgttgcgcggtgtggaagatggcgaacagctgctcaacacggcctacgccatggaagccgccattgacgagatcgtctttattctggggccgattctggcggcttggctggccacctccgtgcatccggtatcccaactgttcgtgcccaccgtggcatgcggcatcggcggcaccatattcttctcgctgaaatccacccagccgccggtcatcgtggaacaggtcagcgtggccgcgcacgatgacggcagccccgctgcaagcgaagatgccgaccagctgaccctgcgccaactcaaacgcagcggtgccaagcccaagagtgtattgctctatgccggcgtactgccgttgctcgccgtgttcatcgtgttcaatatgagcttcacgtccttcgacgtgtccattaccgccaccatgaaatccatgggacttgagcccttcctcggtctgcaattggcgatgttcgcggtcggctcgtgcatcggcgcgctggtgttcggctcttgccaactcaaaggctcccattgggcgcatatggtgatgttcctgtcgctgctgaccgtcggctacgtgttcttccggttgtcaatggacaatctcatcctgctgggcgtcttcgaaatcctcgccggcctgaccgtctcgccgacgttcgccaccggcaacctcatcgtcaaggatctggtgccggcggaatccctgaccgaaggactgagctgggtaaccaccgcaggcacggtcggcacgtcgatcggctcgtccgtggccggcattgtgcttgacgcctccaaccctcatgtgggcatgatgctgccattcatcttcacgctggcgtccgtgccattggcgttggccggatgggccttggccaagcggcgtgggtgaaacgggatcgggctacgcccgatggatggttggcggcttcgccggggtctctccctcagtccgcttcgcgtccagctcgaacgcaattaatgatggctttcagccaactgaattattgctcactgtcgttcgccctcacctaaaaacgcctccggcgttttcttcacggttcggctcatcagagggagctcgacttcacggttcggctcgtcagagggagcttgattctgtggacggggtattggcgtgaggggcctgcggtgataggctgattgccgattggaaaacgtcccgggtacattgccgggcaggtacgggtagacagggaagaagacatgatcaaggtttcggtggtcggagcaaagggccgcatgggctcgcacgtggtcgaagcggtgaacaacgccgaggatacgcagctggcgctcgcattggatgccggcgacgacctgacccagatcaccaccgacaacaccgatgtggtcatcgaattcaccgtgccgtccgtcagcctgaacaacgtgctgaccctgatcggccaaggcgtggacgtggtggtcggcaccaccggctggaccgacgagaaactcgcccaggtcaaatccgccatcgccaacggtccgaagcccgaaacccagaaggtcttcatcgcacctaacttcgcgatctccgccgtactggccgactactttgccaccaaggccgcgaaatacttcgaatccgccgaagtcatcgaactgcaccaccccaccaaggtggacgccccctccggcaccgccatccacaccgcccacggcatcgccgaagcgcgtaaggccgcaggactcgcccccgtgccggacgccaccgaaaccgatggcggctcacgcggccaggtggtcgacggcatccacgtgcacgccgtgcgtctgcgcggcctcaacgcccacgaggaagtgctcttcggcaatgccggcgagcagctgaccattcgggccgacagcttcgaccgcaccagcttcatgcccggcgtcctgcttgccgtgcgcaagctcgccggcgacgctccggctggcctgaccatcggcctcgaccgcttcctcgacctgtaatcgacccgcagtcgaccagtagtcgcccccgcatttcaggcagggaagcgcgccgggacgcgcatcacggcattgccaccggctccggccataatgccacgcattcagcaacaatcaaggtacgtagtataagagtccacaatgggaagtacggtgaacactatgagcgagcatgacatgcaccttcttgattcagcacctttcggccgcattctgccggctatggtcaccccgatgcaatccgacggcagcgtcgatttcgccgccgcgcagaagctcgccaaatacctcgtcgccgatggcgcggatggtctggtggtcaatggcaccaccggcgaatcgcccgtcacccatatggatgagaaggtcgagctggtcagggccgtcaaggaggtcgtcgacgttccggtgatttccggcgccggctccaacgacaccgcacacaccgtgcgtatggtcgaacagactcaggaagcgggcgccgacgcggtgctcgtcgtcatgccttactattcccgcccctcgcaggacggtatcgtcggccactacaaggccgtcgacgaatccgccgaaaagccgatcatcgtctacgatgttcccggccgtaccggcttgaaggtcaaggtcggaacctacgaccgactggccgaacttgaacacgtcaaggctgtcaaggacgccaccggcgatcttgcagccgcagtggagaagcagcagcgcaccggcctcgcctggtattccggcgatgacggcctgttcctgccgttcctctccatcggtgccgtcggcatcatttcggtgattgcccacgtcgcctccaaccccatgcagcagcttgtccaggcattcgatcgcggcgatatcactaccgcccgtcgcctcgccaaccagctcgccccccttgtccacgcgttgaatggcgacggctatcaggccgtcatggccaaggctgcgctcaaggtcaagggcgttatcccctccaccaccatgcgtctgccgaacatcggtcccgacgccactcagcttgacaaggctgaagagggcatgcgcgctgccggactgctgtaagcccgaaacgctgcatacgggttgccagcccgccgcccctgcatgacagagcagaggcaccacaacagaaatcccaaaaaggttatggcacaagaacaaaagaaaacaagcaagaacacgaattctcgccgtcgcggttccgcgcgcggccgcaacgccaacggatccaacagccgtacgccgtcccgtaagatcaacgccacccggcaggccaccgcaccccagcaggatgccgtgctgatcgccccgccgaagtaccgcaagggctccatgcgcatcacgccgctcggcggcttgggtgaaatcggccgcaacatgaacgtgatcgaatacaacggtcacctgctgctcatcgactgcggcgtgctcttccccgaggaggagcagccgggcgtggatctcatcctgcccgatttcagctacatcaagaaccgtctcgacaaggtcgacgccctggtgctcacccacggccacgaggaccacatcggcggcgtgccctacctgctcaagctgcgcccggacatcccgctgatcggctccaagctgaccctcgccttcgtggacgccaagtgcaaggaacaccaccagaaccccaccaaggttgaggttgccggccgtgagaagctcaaggtgggtcccttcgacctcgaattcgtcaacgtcacccactccatcccggacgccctggccgtctatgtcaagaccccggccggctccctgatcgacacgggcgatatcaagctcgaccagctgccgctcgaccaccgcatcaccgacctcgtcgaattcggcaagatcggcgaaaagggcgtggacctgctgatgatggactccaccaacgccgaggtgcccggcttcgtcaagcccgagacctccatcggcccggcccttgaccaagcgttcgcccaggccacccgcaagatcatcgtcgccagcttctcctcccacgtgcaccgtgtgcagcaggtggtggacgccgcccacaagtacggccgcaaggtcgtgttcgtcggccgttcgatggtgcgcaacatgtccatcgccgccgacctcggctacctgcacatccccgaaggcaccgtcgtggacctgaagcaggccaacgacattcaggacgacaagctcgtcttcatgtgcaccggctcccagggcgaaccgatggccgcactcggccgcatcgccgacggcaaccaccgcgatatccacatcaacgagttcgacaccgtgattctcgccagctccctgattccaggcaatgagcacggcgtctacaaggtgatcaacaagctcgtgcagctcggcgccaaggtcgtcaaccgcgacaacgccgccgtgcacgtgtccggccactgcaacgagggcgagctgctgtacatgtacaacatcgtcaagcccaagtgcgccatgccgatccacggcgagaaccgtcatctggtggccaacggcctgatcgccgtcaagaccggcgtggacccgcagaacgtggttttggccgaagacggcgatgtggtcgacctgtatcacggcaaggccgcggtcgtcggctccgtgccgtgtggttacgtgtacgtcgatggcgattccgtcggcgagctgaccgatgacgagctggaaaagcgccgcattctcggcaccgagggcttcgtctccgcgttcgtggtggtcgacaccgacaatcacgaggtcgtcaccggcccgaagatctacctgaatgccgtggccgaggacgaaagcgagttcgacaaggtgcgtcaccagatcgtcgaacagctcaacgaccagatgatgcagggcacgcgcgacacctacaagctgcagcagaccatgcgccgcacgctcggcagctgggttgcgcgccagctgcaccgcaagccgatgatcgtgcccgtcgtggccgacatcgcccaggacgtcgaaaccgtagaaaccaagtagtccggattatccagggacgaccgtaaggagtaattgaagtcatgcccggttctaatctcactcgtattgaagccgaagaacgtaaggccgttatcgaagcgccgattcactatcacgtcgaccttgacctgacggtcggcgcgaagaacttcggttccaagtcgttcatctgcttcaacgcgaagcctggttcgtcgaccttcctcgacctgatcgccgacgaagtgacctccatcgacctcaacggcaagtccctggacccggccgtggccttccaggacaaccgcatcgaactgaccgacctcaaggagaagaacgaggtcaccgtcgaagccaggtgccgttactccaacactggcgagggcctgcaccgctcggtcgacccgtccgatggcaacatctacctgtactcccagttcgaggtgccggacgctcgccgcgtctacgccgtgttcgaccagcctgacctgaaggccaccttcgatttcaaggtgctcgctcccgccagctggatcgtcacctccaacatgccggttgccaccatcgaggacgatccgcgcgaaaccctcgacggcaccctcggcgacaagccgaacgaaagcacccgtctgtgggacttcgagccgaccccggtgatgagctcctacctgaccgccatctgcgccggcccgtacgccgaatggcacaccgaatacctgaacgaagacggtcgcaccgtgccgatggcccagtactgccgacagtcgttggccaaggccttcgcgaaggacgtcgactacctgttcgacatcaccaagaagggcttcgcgttctacgccaagacctggggcgtgccctacccgtacgccaagttcgaccagatctacgtgcccgaatacaacgcgggcgccatggagaacatcggcatggtcaccatccgtgactcctacgtgttcgaatccaaggtgaccgacgcgctggccgagcgccgcgtggtgaccgtgctgcacgagcttgcgcacatgtggttcggcgactatgtgaccatgaagtggtggaacgacctgtggctcaacgagtccttcgctgaattcacctccacgctggccactgctgaagccaccgaatggcacgacgcctgggccaccttctgctccggtgagaagagctgggcgttgcgccaggatcagctgcccaccacgcacccgatcgtcgcgccgatcaacgacctcaacgacacttacgtcaactttgacggcatcacctacgccaagggcgcctccgtgctgaagcagctggcattctacgtgggccgcacgcagttcttcgaaggtatccacaactacctgaaccgtcacgcctactccaacgccaccctggccgacctgctgagcgaactggagaagacctccggccgcgatctcaaggcctggagcgccaagtggctggaggaatccggcatcaacacgatcgccactggcctgaccgtaaacgcggacggcaccatcgccgaactgaagctcacccagagctcgccggccgaacacccggtgctgcgcccgcatcgactggccgtcggcttctacaatgaagacgccgcaaccggcaagatcgtgcgcaccgagcagttcgaactcgatgtagatggcgaaaccaccatcgtcgaggccgcagccggcaagccgcgcccggcattcgtgctggtcaacgacgatgacctgacctacaccaagattcgtttcgacgccgaatcccaggcattcgccgaagccaacctgcatcgtttcgatgatgccctggcccgcgccgtgacctggctcgccttctgggatatgacccgtgacggcgaattcccggccgaacgcttcgtggacatgaccctgcgtcttctggccacggaaaccgaatccaccaccttccgttacgcgctggcctgcatgagcaccaccgcccaccactacgtggcgcccgcccgccgcgacgatgtgctgcgccacgtggccgccgaactgtggactctggccaacgccgccgaagccggctcggacacccagttccagctcgtcaccgcctacttgggctacggtgaggagggcgacgccgcattcgccgccaacgcacacggtctgctggacggcaccgtgcgtcttgaaggcctcgaaatcgacaacaacttcacgtggaccatcgtccaagcgctcacctccgtcaacgagatgaccaacgacgacgtggacgcgcagctcgccaagaaggagaccacggaaaaccgcgagttcgcctacggcgcccgtgcctccatggccaccgctgaggccaaggaatgggcttgggatcaggcgctccacaacgacgagctgaccaactcccagctcgaggccgtggcccgtggcttctccgccaccccgcgctccgatctggccgagccgttcgccgccaagtacttcgagactgtggactgggtctgggccaacaagacctaccacatggccgacgccctgctcaacggcctgtacccgggctacgccgatcccgccacgctggtcaagctcggtgacgcctggctggacgagcacattgccgccgacaatgccctgaagcgtctgatcgtcgaaaacgtggcatcctcccaccgcaccctcaaggttcgcgaatacaacgaagcgctctgatttccttctggctcccctcgggcgcgaggggagctgtcgcctcaggcgactgaggggagtcgcttccgcgagaagctacgtccacattccaacataaaacccgcaaccaatcctcaacagcgtattctcgctcaaggccggcaatatgccggtcgatgagcgacaaggatacggggaatgattgcgggcttttccataacttcattactgctgattctgttggccggaatcggcgcaggattcgtgggctatgcggtaggcgcatcgtcactggtctcatacccggccctgctcgcgttcggcattccgcctgtattggcaaacgcttctaacaccgttggcgtggtcggcacgggcatcggtggcgtgatgggtgcgcgcaaagaactcaaaggccaagcggtacgctccattacgtatgtggtcatcggcgcattcggcggggtggccggtgcgtttctgttgctcaaactcgacccgagtgtctttgaatttgccgcaccagtgctgattttgctgagctcgctgatcatcgccatcaatccgcgcggccgcatgcaggccaagcaagccgccgcggatgccaccgcgcaactcaagcacatcgaagccactgaagccactgaagccactgaagccactgaagccgccaagcgcgcaaccacccctaccgcacctcaccgcccgccggaacaactcgtgcagcccatgagtcaggattcctggtgggtatggctgggcgtagcggcggtcgccatctactccggctacttcggcgcgggcgccggtaccttggctctcgccgtgcttgatgccgccaaaatcggcccattccacaagatcaatgcattgaaaaccctgatcggcacaggcgcgaacatcagcgcctcagtggtattcatcatccaaggcgcggtcgattggccggccgccatcatgctgtgcatcggatgcttcatcggcgggtacatcgccccgtccatcacccgcaagattcccgcaaacatcatgcgcgccgccgccgtaatcgccggcatcattcttaccatcgatctggggctcaaaacctattgattcgtgccttacactgatgcagtgaagcatacagcatggccgtcaaccgcagcgtggtcgcagaccccgataaggtggccaatgtctggcatttggcgactgcggaacctgagcgcctagaaaccagcgcggcaggcgaagcggtgaacgacttcctcgatccgccagacacgtcgcagattcacggcattgcgtgtcatgctgattggcggttcgcggcgcgagcaggtgctgttcgccggcgttatgaaggagctactcgcgcccatcaacaatccgcgatatgtcatcatcggtaaggaatggggcgtgcgcgcttactgcgtgagcttcccctgcccgtccgtatttgcccgccgccagcaggacgccgagatactgagccggcagttggaccgctgcctgacgcattgcaccatggtatacgcccgcactgaggaaggtcggcatacgctacttcgcagccaaacgcgttctttcctcaaccgcgacgagcaactgccgcacatactgaccacaacatcggagtaatagatcgttgcattcatggccgagaccaccccggtagaggagatgccgttgggcatgttcatcgcatggctcagcgtgttcctcgccgtcgttctgtttggtgttgctttgccggttatcgatgtacgctgggtagttccgttcgtcgtatttgccgctgtattgtttacaggcgcgtttgccggcccgttcttactagtgcgatggcttcgttcccgtgccggagtgcatcggtccgcccggcatgcccgctaacgaatgtatctcatcattcatccgccgaacaagatgaatatgcgggtttgtgggtgatgccattgcggctgttgaatgctgatttccggttctggagcagattccgtggcggttttttgccgagtcgggtcctagggtggagcacaacgactacgatggtgcgggtaacgcgatacaaggagtggaacttcatatgccgaagatgtttggaaccgatggtgttcgaggactggccaatagggatttgaccgcacgtctggcgttggatttgggcgacgccgccgtgcgtgtgctcggtgacgccggtacgcaggacgaccagcccgagggccgccgccgtgcgctggtgggccgtgatacccgcgtttccggtgatttcctggcttccgcgctgtccgcaggcatgtctgccggcggcttcgacgtgatcgatgccggcatcatccccactcctggcgtggcctacctgacctccgtgctcaacgtcgaaatgggtgccgtgatctccgcctcccacaacccgatgcccgacaacggcatcaagttcttcgcacgcggcggcttcaagctgcccgaccagaaggaagacgacatcgaggccgtgctcggccaggactgggaccgcccgaccggtgccggcgtgggccgcgtgagccacgaccagaccaccgccaccaacctgtacatcgatcatctggtggccaccatcgctccgctgaacgatgacaaaacccagcccaagccgctcaagggcctgaagatcgtggccgactgcgccaacggcgccacttccgtggtggctcccgaagccctgcgccgtgctggtgcggatgtaatcgtgatcaacgcctcgccggacggctacaacatcaacaagaacgccggttccacccaccccgagcagctgcaggccatggtcaaggccaccgatgccgtgatgggcgtggccttcgacggcgacgccgaccgttgcctcgccgtggacgaagacggcaacatgatcaacggcgaccagatcatgggcattctggcccgtgccaagcagcgcgaaggcaagctcaaccacgacaccctcgtggtcaccgtgatgagcaacctcggtctgaagctcgccctgaaggacatgggcatcaagaccgtggaaaccgccgtgggcgatcgttacgtgcttgaggaaatgctcaagggcgattactcgcttggcggcgagcagtccggccacgtgatcaaccgcgaattcgccaccaccggcgacggcaccctgaccgcactgaccctgtgcaacgaggtcgtcaagtccggcaagagcctgaaggagctcgccgccgacttcccgcagctgccgcagaccctcatcaacgtgccgaacgtggacaagaaagccgccgccaccaacaagcgcatccaggatgccgtggcccgcgaggaggaactgctgggagacaccggccgtgtgctgctgcgcccctccggcaccgaaccgctcgtacgcgtgatggccgaagccgccacccaggcctacgccgacgaagtctgcacccgcctcgccaagatcgtcgccgaagaactcgcgctgtagcacccttccctaaggaaaagcaatgtttggaaagaacgccaaagtcaacctcgaactcaaccgtgatgtcgaacaactcatcaaaaccggcggcaaggagaagctcctgcccatcgtgcaggccggcgaaccggtgttgcgccaacggacggtggcctaccatggccagctttccaagcgtacgctcgccaaactcatcgatacgatgcacaccaccatgctggaggcgcccggcgtggggctcgccgccacccagatcggcttggggctcgcgctcgccgtggtcgaagaccacgtgcgcgacgacgaggatgatccgcgcgaaatcgcggaattccccttccacgtgatcatcaatccgagctacaaacccaccagcgacaaaaccgcctcgttctacgaaggctgcctgagcttcgacggataccaggccgtgcgcaagcgttggctcgacatcaccgccgaatgggatgatgaagacggcaagcaccacagcgagccgttgcacggctggcccgcacgcatcttccagcacgagaccgatcatttgagcggtgaactgtatatcgatcgcgccgaaatccgttcgctgaccaccaccgaaaacctcgaggattattggtgcgacgacccggtacccaccgaggccgccgaagaactcggcttcgcactatgatcgaccgcacatggctggacgccgccaagggagacattccccaatgggcggcgtccatgcccaaagacgccgacggcaccaccatcgactgggactgggtgcgttctctggacctggcgcatggcgtcggcacaataccggaatccaccccacagtccatccacgacgcattgaagatcgattacgccacacgcgagcatctggaatcaatcatcgcccaatgcaacagcacattcatgaccgattacgatcgattcatcggctcctatcgtctgcctcgcgcgctcgcctacgccaatcgtcggctcaacgacaacatcaacacgctgttgcgtctgggcgaacagcaacacctatgggtggtcagtcgcgaacggcgggggaggactaccgttgccgtgctcaggccgtactccggcagccgcccatcgaacgatgaccaaggcatgctgaatctgagcggtgaaaccggtgacgcatctgccggaaacactgctgccgaaaacagcgatgtcaagttccccacaacagtcgccttggacgatatccaagaccgtacggcggcgattcttgacgcacgcgccgaacgacgtaaggcccagcgcttccagaagcgtgcgggcgatgcggcgatggcccgcgccaatctctccggcgcgacttcgccgggtggtgccgcctcgtctggcaacgctaccggccaccatcccaagcccgactggcgcgacgcctatctgcccggccgcgacgtggacgcggtgatgggcatcgacatcgaaaccaccggcatcgatccggcgcgtgactacatcatcgacgtcggcttcgagttcatgaacatggccagtccgcgcccggccggcgaacctgagacatacgcctatgagcagggctattacgccgccggcgacgcctacggccagtcccgcctcgcttttggcgtgccgccggaaaacgcggcgctcggcaacgccctcatcgccaaactcaccggcatcgatgtacgcggccgcagcagcgaggccgggtaccgactcttcgacgaatggccccaagcccaggccggcctgctcgcgcggcttacccagcagccgtacgtggcgcataacgccaccttcgaacatagctggttcatgctgaacgtcgccggatacgcggaaagctaccgcgccgggcgcatcaccatcatcgataccctgccgatgagccggcagtgggaccccggcgcggtacccaccaacgagcatccttacggagacaacacgctcgacgcctacgccaaacgtcagggcgcgcttgattccgcccacaacgaacgccacttgggccttgaggattcgcacatcatgctggtggccatgaaacaccatctggcggcgctgaaagcgcaaaggaaagggccgtgggggcccgccggcagggctggcgtcggcggcaagtcctgcggtcgtaagcggtgagtacactattggtctcgtgagtaactatcaggacggccgacagcagcgtgagaaccgccgccgcaccatcgtgcgtgtggtgtgtgtcgtcatagctgtggccatgctcggctccctgatcatcccggcgatttacgcggggctttgacgttgccttcgcatattcgtgcccgcagttgaacacgtctgatgcgagggatttgtgaggtcgcccggccggctatcggcaaggcaggcccggaaccttctggcagcatggattgcaggcggatgcgtgtgtggcgcggcaatgcccgccaacgccagaggaatgtgcgaaggctgtcaacaaggacgtgacttcccaaagaatctcaaagaatcaacagtaaggtaaaccacgatggcagaatttgactttacccaggcgatcggcgaagcccgcgccaaatacgaatccatcgccaaggcgctggacgtcgaccgactcaaggccgatatcaaggatctcgaaacgcaggccgcggccccgggcctgtgggatgacccggaaaacgcccagaagatcaccagccggctgtccgccgcggaatcgcagctgaagcgtctgaactccgcctcccagcgcatcgacgatgtggaaacgctcgtcgaactcggccacgaggagggcgatcaggactctctggacgaggcgcaaagcgaaatcggcgagatccagaaggatctcgaccagatggagattcagaccctgcttgacggcgaatatgacgaacgttccgccgtggtgaccatccgctccggtgccggcggcgtcgacgcggccgacttcgcgcagatgctgctgcgcatgtacctgcgctactgcgagcgtaacggcttcaaggccaaggtcatggacacctcctacgccgaagaggcgggcatcaagtccgccaccttccaggtggacgccccctacgcttacggccgactgtccgtggaaggcggcacccaccgtctggtgcgcatctccccgttcgacaaccagggtcgccgccagaccagcttcgccgccgtggaagtggtgccgctggtcgaggccaccgatcacatcgacattccggatacggacatccgcgtggacacctactgctcctccggccccggcggtcagggcgtgaacaccacgtactcggccgtgcgcatcacccaccttcccaccggcatcgtggtgaccatgcaggatgagcgttcgcagattcagaaccgcgcctccgccatggccgtgctccagtcccgactgctcgtgctgcgccacgaggaggaggccaagaagaagaaggagctcgccggcgatatcaaggccagctggggcgatcagatgcgctcctacgtgctgcacccctaccagatggtcaaggatttgcgcaccggctacgaaaccagccagacccaggccgtgttcgacggcgacatcaacgcgttcatcgaggccggcatccgctggcgccacgaacagcgccgcgccgccgaaaccgaggagtaagcagcattatggcgctgatctcactggacaatgtgtccaagatctatcccaaaggcacccgaccggcgcttgacgacatcaacctcgatatcgaacgcggtgatttcgtgttccttgtgggtgcgtccggctccggcaagaccacgctcttgagcctgctgttgcgcgaggaagaggccaccaacggcgagattcgcgtggccggcaacgatctgcggcgcatcaccaaccgtcaagtgccgcagtaccgccgttcgctgggcttcgtgttccaggattacaagctgctcaataacaaaaccgtgtgggagaacgtggcgttcgcccttgaggtgatcggcacacggcggtccaccatcaaatcgttggtgcccaaggtgctggataccgtggggctcaccggcaaggaaaagaactacccgcatgagctctccggtggcgagcagcagcgtgtggccatcgcccgcgcctacgtgaaccacccgcagattctgctggccgacgagcccaccggcaacctcgacccgaccacttcgctgggcatcatggaagtgctggacgccatcaaccgcaccggcaccaccatcgtcatggccacgcataacgaagagatcgtcaactcgatgcgcaagcgcgtggtcgaactgcacaacggcaagatcgtgcgtgacgaggctcatggctcctatgattccgccctgttcttcccggatgccgaagtcgaagccaagtccgacgccgcccatcatgtgctggcggcggcgaccaaggccatcgagggcagtgacgagccgtccgaaggcatcgcccgtctggccaactccgtgcattccggccgcaccggccgctatggcgagacgttcgcgccgctggaagacacgctgacctggggcaagggcatcccgttggacgagcaggccgccgccctggaaagcacccaggcgttcgacccgttcaatgacgagtccggcgagaccgccgcggttgccgatacgtccgtgtcatccgccgccgagccgccggccccgccggaaccgcccgagccgccggccccgccggaaccgcccgtaccgcctgtcggcgagcagtccgccgcagaccaaacatccgacgatcaacccgctgagggcgcgaaggagtaagggggatcatatgcgagcacgattcattctgtccgaaacgtgggccaacctcacccgtaacctgtcgatgctgctgtcgctgacgctggtcaccttcatctcattcctgttcatcggcgcttcggtgcttactcaggcgcagatcaccaaagccaagggcgactggtacgacaaggtcgaggtcgtggtgtggctatgccccgacggcaccagccaatccgcgaactgcgcttccggcaaatcgccctcagccaatgagatcacggcactgcagaaaaccattcgcgacgaactcaacgacgtggtctccaacattgactacgtcagcaagcaggacttctacgacagcacattcaccaagcagtacccgaatggcgaattccaaggccgtacgctgaccgcggacgatatgcaggactctctctggctcaagctgaaggatccgaccaaatatcaggtggtctccgaagtgctctccggcaaggagggcgtggaagacgtcaccgaccagcgccagatcttcgacccggtgttcgccgtgctcaaccgagccacggcggttacggccgtgctcgccggcgtgatggtggtggtcgccatcctgctgaccggaaccaccattcgcatgtccgccgcgtccagacgaaccgaaaccgaaatcatgagatacgtgggtgcctcgaactggacgattcgtctgccgttcattctggagggcgccatcgcctcactgatcggctcggtgctctcgtgcctgatgctttcggccattgtgaacgtgttcatcaccggctggctggcgaaatccattacatggattccttatgtgaatcagctcacggtactggtgatatcgccgttcctggttgtgggcgcgatactgctgtccatcatcgcttcaaccatttcgttgcggcgttatttgagggcgtaacgcgaccggcttacccgcgagaaatgtgatgacatcgtgtgcaagcctctcaggttcgcatgttatggtattggcttaagtgagcgaaaggaccattcacatatgacgaatgtacgtgtgatcaagcccgcactggcggcattggtggccgccgcagcctgtgtgggaggtctggcgttcagctcgtcccaacctgcccaggcagacacctattccgacctgatcaatgcgcagaaccagcacgccgcgtcggtacagcgcgaggccgaactcaagcagcagttggccggtgtcaaccaggaactggcggataaggtacttgagctggatgatttgacgaacaacaagattgtcgccgcccagaacaaggtcacgcaggccaacgaggatgccgccaccgctcaggacgaggccgacgccgcatccgaacgtctttccgccgcacagaaagacaaggagacgctcgaggagcagatcaagcagaccggcaaggactacgatgacgcgcacgccgccgtggcccagctggcccgtgacgagatgcacggctcgaatgcttccgacgtgatgagcgtggtcacgggtgccaccagcacacaggacttcgtcaactccatgcagtcccgggacgcgttgtcccgcaacgaggcgaatgcggcttcctccgccgcgaactcgctgagcacgtcgaagaaccgtggcgaacgtctgtcggccatcgaaaagcagatcgctgtgctcaagacccaggccgatgagaaggccgcttccgcgcagaccgccgccgaaaccgcgcaaagcgaacgtgacgctttggacaagctacgtcaggaaggcgaagcaaggcgtaacgaactgtcttccatgatcgacagtctggattcccaatccgccaagcaggcggcccagaccgtactgatcgcttcccagatcgattcctacaatcgtcagtaccagaaggagcagcaggacgccgccaaccgggtggacaccggtaaccagggcggtacgccgaccactccggtgactcctactcccactcccacaccgacgccggcccccaccccgacggttcccggcggtggcggcagtagcagcggcggccaaggcacgtcgaacggtgattacggcaacgcctatgccaccggccagtgcacgtactgggcgtatgaacgccgtaagcagatgggcattggcacgccgtcctatctcggcaatggcggcgactggtggcgcaacgccccctcgtacggcttgcgcgtggaccacaaccctcaggtcggcgccgcgctctccttcctgcctggtcaggacggtgccgacggtacctatggccatgttgccgtagtcgaagccgtgtatggcgacggcacattccagatctccgaaatgaactggggtggtccgtggaacatgcaccaccgcaccttgaccaatttgggtcagtactggttcgtccactgaccggttggttcggccgatatatgcggttgaagggttcctcttgaagaggaaccctttttcgtattcgaggccggtccgtgatatcgtcggatgttgcgttgctacccacgagttgctacccacgagttgttgcccacgaaaggaggagacatgcccaaggaaaccggtgagaaactcatcgtccagaacaagaaggcccggcatgactatgccatcgaagacaagtacgaggcagggctggccctgaccggcaccgaggtcaagtcgttgcgcgaaggccgcgcatcgctgtccgaggcgttcatctccatcgaccgccgcggcgaaatgtggctggagggcgcgaacatccccgaatacctgaacggcacatggaacaaccatgcgcccaagcgcaagcgcaagttgctgctgcaccgactgcagatcaccaagctcgcccgcggcatcgaggccaagggatacacgattgtgccgctgagcctgtacttcaaggacggtcgcgtcaaggcggagatcgcgctggcccgaggcaagaaggaattcgacaagcgccaggccctgcgcgaagagcaggacaagcgcgaagccctacgcgccatgcgctacgccaacatgcgccactagtcccgccccttggctcccctccggaggggagccaagggtaggatgtccgcgttgtgggtcatttcgcccacgattaacgcttccgtagcattgcactcctacgctctggaaccatctgggaaacatacccgcccagctgactatccggagagaggaaatccaatgtctctaagcaagggaatacaatccgctgcggccgccgccctgagcgcggccatgctgatcgccgtggcggcctgtggcacgactgacggcatcgacaccgcatccaagagcggcgattcatccaaggactcgtccagcacttcgattcaaggcttcgacaccagcagcatccagaaggacgacgagatagccgcactgctgcctgattccgtcaccagcgacggcacgctgaccgtcggcgccgatacctcttacgctccggccgaattcctggccgaagacggcaagaccccggttggcttcgacgtcgacctgtccaaggccatcgccgccgtattcggcctgaaggaagaaaccatctcctctaccttcgactccatcattccgtccgtgggctccaagtacgaccttggcatctcctccttcaccgtgaccaaagagcgcatgcaggccgtcgacttcgtcacctacttcaaggccggctccacctacgtggtgcagaagggcaacccgaacaaggtcgactcctcgaacctgtgcggcgtgaaggtggccgtgcagaccggcaccacgcaggaagaggaagtcaacaaggccaacgagcagtgcaaggcggacggcaaggatgccatcgacatccagtcctccaagctgcagaccgatgtgaccaccgccgtggcttccggcaaggcctccatcttctacgccgattccacggtgtccgcctacgccatcaagcagaccggcgacaccttggagacgctcggtgaagacgccggcggggtgcccgaggccgtggccatcaagaagggcgataccaagaccgccgaagccgtgcagaaggccatccagaagctgatggacgacggcacctacaagaagatcctcgacacttggggtgttggttccggtgccatcgacaaggctgagatcaacccggccgacgccgcctgattgccaggtgtccctgttcgttcccgctggcgggagctgtcgccgaaggcgactgagggtggtctgtagcataacagccaccagcagttgtattcttatgcggcggcctcccagcgggagcatttgtatatgtatacgctataatgtatatttatacctgattgttgatagtcgctatagggcggctccacagagaagaagagagagatcatgcagttcaacaagctgaagaccattgcggccgccgccttgagcgtggccatgctgttctccgccgcggcttgcggcacctccgacaaggcgggtgactccggttccgataagggcggttcctccaagtcggtcaccatcaccagctacgacgtgagctccgtgaagaaggacgatgcaatcgccgcactgctgcctgaatccgtgaccaaggacggcaagctcaccatcggcaccaacccctcctacgccccggccgaattcctcgacgccgacggcaagacccagatcggctacgacatggatcttgcccgcgccatgggcaacatcttcggtctcgataccgaaatcgtctcctccaacttcgatacgatcattccggccatcggctccaggtacgatctgggcatcgccgccttcaccatcaccaaggagcgcatggaatccgtcgacttcgtctcctacttcaccgcaggcatgggctatgcagtggccgcaggcaaccccaagaacgtcgatgagaacgacctgtgcggtctgaacgttgccgtcgagaccggcaccgtcgaggaagaggccatcaacaagaccgccaagcagtgcaaggcggacggcaagaaagacatcaccatccagtcctccaagcagcagaccgacgccaccaccgctgtggtgaccggcaaggccgacgtcttcttcgccgattccccggttgtcggctacgccattgcccagaccgatggtcagctggaacagctcggcaaggacttcgatgaagtgccgaacgccatcgccatcaaaaagggcgattcccagaccaccgaagccgtgcagaaggccatgcaaaagcttatggacgacggcacctacaccaagatcctccagcactggggcgtcgaatccggcgcactggacaaggccgaaatcaacccggccgtcgaatagccgacaagctgtcgcgaaaattcgaatggggcgcactgtttgtaacacagtcgccccattcgtacactaaggttcaacgctagttgcaacttgcagttcaggctgcccaacacgtccaaggaaccaaattatggcgaagaaagaagtcgacggtgagggagtgaacatccccaaccgcatcaaggcgctgccggtcaagcgccccggcccgattgtggccgcagtgatcgtggtgctgctcgccgcgatgctcattcaaggcttgattaccaatccgcgactggattggcccaccgtctggaagtacctgttcaacgagaacgtgcttgaaggcattcgctataccttggagctcaccgtgatctccatggtcgtggcgatcatcctgtcggtgattctcgccatcatgcgcaaatccatcaatccggtgctgcgcggcgtcagctggttcttcatctggttcttccgcggcacgcctgtgtacacgcagctcattttctggggtctgttcgccgtgctgattcccaagattagcctcggcattccgttcacctcggtggagttctggagcatcgactccaacgtggtggtcaccgcattcaacgccgcatggattggtttggctctgaacgaggccgcctacctgtccgaaatcgtgcgtgccggccttgaagccgtggaccccggccagaccgaggcggccaaggcattgggcatgaaccgcacgctcatcatgcgccgcatcgtgctgccgcaggctatgcgcatcatcatcccgcccaccggcaacgagaccatcggcatgctgaagaccacctcgctggtcaccgccgtgccgttcaccctcgaactgcagttcgccaccaacgccatcgccaaccgtatctacaagccgattccgctgcttctcgtggcctgcttctggtacctgctgatcacctccattctgatggttgtgcagtcccgccttgaggcgcacttcggcaagggcttcaacgcccgcccggtgggcaccaagggcaagcagccgccatacgatccgccgtaccccggcaagtctgacggcgagccgaaggacgatgtgaacaaaatcaatcagaccaccttcgctgggctgaatgcgtaaggcgggagcgagaattatgactacgaacgacatcaccaactccgctccggtcgtgcgcaaggcggttgacggttccgtgattcctgctgtcaaggccgtgcaggtgcacaaggcgtttgggccgctgcatgtgctcaagggcatcgatctaaccgttatgcccggcactgtgaccgtgattctggggccctccggttccggcaagtccacgttcctgcgtctgatcaaccagctggaaaccctgaccggcggttccatcgaggtggacggcgaactcatcggctacaagcacgtgaccaaaaacggccaggacatgctgcagaccctggacgataaggagatcgccgcacagcgttctcgcctcggcatggtgttccagcgcttcaacctgttcccgcacatgaccgcgctggaaaacgtgatggaagccccgattcacgtgcagcaccagtccaagaaagccgcccgtgacctggccgtggccgagcttcagcgcgtcggtctgggcgatcgcatggactattacccctcccagctgtcaggtggtcagcagcagcgtgtggccattgcccgtgctctggccatgaagccggagatcatgcttttcgatgagccgacctccgcccttgaccccgaactggtgggtgaagtgctcaacgtcatgcgttccttggccaaggaaggcatgaccatggtgtgcgtgacccacgaaatcggcttcgcccgcgaagtcgccgaccagatcgtgttcatggacggcggcgtagtcgtagaaaagggcggccccgacatcatcgaccaccccaccgagcctaggtttaaggacttcttgcagcacgtgctgtaggaaggctcgttgttgcagctccaaaaacgtacgctgatgaactcagcgtacgtttttttgcgacgcctaatcgcacccccatctcgtgaagaacgtacgctgagtggtagtcagtgtacggttttcacgaaggggcatgttccaatcctgcaaaggcggcgggttggattcgctttgcgcaataatcgtccgctaggctggtgaaccatgtgtggaatcgttggatacgcgggaaatattgaaacggcatgcggcaagcctttggaggtctgcctgcaaggcctggaacgtctggaataccgaggctatgactcggccggtgtggcgctgaccgcgcccggcatggataaggtggtcgtgcgcaagaaggccggccgtttgaagaacctggtcgaagacatcgagcgtaagccgatgccgcttgccacggtgggcatcggccacacgcgctgggccaccaatggcgagccgagcgacgtgaacgcccacccgcacaccagcatggacggcaaggtggccatcatccataacggcatcatcgaaaacgcctctcagctgcgtctcgacctgcaagccgaaggctaccgattcgcctctgccaccgacactgaggtggccgctaagctgctcggcaagatcgtggacaagattatcgcggacgaaggcaagccagacctgttcaaggctgtgcgccgcatggcccgcatgcttgaaggcgcgttcaccattctggccaccgactgccgccagccggacatcgtggtcggagcccgccatgattcgccgctggtcgtgggccttggcgagggggagaacttcctcggttccgacgtcgccgcattcgtggcctacaccaagcgcgccatggaagtcgaccaggatcaggccgtatgcgtgtccgccgacaaggtcatcgtcaccgatttcgacggcaacgtggtcgaaaacccgaagacctacaccgtggattgggatgcttcggccgccgaaaagggcggctgggattcctttatggacaaggagatccacgaagaccctgccgcagtgcagcgcaccctgcttggccgcttcgatgcgaatggcggcatcacccttgatgaagtgcgtatcgacgaacacgacttcaaggccatcgacaaaatcatcgtcgtggcctgcggcaccgccagctacgccggccaggtagccaagtacgccatcgaacactgggtgcgtatccccgtggaaatcgaactcgcgcacgaattccgttaccgtgacccgattctgaccccgcgtacgctcgtggtggccatttctcagtccggcgaaaccatggatactctgatggccctgcgccacgcgcgcgaacaggggtccaaggtgctggccatctgcaacacgcagggtgcctccattccgcgcgaatccgacgccgtgctctacacacacgccggcccggaagttgccgtggcatccaccaaggcgtttgtggcgcagatcaccgccgcctacctgctgggcctgtatctggcgcaggtcaagggcgcgatgttccgcgatgagattcatcaggtgcttgactccctgaaagacatgccgcgcaagattcagtgggtgctcgacacccagcccaagaccatccaggcggccgccgagcgcatggtgaacgccaactccttcttgttcctcggccgtcacgtgggctacccggtggcgcttgagggtgcactgaagctcaaggagatcgcctacacgttcaccgagggcttcgcggccggcgagctcaagcatggaccgatcgcgctggtggacgagggtgagcccgtggtgttcatcgtgccgccgcagcgcggccgcaatgtgttgcacgccaaggtgatctctggtatcgaggaggtcaaggctcgtggcgcgtacatcatcgccgtggccgagcagggcgacccggatgtggaacggtacgctgacgtggtgttctggcgccccgcctgcccaacgctgatgagcccgctggttgacgtggtgccgctgcagctgttcgccatggacatggcaaagctcaagggctacgacgtggacaagccccgcaacctcgccaagtccgtgaccgttgagtaagccacatcggtatgtgattgacgagcctcatattccgtttgagatggacgtgctgtatgaggacgagcggatcatcgtggtggacaagccgcattttctggccaccatgccgcgcggcatgtggtatcggcagaccgcgctgatccgattgcgtgagcggctgggggagccggacatcacgccagcgcaccgattggaccgcatgaccgccggcgtattggtgttcgtgcgggatccggcctgccgcggcgcgtatcagatgctgttccagaaccggcagaccgtcaaggtctatgaatgcctggcgccctgccggccgatcagccgcccgcgattcggcacgatcatgcaggtcgagccgccacgcccgttcccattgctgcgccgatcgcacatcaccaaggaacacggcacgatggccgcattcgaggaaccgggtttggccaacgccgaaaccctcatcgagcgcggcgacctctgtttccctcccgctgacgggaggtggcgcgaagcgccggagggtggtccccatccggggaatcaccccatctgccgctacacactccacccgcgcaccggcaaaacccaccaattgcgcgtccacatgaattcgctcggcctgcccatcgtgggcgacgacttctacccgcgcatccagacgcgcccctacgacgatttcagccaaccattgcagttggtagcacgcatgctgcgattcaccgatccaataacaggcgagaagcgcgaattcgtttcccgtgtgccgcttaagatctgatttcttatgcattgagagtgttttcgctcatggtgtcaccattcatagagttcggcgggctgcggggttttgcggacatccagcgacaagccaagctcagtcagggcgctgagaatggtggagaattcgggattggggactcgggcgtgttcaaattcgatcagccagcgacgtgacacgcccagccgttgggccatgtcggtctgactaatgccctggcgttgcctatgaatcactggcaggtggatcactggcaggtaccagtggatgccagcgcatgccgctcgtcagctgatgtcgagcacggaaccgcgttcaatcagttccggcgggattacggttttgacgccgaccggtatcttctcgccttcgcattgacggcggaccatggagaaggcggtggcgccaatgtcgtcaaagcgcagcttcatggtcgtcaggttcaagcgcgggaccatatcgaccagcgaatcatcgacgcccacgatgctgacatcctcgggcacacgcttgcccactgactgcaacccgagcattgcgccgtacgccatctggtcgttggcggcgtagatggccgtgcagtcggggtcgtgggccaacgccacgccggcctggtagcctgaatccgcgcaccaatcgccgatatacatgctcggtacgcgtgctcccatttgttccaacgcttctcgccaaccgcgggcgcggctttcggcggcacgcgaggtggacggtccggcaatgtggtagacggtcttgtgtcccttgctcatcaggtaatcgacgatagcggtcgagcagccatactggtcggcgtcaacagtggggcagtggtcggcggcggattcgcagatgagcacgactggaagttctcgcggaggcttgtatccgacgaaatcggagatgcgttcctccagcactacgatgacaccatccaccggctgacgctgcatgtgatcgatggcggcggaaagcgtgcgttccgcaccgtgacgcatggtctggatggtgactgaataatcgtcatcggccgcgttggccacaatagaatcaaggatgcgggcgttgccgaacgtggcggtgttgaacatcaccacgccgatatcctggaagcggccgtgctttagggctcgggccgcataattcggacgatatccaaggcgctccattgcagcttcgacacgctggcgtgtttcgggtttcaccgcatcgctgccattcgccacgcgggacactgtctgtggcgaaacgtcggcggctttcgctacgtcttgcatggacacctgtgttggcctcgacatttcaccctcgcttgactcattaatgtcggtgtttcgtttgcagcgcttatcttaggccgcttacgttaacgataacatcgttgttttcgtgaccattgtagcagagtgactgaggaacccttaattcaacacggtactcaacacgattggacaatgttacagatagtgttatgatgataacgcaaacattttggtcaaccttcgaaggagaggggttggaaatggcttcagccgatatcgcagctgcgcccgtgcattcgggcaaggctcgtgtgaataagcacaaggccgattggcgtggatggaagttcatgtggccttttgcggtggtgttcgtgttcgtgttcatcgtgccgatcgtgtatgccgtctatatttcgttcttcaagaagcagatgatcggcggcaccaagttcgtgggcttcgagaactacgtgcgcctgttgggcgatggccagttctggagcagtgttggtcgtgtggctttgttcacgtgcgtgcaggtgccgatcatgctgtgcctgtcggctttgatggcgttggcgctggattcgatgaagttgcatggcacgaagttcttccgcatctccaccttcctgccctacgcggtgccagctgtggtgtcgactttgatctggggtttcgtgtacggcgcgaagtacggcctggtgggttcgttgaacgatttcctgggcacggacatcgacgtgctcgccccttccgtgttgttggccagcatcgggaacatcgtgacgtgggagttcacgggctacaacatgctcatcttctacagctcgctgtcgaccatcccgcattccctgtatgaggcggcgagcatcgacggcgcgtcggagtggcagatcgtgaagagcatcaagcttcccgaattgcgcggcagcctggctatcacggtgatcttcagcatcatcggctcgttccagttgttcaacgagccgagcattttgcagaacatggttcctggtaatgcgatcacgacgtattacacgccgaacatgtacgcgtacaacctgagcttcagcggcaaccagtcgaattatgcggccgcgttggcgatcgtgatggccgtgatcaccatggccatcgcctacatcgtccagttgaacagcctgaaggagcagatgaagtgacgatgaccgctgttcgtgttgaggaatcgatgatgatcgtgaaggagcgtatgtgatgagtgcagcaacgacttcggccgccggtcgcctgaccgacgccgagctcaaggcccaggagaaggccgccaggaaggcggagaaggcccgccagaagaggatcgccgccgacgaggccgccgaacgcaagcgcagcgcgaaggccgggttcgcgaacgtgaacaacccgaggcgttccacgttgttgaccgtcctgtgcgcggtcttcgccgtgtactgcctgttcccgttcgtgtacctgctgatcaacgcgacgaagacacaggccgacttcacgagcacgttcggcctggggttcggcaagacgttcgctttgttcgacaacatcgcgaccgtgttctcctatcaggacgggatcttcgcgcgctggctgttcaacacgatcctgtacgtggtggtcggcgccggcggcgcgaccctcctggcgatcatgggcggctacgctctggccaagttccgcttcccgggccgcaacgcggtgttcgtggtcatcatcggcgcgatcagcgtgccgggcatcgctttggcggtcccccagttcctcctgttcgccaaattgggtttgacgaacaccccgtgggccatgattataccgagtttgatcagcccgttcggcctgtacctgatgtggatcttcagcgagcaggccgtgccccaggagctgctggaggccgcccgcgtggacggtgcctccgagttccgcacgttctggcagatcagcctcccgttgttggctccgggcatcgtgacgacggccctgttcacgatcgtggcgacgtggaacaactacttcctgccgttgatcatgctcaaggacgcggactggtacccgctgaccatcggcctgaaccagtggaaggaccaggcgagcacggccggcggccaggcgatccagaacctggtgatcacgggctccctgatcacgatcatccccttggtcatcgcgttcttgtgcctgcagaagtactggcagtccggcctggccgcaggcgccgtcaaggagtgagcgtactttggctcccttctggtggagggagccgagataaaggcataaccactaacagaaggaggcacctatgcagatattcgcattgttgagaattgtgcaggtgcctccttgtgtgtctgtgcaacgtgaggaatttattcccgtagacgcagattatcgataaaattcaataaaggaactgaatcatcatggaacgtaaagagttcaagtggccgcagcctcttgcgggcaacgagccccgcatctggtacggcggcgactacaaccccgaccagtggccggaggaagtctgggacgaagacatcgagcttatgcagcaggccggcgtcaacctcgtctccgtagccatcttctcctgggccaagcttgagcccgaagaaggcgtgtacgacttcgattggctcgatcgcgtcatcgacaagctcggcaaggccggcatcgccgtcgatctcgcctccggcaccgcatccccgccgatgtggatgacccaggcccacccggagatcctctgggtcgactaccgcggcgacgtctgccagcccggtgcccgccagcactggcgcgccaccagcccggtcttccttgactacgcgctcaacctgtgccgcaagatggccgagcactacaaggacaacccctatgtggtctcttggcatgtgagcaacgagtacggctgccacaaccgcttcgactattccgaagacgccgagcgcgccttccagaagtggtgcgagaagaagtacggcaccatcgacgctgtcaacgacgcctggggcaccgccttctgggcgcagcgcatgaacaatttctccgagatcatcccgccgcgcttcatcggcgatggcaacttcatgaatccgggcaaactgcttgactggaagcgcttcagctccgacgccctgctcgacttttacaaggccgagcgcgacgccctgctcgagatcgcccccaagccgcagaccaccaacttcatggtctccgccggcggtgccggcatcgattacgacaagtggggttacgacgtggacttcgtgtccaacgatcactacttcacgcctggcgaagctcacttcgacgagctggcttactcggcctccctatgtgacggcatcgcccgcaagaatccgtggttcctcatggagcactccagctccgccgtcaattggcgcccgatcaactatcgcgtcgagcccggcgaattggtgcgcgactccctggcccacttggccatgggctccgacgccatctgctacttccagtggcgccagtccaaggccggtgccgagaagtggcactcttcgatggttcctcacgcgggccccgactcccagatcttccgcgatgtgtgcgagctgggtgccgacctcaacaagcttgctgacgagggcctgctgagcaccaagctggtcaagtccaaggtcgccgtcgtcttcgattacgagtcccagtgggctacggaacacaccgccacgcctactcaggaggtacgccattggaccgagccgctcgcgtggttccgcgcgctggcggacaacggtctgaccgcagacgtggtgccggttcgcggcccttgggacgagtacgaagccgtcgtgctgccgagcctgaccatcctgtccgaagagaccacgcgccgcgtgcgcgagtatgtggcgaacggcggcaagctgttcgtgacctactacaccggtctggtggacgacaaggatcacgtctggctgggtggctaccccggttccatccgtgacgtggtgggtgtgcgcgttgaggaattcgccccgatgggcaacgacttccccggtgccatggaccaccttgacttggacaacggaaccgtggcgcacgatttcgccgacgtgatcacctccgtggccgataccgctcacgtggtcgcctccttcaaggcagataagtggaccggtttcgacggcgctcccgccatcaccgtcaacgacttcggcgacggcaaggccgcatacgtcggtgcccgtctcggccgtgagggtttggccaagagcctgcccgtgctgctggaggaactcggcatcgagacttcggctgaggacgatcgcggtgaagtgctgcgcgtcgagcgtgcggacgaaactggcgagaaccacttcgtgttcctgttcaaccgcacccacgatgttgcggtcgtggacgtggaaggcgaaccgctggtcgcctcgctggcccaggtcaacgagtccgagcacacggccgccatccagcccaacggcgtacttgtcgtcaagctgtaaaaccgcgcatagcgcctaattacccaacggctcccttgctgctcatcgtagcaggggagtcgttttcgtatctccagcaaagtcgggtagggtggtcaccgtgcgaggcaaaaacagagtgacgatggcggacgtggcccatgaggccggtgtttcggtagcctcggtgtctaattttctgaacaaacagccatatatgagcgaggcgatggccgcgcgtattgcggaagccatcgacaggctcggatacaaagtcaactcgtcggccagaaacctgcgttccgggcgtacccggttgctcaagctggttattcccgatctgcggcaggtgtacttctccgaactcgccgaggatattctggccgaggcccggcaacatggctacggcgtcatcgtggaatccaccactaacaatcgtgcccgcgagctggaaagcatcgcatcgatgggcacgcacagcgcggacgggctcatcttaagccctctgatgatgacggttgacgatatcgcggctttggatggcgattacccgcttgtactgttgggtgaacgtttgttcggcgtcaacgcgccgcacgtagtgattcgcaatcgcgaaggggccgccgccgcgacttatcacctgcttgatgccggttgccgccgcatcgccgtagtcggtgccgtgccccaccccgagcacgatttctcgtcgggctccatccgcacccacggatatcgtgaggcgctggccgcgcgcggcatcccctgtgatgacagtctgcttatcgaaacccaaggctgggggagcgccgacggtttggtcgcggtggacaccatgctggagagtggcctgcaattcgatgccgtgttcgctttgaatgacttgctggcgtggggcgtgctgcgtgaactgcgcgaacgcggcgttgccgtgccggatgatgttcgcgttatcggcttcgatgacgtggaggaatcggcctacatggtgccgtctctttccaccgttaaccccggcagggaagccatcgcccgactggccgtcgaatccatcatccaacaggtcgaatccggcagccgtgcccccgcccaaaccatcgaggccccctatagcctctccctgcgcgagtcctcaccggcgttggcgcgcgcctgatgaatccgtggttcgaaatatccgaagtgaatgacaaggcccgtcaatcgtatggtgattgacgggccctggtcgtattggacttgactgtacttggtacgggcgtgactctccgtcttttagccgtggaattccacgctgatccaggagatggcgggaagcgttgccgtgcaggtgccggtggcgttcattgcaatgtcgagcggttgcggcgtgacggcttcgggcgcttcggcggtgttggtgcggtacggatcgtcctcatgcaacagttgcgccttgctgagcgcgagcgtgccgagaccgggcaggccgggcagcccggaaaggtcgatggtgagcgtgtgcggggtgttggcgtcgcggttgacggcaagcagcagaccggtgcgggcctgttcatcccacgtgactaccgcgtcgatggccggcacgtcgtcatatgcctcggtatggatggtgggggagctgatggccggagcgtaggcctggccgcgcgcgtgaagggcggcttcggcgaacgggtagaacgtggtctgccgccatgccgggccgtgttcctcggccatgatgggggcgatgacgttgaccagctgggcgcgcgaggcggaacgcacgcgatcgcagtgcttgagcagggtgatcatcagggaaccttcgaccaccgcgtcggccgcggtgtagatgtcttccagcaaatgcggagacttaggccatggctcgtggtgcaaaccctgcgcggcctccgccttccactggtcttcctgctcgttccacttgtccgaataccatacgccccattcgtcgaaggacagggcgatgtctttggtgccgttgttggcttctcgcgcctgatcggccgcgtccgagacggtggcgatgaacttggtcatgtcttcggaagaggccaggaagtcctgcatggaggcggcggtccgggttttatggccgcggtcgaagtagtaggcatggcaggagacgaagtcgagattctcgtaagccttggtgagcacggtcttctcccacgtgccgaaggtcggcatataggcacccgaggaaccgcaggccacgagttcgagaccggactcggcgagcttcatggcgtgggccaccttatccaccgcgccggcatattcttccgggctcatgtggcccacctgccacgggccgtccatttcgttgccgatgcaccacatcttgatatccatcggctcctcgatgccgttggccacgcgctgatccgcccaagcggtgccgggcgcgccgttgacatactcgagctcgtcgagcgcggctttcagcccccgggtgcccatgttgacggcaagcatgatttcggtgccggctttctggctccagcggtagaagtcgtcgatgcccatctcgttggtttcggtgcaatgccaggccaggtcgcggcgcacggggcgattctcgcgtggaccgatgccgtcttcccagttgtagttggatacgaaattgccgccggggtagcgcacgcaggtgacgcccagctccttgaccaggtcaagcacgtcttggcggaagccgttttcgtcggcggtgggatggctgggctcgtagatgccgccgtagacgcagcggcccagatgttctacgaatgagccgaacagacgcgggggaacgtcggctaccggagtggcgtcggcgttgagggcgatgctggcgtccggcgtagttgcgttgccggttgtggagacgttactggccgtggtgccggcggcggtcggcgccgggctgctttcctgcttgtcgggatgggtggtttcggcggaatactggctgttgtgagtggtcatgagcgggatgcatctccttcggtttgcggttaatcaccatggtgcgacgtgtcgtgtttgcgtaaacataaaacatgtggtactgtttcttaaaacgatacaatacttggaacaaaacgccaagtcccgtcgtttcccataacaaggaaggaaagaacgatgaagttcggcaagaagacaattgccctgatcggtgctgtggccatgctctcctctgtagctgcctgcggttccacctctgccggggatagcggaagcaccggatcctctgataagaagatcgagctgaccgtgtggtcctgggattccacactgcctcgtacggtcaagggattcgaggccaagaacccgaacattaaggtgaaggtgaccaatgccggcaccaacaaggacgagtacaacgcactgtccaacgccatcgaggccggctccggtgctccggacatcgcccagatcgaatactacgcactgcccgaatacgtgattcgcggccacctcgagaacctttccgatctcggtgcctccgatttcaaggacttctacaccccgggcacgtggtcctcggtgaacatcaatgacggcgtctacgccctgccgatggattccggcccgatggcctggttctacaacaagggcgtcttcgacaaggccggcgtcgatccgacccaggtgcgcacgtgggacgacttctacgaggccgccaagaagattcgcgccgtggactcctacatcacctccgattccggtgacgccggcttcttcgactccatgacctggctggccggcgcgaccccgttcgagacctccaaggacggcgggaccgtgaccatcaacctgaccggtgacaagaacgtcaagaccttcaccgacttctggcagaagatgatcgacgaagatctcatcgacaccaagaccgtcggctggaccgacgattggaacaagggtctggatgacggctccatcgcatccctgctgaccggcgcttggatgccgtacaacctgctttccggcgctccgaacggtgacggcaagtggcgcatcgcccagatgccgaccgcagacggctccgagaccaactccgagaacggtggttcctcgctggccatcgtgaagtccgacgacaaggacaaggtcgccgccgcctacaagttcatggaatacgcctgccacgacgccgagggcatcaagacccgtgttgacggcggcgccttcccggccgacaacgacaccctcaagtccgacgacttcctcaacatgacctccctgaccgactccgacggcaaggcccacgagtacttcggcgggcagaagttcaacgaggagctggccaaggccgcagccaatgtgtccaccggctacaagttcctgcccttcgaggtctacgctcgcggcaagttcggcgactacgccggcgatgcctacaccggcaagaccacgctctccgatgccgtggcttcctggcagaaggacctgcaggattacgccaagcagcagggctaccaggtgaagtaacggcaatcacagcagacttcctcctgtggtttctgtagcgggaggttgcgataacaggatcgggcactcttcggagcgcccgattttcttatgccatgggagcagtggcgcgcggattgcgataccaagatggcgtgttgccgaagaatgtgtataataaaagatgttatcgcaaccatagctacaaagtggcgaaacaaagccgttttgtgactactgaaccatagagtgatggttcacgatagcatgacgacgaggagagttgccatgctgttgtggtgacaatcactgcagaccgccgaaaggcgatccaaggaaggagaacagaacgatgaagttcaccgttgctaagaaggccattgcacttaccggtgcggttgccatgctgggttccgttgccgcctgcggttccgacaccgccagtggcaagccggctcaagataaggacgttaccgaaatcaccgtgtgggcttgggagcccacgctgacccaggttgccaaggacttcaccaagaagaccggcatcaaggtcgatctcaagaacgtcggcaccaacaccaaggaatacacccagcttgataacgccatcgaggctggctccggtgctccggacgtcgctcaggttgagtactacgccatcccgcagtacgccatcaagggcaacctgctggacatcaccgacaagacctccggctactccgacttctacacccctggcccgtgggcttccgtgcagttcgccggcaaggtctacggcctgccgatggattccggcccaatggccttcttctacaacaaggaggtcttcgacaaggccggtgttgacgccgagcagatcaagacctgggatcagtactacgacgccgccaagaagattcacgctctgggcgacaactactacatcacctccgacaccggtgacgccggcttcttcgactccatgacctggctggccggtgcaaagccgttccagacctcttccgatggttccgaagtcaccgtcaacctgaccgaggacaagggcgtcaagaccttcaccgacttctggcagaagctgctggacgagggcctgctcgacaccaagaccgctggctggtctgaggactggttcaagggcatggtcgacggcaccatcgcctccctgttcactggcgcttggatgcctgccaacctggccaactccgctgctgacggcgctggcaagtggcgtgtgacccagatgccgaccgctgacggctccaccaccaactccgagaacggtggttcttcgctggctgtgctcgcctccaccaagaaggctgacgctgcttaccagttcatcgagtacgccaaccacggcgacggcgtggccacccgtgtggccggcggtgcattcccggctgacaaggcctccatggagtccgactccttcaagaacaccaccactgtgaagaacgccgatggcgaggacgttgactacttcggtggtcagaagtacaacgaggttctggctcaggctgctgagaacgtgtcctccgactaccagttcctgccctacgaggtcaaggcccgcaccatcttcggcgactactttggcaagtcctacaccggcgaccagaagctgactgacggtatcgccgcttggcagaaggcactgcaggattacggcaaggatcagggcttcaccgtgaagtaagccttgaaccctcgctgagactgcctagctaatctcacctgatacacaaagccccgtgacgaatcccgtcacggggcttttaccgttttaagccccgcctagtacactcgtcaccatgcgagtgatcggacagcgaatcaaaagaatggcaaccatagcagtgactgccatcctttccgtatccttggcctcgtgcgggcagtccaccaccgataaccgcacggaaatcagcgtatggagctgggaaccgagcatgggcgaggtcatccgccgtttcgaaaaagccaatccggacatccgcgtgaaatggaccaacatctccggctatggcaatctcaacaccgccattcaggacggttacggcacgccggacgtggctcaaatcgaatactatgcactgttgcagtacgcggtctccggccaattgcttgatctgaccgacaaaatcggctcggattattccaacttctttaccctcggcacatggtcgtccgtgcagctcgccggccgtacctacgggctgcccatggattcgggcccgatgggcttcttctacaacgaagacgtgttccgccaagccggcgtggacgccaccaagatcaagacttgggatgactactatgaggctgccaaaaagctcaaggagattggcgtgtacatcgccgccgactcgggcgatggcagcttttacgatgccatggtctggctcgccggcggccagccgttccacacgtcggccgacggcaaaaccgtgaccatcgatttggatgaggacgccggcacccaacggttcaccgaattctggcagaaaatgatcgatgaggggcttgttgacaccacctccgccacatggtccgaccgatggaagcgccgtgtgggcaccggtaccatcgcctccgtgttctctggggcctggatgccgtcgctgctgctgtccaatgtgccgggcgcggccggtctgtggcgcgtggctcccatgcccacctatgatggccagcccaccaacgccgaaagcggcgggtcggcactgaccgtactgcaattgacccgtaagccggatgcggcctatcgtttcgtggactttgtggcgcatgacgcccaaggcattagcgcgcgtgtagacggcggtgcctttccggccgattacgccaccctgaattccgctgattttctggataaaaccacgattaccaatgaccgtggcattgaaatcccgtatttcggcgggcagaagttcaaccgggtactgtcggaggccgccgaggatgtgtcggtcggataccagtatctgccattcgaagtgtatgcgcgcagtgacttcaaatcgacggtgggccaggcatacgagtggtccggcagtttccacgcctatcagcagcgacaggaagccattgagatgggcatgaaggacgaggaaggcaacccgctcgaaccgttggagaagcccggcaagaaagtcagtctctccgacggcctggcccaatggcagaaagacctccgagaatacggcttcaatcagggctttacgattaagtagggattcggggttgggtcggaatcgaccgcgctatacgcggccgattcctgcatactacgtcacttcacattgcgcgagtagatgtgcgccatgcccttgaaaatcaaatccgggtcatacacgtcaatcagctcggtgtcattctcaaacactcgaccgaggccaccggtggtgatcaccttgaaatcctcgcctccgagctctctgcggaactgacgaatcgtgcgctccacaccgcccaagaacgtgtaatacaaaccggcctgcatgcaggtcttggtgttggtgcccagaatcgtatccggtcgcgtaatttccacttccggcagctgggccgtatctccccacagagcggccgcaccggcacggatgccggtggtgatgacgccggaatcgaccacgcccttgtcgctcacgtgcgtgaacgtggtggcggtgccgaaatcagccaccagcactgggccgccatactcgtaataggcaccggcgcagtcggccagaatatccgcacccagcgatttcggatcgtcaacgcgcacgttcataccggtcttgatgcccggtcccaccaccatcggatcaatgtcgaggaatttgacgatggacgaacggaaggagtgcatcactttcggcaccaccgaacagatgatcacatcgtccacatcggatggctgaaaaccgctcattctcaggaattcagtcagaaacagcccatactcatcagacgtatggttggctttggtggtgatgcggtaggtgccggcgatggcatcgccatccaaaaagcccagcacgatgttcgtattgccgatatcaacggcgaccagcatgataaccctccagattcaagatggatttcatgcgcaattctacagtcccatggctatgatggcctgcggtggtcgacccagcgtggcggccaaccgtagaacacaacatatacagaggaagaaccatgtctcaagacaatggtgcgcacgtcgaagacggcgcaaccacagatgcgagccttgcctcgcgcgcaaagaatccgaaaaaaagcggcccgaagtggtggctgatctcactgattgccgtcatcgtggcagtggcggtcgtcatcggcgtcacgctcgctttcggcggtaagaaagatgacaagtcggcttcgtccagcaaccaatatgccgacaccgtgaccatcggcctcaaactggcccccaccaatctggacatccgcaacaccgccggctccgcgcttgaccagatcctgatcggcaacgtatacgaaggcatcgtggcacgtgactccaagaaccaggtcgctcccgccatcgcctccagctgggagacgtccaaggacggcctgacctacaccttccacctcaataagaacatgaccttcttcaatggcgacaaacttgacgccgaggacgtggcctggtccatcaacgagctgatcgctaagggctaccacgacgccgacgcgctcgccgccgtcagcaaggtggaggccaaggacgccgacaccgcggtgatcacgctcaagacgccgaactccaacctgttgtggaccctgaccggtcgcgcagggctcgtgttcgacaaggacgccaagtatgacctgaagacgcaggccgtcggctccggcccctacaccgttgccaagttcgtggaaaacagctcgatcacgctgaaggccaatgagaagtactggggcaagaacaaggccaagacgcccaccgtggtcgtcaagtatctggccgacgacaacgccgcggtcaatgcgctgaagtccggtgacgtgcaggtgctcgccccgattaccgagaacctcgccgaaccgttcaagtccgattccgccaagtacacggtcaaagccggcaacggcaccgacaagttcgtgctcggcttcaacaacgcttccggttccaaactggctgacaagcgcattcgccaggccatccgttacgccatcaaccacaaggagctcatcgcctctcgcggcggtgcggacaaggcgctcggcggcccgatcccgtctctcgaccccggctacgaggatctgacgaatctgtacccgtatgatcagaacaaggccaagtcgctcatggctgaagccggctattccaccgacaagccgcttcaacttacgctgacctacgccaacatctacggcaccgagctcggagaccagctgcgctcccagctcaagcccatcggcatcgacctgaaggtgaatgtggtggagttctccacgtggctgcaggatgtgtacaccaaccacaccttcgatatttcgctggtggaccacaacgaaagccacgacttcgcatcgtggaccgatccgacatactatttcggttacgacaacaagaatgtgaccaagctgtacaacgagggtgttgccgccacctccgacaaggagcgtgatgccaagttcgccgcggccgccaagcttgtctccgaggatgcgccggccgactggctgttcaactaccgcatcaccaccgccacggccaagggcgttgaaggattccccttcgacctcaaccagaccgttctgcccctctacaacgtgacctacacgaagtagttcgttacagcaatgagctccctcagtgagggggctcattgttaatccaagtaaagtaggcattatgcgattcgtgttgaaacggctggcgttattcgtggtggcgttgttcggcctgtccgtggtggtttttgcagcattgcgcattctgcctggcgatgtggcctccgtgatggccggcgtcaactcgccgcctgagcgtgtgacccagctacgcgaacaactcggtctgaatcggccattgattgcacaatacttcgattggatgagtgcgctggcccgtggtgacttcggcacttcaatcctgactggtcgctccgtaacctccttggtaggcgcacgtgcgtccatcacctttcccctgattattcttgccctgctcatcgccttggtcatcggcttgccgctgggctgtgcggcggtactggcccgcagcgcaacggtgcgtgcggtgtttcatgtactggctattgtcggcggtgccgtacctgcgttgtggggcggtctgctgctgattctgttgttcgggcgcggcgtaggattgcttgatgtgtttccctcgcaagggttcccgctggatggttggggcgcacccggttcggcgatatcagcgttggtattgccggctgtatcggtcggcatcatcgtgggagcatcgcttatgcgatacacgcgcgcggccttaggggatttagccagttccggctacatcgatatggcacgctcgtgtggcatgacgcgcactcaggcggtgttgcgtgtgggattgcggttggcaaccccgcagctggtgtctgttatcgggctgaccttcgcttcgatggtcactggcgtgatggtcatcgaaaacctgtttgcgttaccgggcatcggcaacggtcttgtgaccgacgtgggcaaccgcgacctgattgccgtgcaaagcgagctgttcctgctggccgcgttctttttgactgtcggcctcgtggtcgatttgttccaccgcgtgctcgacccgcgtctgaaaaccgctaccgccattacggaggtgaccgcatgagcaatgttcgtcgtgcgacgactggtggtcgacgggctgccttcgtcatcgtcctgcactctatgtggcgtcgtgccgagggcaaattcgcacttatcgtgctcgctctgtggttgctcattgccatcgtttccctgttctggaccccgcaatcgctgtgggccactgatggctaccatgtatgggccaagccgtccgccgagcactggctcggcactgacggcaccggcgcggacgtgttcagctggctgctggccggctcacataccaatcttgtgatcgtgctgctgaccgtagtggcatctatggcttgggggctgctgctcatcgcggccatggtggcacgcaatgcggcgctcgccagttcttcggtagtggtagttgatgcgttgatttccgttcccaccgtgttgattgcgttgattctggctgtgccgttgagagcgtcaatcgcggtgattgtgatcgcctgcggcttcggatatgggttgaatctggctcgtgtggctcgccccgcagcgttgctggcggcccgctcgtcgtatgtggaatcggccttggccaatggtgccagcgggtggcgtgtgctcataagccatgttatgccgaatattctgccggtattggctgtgcaactgtcattgtcggcgggcacggcggtgttggctgagtcggggcttacttatctcggtatcggtgtgccgtccggtgtgccgagctgggggcattctctggccacttcggtcaaactcatcaacgtgttcccattaaccgtggtgtggcccggcctgatcgtcacggttgtggttgtggcgctgaatatttttggtgatgtgctgcgcgatgccatcgatccggtcaccaaccccgcattacgtgaaataggaggcgaacgatgagcgtcgatgttcgcgggttgaaaatcacgattggcggcaaaccaatcgtctctgatgcggatatgaccattgccgacggtgaacgagtcggcttgatcggttcttcaggctccggaaaatctatgattgccaaggcgatgctggggttgctgcccctgaccgctgtgactaatgggtcgattgatatgggcagcacggaaattatcggagcttccgaacgtgcgcttgccgacctgcgcggccggtatgtgggtgcggtgttccagaatccggctgcctcgctgaacccggtgatgaccgtggcgcagcagatcgccttgccattgcggttgcactatgatctgaccaaggtcgaacgagccgaccgagtgaatgccttgttgagcaaggtcgggctggatctcgatatggccggcaaatacccgcacgaactgtccggcggccaacagcagcgcgtgggcatcgccacggcgctgatcacctcaccgcgattcatcatcgcggacgaacccaccaccgcactcgactccatcacgcaacgccagatcgtggacctgctgacctcgctggtggacgacgccggtgcctccatgctgttcatcacccacgatttctccgtactcgcgcgtgccaccacccgctgctacgtgctggacgccggccgcatcgtcgaatccggacccaccgccgacctgctcgccgcgccgaccacaccacaagcccagcgcctggtcgccgccgcccaaaccctcaccctccacacccccaaggaggattcgcatgagtaacagcagtgtgccgctcctctccgcccactccatcaccaaatccttcggcccgcgcaccgcacgccaccaagtcctcttcgacgtctccgccgacgtccacgccggcgaatgtctggccgtgatcggcggctccggatccggcaaatccacgctgacccgcattatgctgggcttggaatccgcggactccggcagcgtggaatacgagagccaatccattgtcggcggccgaaaatcgccgggattcgcggccctgcgccgcgaatcgggactggtgttccaggacccgttctcctcgctcgacccacgttggcgagtcgccaaatcagtggctgaaccgctgagtctgcaacggcgtgacctgaacaacaccgatatcgacgagcgagtggccgcggctctgaccatggcaggccttgaaccggcagacttcctgaaccggtacccaatcgacctgtccggcggccaggcgcagcgcgtggtcatcgcccgcgctatcatcaacgagcccaaagtgatcctcgccgatgagccgatgagcgccatcgacgtggccgcgcgcattcagatcctcgacaccttcgccgccatccgcgcggcccggccgagcaccgccatcatcatggtctcccacgatctcggcgtggtacagcacatcgccgaccgcatcctcgtgctccatgacgggcgtctcgaagagacgggttccaccgctgaagtgctcggcaacccccaatccgattacacccgtcagctcatcgaggcagcctcgttatagaccttttttggctccctctctgaggggagctgtcgaacgcagtgaggctgaggggagttacgggtgccgtcgtattcccctcagtccgcttcgcggccagctcccctcagggaggggagccggccgccggcgacacgcgcttgtcgcgggttgtgctatggtgtgaggcatgcagattatctcatgttgttgtcgctaaccgacgcccctgggcgagcggtcagtgacgcataacttgagatagagcattcgaatcgcggcaaatctgtcgcatgaattttcatgaaatcgatggcacgagcgtaaccgtgtaacgcgcgagtcgtggttaacatgaaaaaccgattcactttccggcttcaccgtacagtgagcggggatactcgatttcaaactaaagccacagtccattcgtctgggaacgtcggttcacgaacgcaacgcagcaaaaccccacaaccccagcaacgaaggacttcacatgaccatccacaacagcctcgcagaactcatcggcaacaccccgctcgtcaagctcaaccacattccgcaggcggccggcgtcaaagccaccatcgccgtcaaagtcgaatacttcaaccccggtggatcttccaaggaccgcattgccgaacgcatcatcgacgccgccgaacagtccggccaactgaagcccggcggcgtgatcgtcgaacccacctccggcaacaccggcgtcggcctggccctggtcgcccagcagcgcggctaccgcacgattttcaccctgccggacaaggtctccgaatccaagcgcgcggtgctgcgcgcctacggtgccgaagtcatcgtcacgccaaccgacgccggcccggacgacccgcgctcctactatcaggtcgccgaacgactggccaatacgattcccggcggcttccgcccgaaccagtacgacaatccgaacggcccgctgagccactactacaccaccggacctgagatctgggaggccacggaccacaaggtcacgcacttcgtggccggcatcggcaccggcggcaccatctccggcaccggcaagtacctcaaggaagcctccaacggcgcggtcaaggtcatcggctccgacccggaaggctccatctactccgcttcctcacgcgacgaagtccaccagtacgatatcgagggcgtaggggaggacttctatcccaaggccttcgaccggaacatcaccgacgacatcgtgcgcgtgtccgacgccgaagcctttgaaatgacccgccgtctggccggcgaggaggcgctgctggtcggcggctcgtccggcatggccgtggccagcgccatcaagtacgcgcttgccaatgatttggacgagaaccaggtcgtggtggtgctcgcccctgattccggccgcagctacttggagaagatcttcaacgacgactggatgcgtgccaacggctacggcgacatcgtggagcgcaccagcaagccctccctcgccgagcagtaccttaacggagctccctctgatgagggagctggggacggactccataactagctatcaaaagaatcaataccaacatccgcactaaccaaccgcacctgttctaccttcgaatacggaacgattccgaaaggaacccaatatcatgtccgctgaatacaacgccaagttcgccaataccgacatcgccactcgcgccatccacgccggccaggagcccgacccgaccaccggtgcggtcgtcacgccgatcttcgccacctccactttcaagcaggatggcgtgttgggcctcaggggaggccacgactactcccgctccatcaaccccactcgcaccagcttcgacgagcagctcgccgccgtggaaggcggcaagtacgcgctgagcttctcctcgggcttggccgccatcgacgtgctgctgcgctccaccatcaagcccggcgacaacatcctgctcggcaacgatgtgtacggcggcacctaccgcctgctctccaaggtgttcgtgccgtggggtgtgggcctcgacgtggtgaacatcaccgatctgaaagccgtggaaaccgcattggcctccaagcactaccagtatgtgtgggtcgagaccccgtccaacccgctgctcaacatcaccgacatcgcggccaccgccgaagtcgcccacaagtacggcaccaaggtcgcggtcgacaacaccttcgcctcgcccgcccttcagcacccgctggccgatggcgccgatgtggtggtctactccaccaccaagtacatcggcggccactccgacgtggtcggcggtgccgtggtggtcaacgacgaggagacccgtgagaaggtcgccttcctgcagaacgccgccggcgcagtgccctccccgttcgactcctggctggacatccgcggcctgaagaccctggatctgcgcgtcaagcgccacagtgccaacgccctgaaggtggccgaatggctcgaatcccagccctctgatgtgattgagcgcgtctggtacccgggcctcgagtcccacccgggtcatgaaatcgccgcccgccagatgcacggcggcttcggcggcatcgtctccgtgcagctcgcggccggtgccgaggcggccaagcacttcgtggaccacacgcagatcttcacactggccgaatcgctcggcggtgtggaaagcctcatcgaggtgcccgccgccatgacccacgcctccgtggccggcaccaccctgcaggtgcccgccaatctggtgcgtatttcggtcggtatcgagaacgccgacgaccttatcgccgatctcaagcaggcgttggatcgtatctgaccgtactgacggtactggtggcaccgtattgacggtgccaccacgcttatcggcggactcgctatcgattggtacctacaaaaaatccccggcccacaagggtcggggattttccgttatcgattaaacatattgaatcagctggcgttgccgccctgccatccagtggcatccgcaccagccgggcgcaacgtctgaccggaagtcggtgtggtgccatcaacgaccacacgagtgccgatggtggcaaagtcgtacatccacttggcatcggccacctgcatgttgatgcagccgtgcgagcctgggataccctgctgcacatagatggggtgctcgccccacatgtatgcaggaacaccgtgcagggcctcgccgccgttatagtaggaaatccacggcgtgcctggctggttgtagccttcgccaaccatggtctgcgattcgtacttgagatacacgtagaacgtgccggtatcggacagcatggaaccatcggcggtgggcttgccagaagcgatgttgaacttcttgaccaccgtggttccctgatatgcagtggcagtctggttcgtcagatcaacatgaacccacttatcgccatttgccgtatcgaagttatgaggcacctcgacctgcttgacatcatatgggctgtctttcacagccacagtggaatcagtggactggttctgctcgatggcggtagccagacgttcgggggcgtccccggcaccagtcacttcaataccatccacaccgagtgtcttatcggcaccaatttccacgccgccttcgtctttcggcgtgatgtagacctcgcgtgtcaccttgggaacagtcagttctttggttacgctgtcactggtgacgtacttggtgatggcatcgcggtcgactaccagactcatggtgccacccgccttattcaccgtgggcttgaggaatgaggcaatggtatcggccgggatggtgacgctcttgttcacgccgttgtccacggtcagtttgaggccaagcttggcattggcgtcaaactgtgtttgctgtgcgctcgcgtcatcaatcggattctttgcagtctgtagcttgaccggcaccgtcgcattttcgcccggggtcgcgacggcctccttgactgcagcattgacaacattgatatccggacccttgccatcctgacccgcggtgtaatcgaactgcttggtgctcttgttgtagacaacggtggcaatctgcgctcggtcggcctcatcgaccaggccggcggtgacgaattgttcggcagtctctttgtccctggtggcggtcagagcgatatgcggctgatcgaaaatattgagcttggccacgtcgccggtcttcgcgttcaacagcgcatctacggttttatccgtgtcgacggtgacgccaaggtccttcagcgaggctttgacgctgttgccttcggcggtgaacgtcactgtggtgttattcagctgctgcttcacagtattcgcaagttcttcgcgggtctggcccatgacagagacattgcccaaatgaacaccgggcgcagccttgtcttggaagtaccaacgtccgacgaagaaataggctattaatgcggcaagcaacactgcaaatatggttatgatggcaatccgtgcggccttgccatgtgatttagcggtggtagatgccataacatgttcacccacataggctgtattatcggcatggttattggtgccattgtcactttgctgtggtgtggcggtacctgaatccgcggctgcgaacagcccatcggtggccacaggctgcagcaccgccgtctcctgatcgtcaggagaggagaaggaaaatgtatcgttggccatcaaaatgccccgtcttagttctctcaaagcggcatatcgtgcgatatgccgggaataacgttccttgacgcataataatacggaagggctacgtacatcgttgcgaggtattccgttatacgctgaaatccagccgcggtcggcctacactggtcgtttatgacagcacatcaggcggcgctggaggcgctcacacgatacttcggctatgactcgtttaggcccggacagcaaggaattgtcgaggctttgcttgccggacgcgatgtcttgggcgtgatgcccaccggcgcaggcaagtccgtgtgctaccagattcccgccgcgctcagcccgggtgcgactttggtcatatctcccttgatttccctgatgcgcgaccaggtcgatgcgctgaacgacctcggtatgccggccgcgttcatcaacaccactcaaactcccgacgagcaggcgatggtgttcgcccaagccgccgccggacagatcaaactgctgtacgtggccccggaacgcttggaaaccgggcgattccgcgactttgccgcccgtacgccgatctcgctgatcgccgtggacgaagcccactgcgtctcccagtggggtcaggacttccgctcgtcgtacttaggtatcggcgatttcatcgccgggctgccgcagcgtccaccggtgggtgcgttcaccgccaccgccaccgaacgggtgcgtcgggacatcgtgggactgctgggattgcggaatccggccgtcaccgtcaccggattcgaccggccgaacctgtattttgatgtggtcaaactggagaccaaatacaaggccgcatgggtggcgcggtatgtggccgaccatccggacgaatccggcatcgtctactgcgccacccgcaagaccaccgaagcgctcgccgacacgctgaaccagatggggcatccggccgtcgcctaccatggcggcatgtcgccggacgcgcgtgaggtggcccagcgcgacttcatcaccgacaaggtgccggtggtcgtagccaccaacgccttcggcatgggcatcgataagtccaacgtgcgttacgtcatccaccacaatctacccgaatccattgaagcctactatcaggaggccggccgcgcgggccgtgacggcgagcccagccgatgcacgctgctgtggaatgagtcagacatcgtcacccggcgtcggttgctggataacgattatgagaacgagcgattgactcccgaagagcaggagatcgttcgccagtccaagcgccggctgctggacggtatggtcggctactgccgcaccaccgactgcctgcaccggtatatgacccggtatttcggtcaggaattgtcgccgaatgctggttccgcggcgggtgaagacattgcggcggactcttcgcagtccggcagatgcggtgcctgctcgaactgcgaaagcacgttcgagaccatcgacgtgacccgcgtggcgcaggcgatcagccgttgcgtgcatgacgtggggcagcgcgtcggttccggcaaaatcgtcaagattctacgcggctcgcgggcacaggatctggcatggctgaacccggagcggatgcccaccttcggcatgctcaaggacgtgaacgaggctcgcgtgcgcgacgtgttgagccagatggccacggacgggtacctgtcaatcgccgaagggcgtatgccaatcgtcatgttcggtgcgcgggcggccgaaaccgccgctcccgacttccactatgagatcaaacgggtggaacgcaagtcggaggcggccggttccggtcggagcgggggagtggctgatactgccgattccgccaatgttcccggcgatgcgctgggctcgtatatcccggacgatgacgaggaatcgctgttccagaagctacgcgaactgcgacgcaccatcgcccaggaaatcggcaagccgccgtacatcgtgttctccgacaagaccttgcgcgacatggcccgcatcaagccggttaccaatgcgcaatttctggcggtcaacggcgtcggtcaacacaagctcgacctctacggccagcgcttcatgcaagccatcgcctcgttcaatgccgggagtgcgtcataacaatctcctatagcgaactgcggagtatttgcgggcgttcttgggctggctcgactacgatgactgttcgatgcttcatgaccgaacactcggcaagtagaaaggcaacagcatggcagaagaaacggccgaaaagcccgtcgtcgaatcattccagcttgatcacaccaaggtcaaggcgccgtacgtgcgttacatcgacaccgaaacgggccctcacggcgacgtgatctccaactatgatctgcgcctgacccagccgaacaagcaggccatccccaccggcggcctgcacaccatcgaacacaccatcgccgtgctgctgcgcgaacgtatcccgggctacatcgactgctcgccgttcggctgccgcaccggcttccacctgctgacctggggcacccaccccaccgaggaagtggccaaggccctgaaggaatcgttggagttcatcgcgtacaaggccacgtgggatgacgtgcccgccaccaccgagaagagctgcggcaactatcgcgaccacagcctgttcaccgccaaggaatgggccaagcagatccttgaggaaggcatcagctccgacccgttcgagcgcaaggtcgtctgatcgcaagccaatcggcatggaagaaccccgcccccgcataccacgcggacggggtttctttgtgcctatgtttgtgcctatggcatggtaggtttgccgtcagttaatcgttggccgctgcacatcggtagcttggcatgttggagaggtggaagtgactcagtcgaacgctgcaaacaaggcgacaggccgccgtttccgccacgccaccatgcgcgatctgccgcagatgcagaaaatctacgcacgcgcacgcgcgttgatggccgccaacggcaaccccacccagtggggcaacgaatttccgcgtgaatcgatgattgaggacgacatcgccaaccagcgtacgatgctgctggtcgacacctgcaatggccacgaacgcattctggcccagttcgccctgtgcccgggcgaggatccgacctacgccaaaatcgacggcgcctggctggacaacgacgcctatgtgaccatccaccgcatcgccgcatccggtctggtgcgccacgcggcccgcgactgtatcaggtgggccctgaagcactacggcaacgtgcgcgccgacacccaccccaataacaaggccatgcagcacgtgctcgaaagctccggcttcgcccgttgcggcctgatccagctgctcgaccggccggtcgacaccaccagaatcgcctatcagcgccacgagtggtgagtgtggctgccggctgatgtgctcgtttctgcaccgtcatcggtttctgacggtagaatcagtgtgtgagaagaacacgttgggtcgggggcgtcgtgacggtgcttgcggctgtcatgctgtcgtcgtgcggcggcgtccagtcgaatcccgggtaacacaccgttgccaatccattcaccgcgcaggtgaatggagaagacatggcgatgcctgtcggccgatggagccccatcggccgacaggcatcgaggaagtcaccgtggccggcggaacgcgcggtcgccgattggggcgaatggcttgtgtggttcgctttggtaccagtaggcgaccgtggccacgtcgtcctgtcgttcgaagttgccggcttcctcggtgccgatctgctgccattcgacgcgcaggtctcgctcgaagtagatcgggtcggggatgtgccaacggtataggccgcgggtcacgggggtggcagtgtcccagtaggcgctttcgcgtccggcgaggttctgcgagtagaacgggaagccgaggtatgggccggtgaaggtgcgctcgtgcatgcggccgtgttcgtcgaattcggcgaagctccaggcaccgccgaagtagtcctcggcgccggtgctgcaccaggtggggtatttgccgtcgccgtcgatgtagaacttgaattcgccttcgccccaccagcggctttcgagcgcggtgagcgccaggtaggtgccgacgtaggtgccgtgtccttcgacgccatcgagcaccacgtagtcgtgggcgagttcggtgacgcgttggcggcgccactgcgcgtggaagcgcatcgtgtcggccggcagccggtcgtattcggtgtagtcgatttggtagaagaacgcgggcacgtcctcgttgtggtcgttgcgcagcacgatgcgcgcgtgttcgaacggcatggcgaagtagcagttgaagccccggttcgggttgaccatgacgggaattgagttgatggtgcaggactgggcgtgtccgcagcagaagaagtcgccgatcgggcattgcaccgagggggagtcctcgccgtcccagtagaattccaggatcaggttgcgtagcacgtcggggccggtgggggaggtgcggtcggttaccgtcatccagatgtgacgaatcacgccggggccctcgacgtccatcaatgtcaccgattccccggacctcaccgtgctgatgcaggggcttcccttgcgggaggggcccaacgcgctggccgccatggccgcgcggcccttgccgccgtccgggttttcggcgttgatgcagcgggtgcggccgggggtcctcatggccacggcatccaaggcgccttgtccgagccccggcgcggggttcgctgtggtgaatgcgtcgagcatgatgcttacttcctttcctgtcgcaggcccgtcccgccacggcgttttgtctggggtgagccgggctgctgggggggggagtatttcacggcaccggcggtgatgccctgggagagcttgcgctggggtagtgcccgatatcttgcgcactttggtcttcgcccgtccctgtggcgatgatcggttcgcttcccgtacagtctcaccgagtcttgacatgtcgaggtagcggcgcgtcgaccactcgttcgacgtgacatagcgcacgcgtgcgcagacgagcatcaacgcgctgcgttcgtcggggaagctgccgaccatgcgcgtgcgccgtctgacctcgcggttgcgggggtgaccctggcgaggacgttgcgttcgaagtgcaccatgcaccgctggtagcgggcatcgcgttcaaggtctccttgacgctcttgcggaccatacggtccagggtggtctccgacatggcctcatatcgcaaaaaccgtacgctgaaagtaactcagcgtacggttttcacgaaagcagccatcggctatcggtcagccgatagacctcagtcctcagtcctcagtcgcagcgaccttggcgtcagccccggccttctgctcaaggccgagcttggagcgcttgcggctgtagccgaagtacacgatcaggcccagaccgaaccagacggcgaaacgcacccaggtctcccagttgagaccggcgatgagcacgaagcagaatacgatggccagaatcggggtgaccggcacgcccggcgcgcggaagccgcggggcgcattcggctgggtcttgcgcatccatagaataccggccgacacgatgatgaacgcggacagcgtaccgatgttcaccagctcgaacagcacgttgatgttgatgaagccgccggcgaacgcggtcagcagaccgaagaaccaggtgcccttgaacggggtacggtacttctcgtgcacgtggccgaagaacttcgggaacaggccgtcacggctcatggcgtagcagatacgggattggccgtacagctgcacgagcatcaccgtggtcatgccgatgagggcgcccaggttcacgatcaccgcgagccagttcatgccggtctccagaatcacgccggccaccggggcgtcgatgtacttggcgaactccttgtagggcaccacgccggtcatgatcagggtcatgatgacgtagagcacggtggaaacggccagggacagcagaatgccgcgcggcagcgtcttgttcgggttgatggtctcctcagcggaagaggacacggcatcgaagccgatgaagctgaagaacacgatggaagcggccggcacgatgccgtacggctgggtggagccgggctggaaagtgtagatgccgtacggggagaacggctgccagttggacggcttgacataccacacggcgcacacgatgaacagcacgatgatggcgagcttgatgagcaccatcacgtcattggtgcgcttggtctggttgatgccgatggagagcacccacgtgatgatgagcacgatgacgaaaccgggcaggttgaagtaggtggtgacgtccgggttggtgccgtaggcggcggtcagctcgaccggcaggtgcaggccgaagccttccagcagtttgttgaagtagcccgaccagccggcggacactgtggccgcctgcagggcgtactccagaatcagatcccagccgatcacgaaggcgatgagctcgccgaacgccagataggcataggagtaggccgagccggacaccggggccatggcggcgaactcggcgtagcacagaccggcaaaaccgcagcagacggcggccagcaggaacgatacggacagggccgggccggcggtcagcgcgcccttgccagtgagcacgaagataccggtgccgatgatcgcgccgatgccgagcatcgtcagatcgaaggtgcgcatcgtgcgcttgaggggagtggattcggcgacaagctgatccacgcttttcttacgaaacagatccatgttcttctctcatgaaatctaggattatggggctgaaccggacggatttccgggatcccggcacgcctcaacgccgggaatcaaaggcggcttccgagaaaccgcatatcggtcattagtgtacgactgccgggcgaaaacagacgattgcgactacacgtcacattctcgcgcaacaataggtgtctatgagcatgaacgcagcacctgaaatcgcattctcgtccgagcagggcaaggccaactatgcggccgcccgccgccaataccccgcacaggccatcgtggacctcaaaaccatgcgcgacaacatggcccacctggtctccgtggtcggcgggcccgcttccggcacggcggtgatgggtgtggtcaaggccgacgcctacggccacggactgctgcccgccgccctggccgcgctcgccggcggcgccacatggctcggcaccgcgcagtcgcacgaagcgttgctgctgcgcaagctcggcatcggccccgaccgctgccatattttgacttgggtatacaacggcaccgaagtcccgttcgacgagctgatcgccgccgacatcgacgtatcggtcggctccctgcccggcatcgatgccgtggccgccgccgcacgcaagctcggcaagcccgcccgcgtacacgtcaaggtcgattccggcttcggtcgcaacggtttcacgccggccggattcgacgccgcgctcgccaaactcgtgccgctcgccaaagagggcgtgttgcatattgtgggtcagtggagccatctcgccgtggccgattcgcccgatgtgcccgaattcgtgtcctccaccgaccgccagatcgaaacattcaaggacttcacgcgccgcatggaacaggccggcattccgccggagatccgtcacctggccaacacggcggccactttggaccgcccggagattcacttcgaacttacccgccccggcatcggcctgtacggctacgagcccgatcccgcgatgggcaccccgcgcgactggcatctgaccccggccatgcgcctgcaggcgcagctcggcacggtcaaggatgtggaggccggccatggcatctcttatggccgcacctacctgaccccggacaacacctcgaccgctattgtgccgctgggctacgccgatggcatccaccgctccgcttccggtttcgatatggaaggtgccaagcacgtggagaagccgggcggcccggtgcgcatcatgaccactgaaggtccgaagctctaccgcgtgtgcggccgcgtgtgcatggaccagttcatcgtggacctgcacggatccgccgccgaactcggcgttcacgagggcgacacggtcgaactgttcggcccgggccgcggcgaggattacgttgagcctaccgccgacgattgggcccgcgccgccgacaccatcagctacgagatcttcacctgcctgcgcaaccgcatcccgcgcctttacgagcatgccgccgaagtactgcccgccgccgacctcgccaagctcgaccccgccacgctgctataaggtgcattaccgccatacggtggcaccccgtaatcccttcttcccgaatatgtgccgttgacatgtgctgagcgtcacatattcgggaaatcggccccaatctcccgaatatgtgctgttgagttgacgtcagtggcacatattcgggaagtcgggattactgcggccgatatgtgtgcctatgcttggaatatggaaacgactttggatggggaacaggtgctgagcgatgagggctacagcgccttcgacgaggagcggtgggcacccgagccgcccaaatccaagtcgcgcacggctttcgaacgcgatcgcgcgcgactgattcattcgtccgctttgcggcgtttgggcgcgaaaagccagattctgattgccggtaccgacgatttcgcccgcactcgactgacgcatacgctggaagtcgcccagatcggtcgccaaatcggcgcattgctcggctgtgatccggacgtggtcgactgcgcctgtctggcccacgaccttggtcacccgccgttcgggcacaacggggagcgtgcgctcgccgacatcgccagcaatatcggcggcttcgagggcaacgcacagaccatgcgtatcctgacccggctcgaacccaagatctttcacccggacgggcgttcggccggcgtgaacctgacccgtgcggccttggatgcggccgtcaaatacccgtggaccttggccgaagccgaccgacacccgaagggggagcggtcgaagaaattctgcgtctacccggatgacgaaccggtgttccgctggctcaaaatcggcgcgccccaggccgccaaacccatggaatgccagatcatggacctttcggacgatatcgcctactccgtgcatgacgtcgaggattccatcgccaccggcgcgttcgatccgattgtgctcgccgatccgaagatgctggaccacatcatcgagcagacgcgcgcatggtatggggcgaagtgggatgccgacaagctgctggccgcgttcatgcgattgcgccgagagcatttgttccctgcacatttcaatggttcgcgcgaatcgttggcgcagcttaagaacattacgtccgatttgatcggccgcttctgctggtcggtggagaccgccacgcgcgacacgtatgggcccgggccgttgacccggtattcctcgaacatcgtgattcccgagaacacgaattacgagatcgtggcactgaagggcatcgccgtgtacttcgtcatggcgcctcgcgagcgcgagccattccatcaggaggagctcaagatcgtatcggatttggtcgatgtacttatggctgattcgccgctcccatccgacgctttggaaagccagttcctggccgattggaacgaatccaccaacgacgacgaacgcctgcgcgtcgccatcgatcaggtcgcgagcctgaccgacaactccgccctggccctgcactccatcttgtgctgagggcgtgttgggcgggcgcttccctcagtctcgctgcgcgagccagctcccctcgggtgaggggagctgtcgctgtagacgactgaagggagtttcgcggaagaaatgataaccgacggtaaaaatttaccgtgtctcaggtgaggcggtactctagagacttatggtcggaatgattaagaaagaagatgtcgagaaggtgcgcgccgccgcggacctgtatgacattgtatctgcgaccgtaacgcttaagccctccggcaccggcaccttcgtgggcctgtgcccgttccacgacgagaaaaccggcagcttcaacgtgcgtccctcgctcggcgtgtggcactgcttcggctgcggcttgggtggcgacgtattcaaatacgtcgaacaatccgaaaacatcgacttccgcgaagccgtggaactgctcgccgacaagtaccatatcgagctgcactacgagaacagcggcaacggcccggcgcgcgagaacaccggctccaagcgcacgcgactgctggaagcctgcgaggaagcccagcgcttcttcgtctcccagatcttgaccaaggaagcactgcccgcccgcaagctgcttggcggccgcaacttctcccaagctgattgcgaacgtttcggctgcggctacgcgccgcaaggctgggataatctcgtgcgccacttggcctccaaggggtttacgcagaaggaaatcctcgacgcgggcttggcccgtcaaggccagcgcggcatctatgactatttccgcggccgagtgacctggcccatccgcgattcgaccggccgcacgctcggcttcggcgcgcgcaagctgtatgaggacgaccagatcgccgccaaatacatcaacacgccggatacgcagctctaccgcaaaacccaggtgctttacggcatcgatttggccaaatccgccatcgtcaagaagcggcaggtggtgatcgtcgaaggctatacggacgtgatggccatgcacttggccggcatcgacaccgccatcgccacgtgcggcacggcgttcggcgccgagcacgccaagattgtgcgccgcctgatcgccgacgattcgctgggtgcggtccagctggtcgggccgttgaaggtcaaggaccagccgttgagctcgcgcatcgtgttcacgttcgatggtgacgccgccggccagaaagccgcgctgcacgctttcggcctcgattcggccttcctctcccaaaccttcgtggccgtggccgacgacaatctcgacccgtgcgacctgcgcatcgagcgaggcaacgaggcagtgcgctcgctgatcgcccgggccaaaccgttgtatgatttcgtgatcgacgccgccatcagccggttcgatctgacctacacgcccggccaagtgggtgcgatgaaagccgtggccccgctggtggcgcagattcgcgaccgctccctgtgggacgcttacgtgcgcaagtccgcgggccgtatcggtgtggaccttgaggtgatgcgccgcgaggtgatgaacgcacgccggcagatgcatgtacgcgatgaggacgcctacgcgcccaaacgtcgattcgagcgtgacgagccgcgtgtggaacccggcaccaacccgtacgccaatccggccacgcgcaaggccttggagcgccgtgacgccgccgaacaggcatatttcaagatcgacgacgccgtattcatcgccgaacagcagttcatggccgtgctgattcaggtgccgcgcgccatcgaccgcaccatgttcgggcagctgaccatcgaccatttcatgacttcggtgttccgcaccctgttccaggcgatcgcggccgccggcggactgccatccgacgataccccgcaggggctgtggatgcacaacctcaccaaggccggcgggccgatgctcaatcaggtgatcaacgagctggctgtcatgccgctgcctctgcctggcgacgacagtggcaacggtgcgcagccggtgcaggccaacgtgtcgggaggaggtgttggcgtgaatggcggtgccgccgcagtacagctgcgtcctgccacgccggaggagcagcgctacgccactgagcttctcacccgattgttggacatgggcttcatgcgccagatcggtttggccaaacgccgcatggcccaactgcccgacggcgaagagaagataaccctcctcggccaaatcgcccgcatggaaaccgcccgcaaagacctccaagcccaaatctacggcaacaccatcggctaataccccccccactgattgcgcgcatcctcgaatacgtgccggatgcataagtccatacaaccggttgccggattggatgggtgcagaagttgcggattggccccatccaaattggactggtttgggtgggccaatccaatccgttcaataatgaagcgcgataccaagcagcgtcgaaacgaagggaaactcatgacgcagaatcgtgcggaactcaaccgtaatctggcccagatgctcaagggtggcgtgatcatggacgtcaccacgcccgaacaggcgaaaatcgcgcaggatgccggcgcatgcgcggtgatggcgctggagcgcatccccgctgacattcgtgccgccggcggcgtctcccgtatgagcgatccggccatgatcaagggcattcaggaagctgtctccattccggtcatggccaaggtgcgtatcggccacatcgccgaggcccgcattctgcaggccatcgaaatcgactacatcgacgaatccgaagtgctttccccggccgacgacgtgtaccacatcgacaagaaccagttcgacgtgccgttcgtgtgcggcgcgaagaacctgggcgaggcactgcgccgcatcgccgagggtgctgccatgattcgtaccaagggcgagcccggcaccggcgacgtgattcaggccgtgcgccacatgcgcaccatgaacaagcagattcgcgagctcgtggccttgcgcgacgacgaggtctacgaggccgccaagcagctggccgtgccctacgacctggccaagtacgtgcacgacaacggccgtctgcccgtcgtgaacttcgccgccggtggcgtggccaccccggccgacgccgccctgatgatggagctcggtgccgaaggcgtgttcgtgggctccggcatcttcaagtccggcgacccggccaagcgcgccgccgccatcgtcaaggctaccgccaactggcaggacgccgatctgctcgccaagctgtccgaaaacctcggcgaagccatggtcggcatcaatgaggacgagattcagaccatcatggccgctcgcggcgagtgagtgcattaccttggctcccctctttgaggggagctaggaaagggtgacgctcccgccagcgggagtcaaggcccaaggagacaacatggttgtagctgttgaatatatttccaaagaagaatccgcggacgccaaaaacgccaagcacggcgtgaccggcatcctggccgtacaaggcgcattcgccgaacatgcggcggtgctggacaagctcggtgcgccgtggaaactgctgcgcgcagccgaggatttcgatgaatccatcgaccgcgtgattctgcccggcggcgaatccactacacagggcaagctcctgcattcgaccggactgttcgagccgatcgccgcccacatcaaggcaggcaaaccggtgtttggcacttgcgccggcatgattctgctggctaaaaagctcgacaatgacgacaacgtctactttggcgcgctcgacgccgtcgtacgccgcaacgcctatggtcgtcagctcggtagtttccaggctactgccgattttggtgcagcggatgatccgcagcgtatcacggacttcccactggtattcatccgcggaccgtacgtggtgtcggtcggacccgaagccacggtcgaaaccgaagtcgatggccacgtggtgggcttgcgtcaaggcaatatcctggccaccgccttccacccggaactcacggacgatacccgcatccacgagctcttcctgtcgctgtagtcgattcgtctgccgttagactggtatccgattgacgaatcaaggagacgatctgccatgcagcttgagctgaatcgacgcagcaaggtgccgatgtaccggcagctggccgccgagctgcgtgaacagatcgtctccggcgcgatggccgagggctaccgcctgcctcccgaacgcgagctgtcctcacgtctcgaagtcaatcgcaccacggtgttgcaggcgtatcagcagctcaaggacgaaggtcttatcgcctccaaagtcggcaaaggcacgttcgtgctgccggctgcctccgcaagccgaacatcgcacacgtcaaacagtgacttcgggaatgcaataacgcgaacaacacgatcgtcggcagaaatgggaacatcgcaagcctcctcttccggcgacgtagaacgtgctacctccactgatttcttgacgacagaccagggcagcagctctgcggcggtccatacgattcgtgaaagccgttcggttcagggcccggaaccaaccgtcgtgcgtccgccatggtcggtgttgttctctgattattccaaccggtttacctaccatgacatcgcctcggccgagcgggcgcagcgcggcgacaccattattgacttcgccaccggttcgccgaacccggcggatatcccggacgatctgctgcgcaaggtcagcatcgaagcattcgaatcgcgggaattcgacggccaaccggaatcacctatcgagggattcgaagagttgcgtgcgctgcttgccgaacatatgcgcgcacgaggcgtacaatgcggcgtccgcaacgtgatggtgctctccggctccgagcagggcattgacctcatcgtgcgcgcgttcatcaaccccggcgactgcgtgctggtcgaacaatccacgttcttcccggcattgcagaccttccgctcggcggatgcgcgcatcatcggcgttccagtggacgagcacggtatgcgtacagacctgttggacggctattgcgcgcgattccggcccaagctcatctacaccgtcccgacgttccaaaaccccaccggtaccacgctgccgcccgaacgacgcagcgaactcatcgacgtggcgcggcgctatcagtgtctgatcgtggaagacgatgcttacggcgatttgtggtacggcggggaatcgtccgacgcacatcgccccataccgcttaagggcatggagaatgcgggatacgtgatgtatttgtcgacgttctcgaaaaccgtcacttcgggcctgcgcacgggatgggttgtggccgacccgcatgtgattaaccggctggcggctctgcggcgcatggtcgaccagcatacgagcacgtcatcgcagcgcatctgtctggaactgcttaaagaaggccgcatcgccgaacatttgcgcggtttgatcaagacttaccgcattcgacgagatgcagcaatcgcagcattggagcggtatgcgccggatgaagtgtattggaccgtgcctgcaggcggctactatatttgggtttctttgccggacggcgtgcgctctctggatgtattggaatcctgccgttcccaaggcgtcacgttcatgccgggcagcgtgttcgacgttgacgaaatggatgattcccacatccgtctcaactttgtgcgcccggatgctgctgacattgataccggcattcgaatcattggcgagacgatagcacagatgtagccaagtgactggctcattgcggttgtcgagtttttttgatggctgcatacccacatcgatgggtgcattcgacgaatgaataagcgaggaagccatcatcagttcgctgtggcatgcgcatagcgttgtcgggcgaacggggcagaccacgtggtcgttgcgtgacctggccgatcgagccggcatcgcattgcccctggcgtagtggcgaggtggcgcagtaacgagtcacgccatcgcgagccgatgatgcgaaatgcggaaccggtcgcggccatcaacggctatcatacatgcggaagcaacgatacgttggcgtcagcacatccatctgactccagaaagggacacgatatgaccacatcctccgtttcgccggtgaccactgaactggcgggcagcgaaaccggcatcacgcttgtcattcacgccggagcgggcagtcgtggcaagcacagcacgcctgaacgcatcgcccaggtcgaacttgatctgcagcgcgccctcgatgccggataccagttgttggaatccggagcaccggcgcatgaggctgtggtcgccgccatccacgtcatggaagacgctcccgaattcaacgccggccgtggtgccgccctgaccagcgatggcatcgcccagatggacgcctgcctgatgaccggcgatggcgaggtcggtgcggtcaccggcgtaagcaccgtgaagaacccgatcgatgcggcgcgtgccgtcaaagagcagaccaagcatgtgctgttcgcggacccgaccgatgccgagatcgccgattggggcgtcgcgaccgaaagcaacgagtacttcatcaccgaacagcgtcgtcagtccttggccgaggctcagtccggtggcgatgagtgggagaagcatggcaccatcggtgccgtggcgcgcgatgccgagggcaatatcgccgctggcacgtccactggcggcatcaccaaccagatgcacggtcgtgtgggtgattcgccgctgcctggttgcggcacgttcgccaaccagtccacggtggcggtgtcctgcaccggcatcggcgaggcgttcatcaaggtggtcgccgcccatcaggtgtcggatcgtgtgcgtttctccggcgagaacgtcgaggatgccgcgacggccactttggacgaagtcgccgcgcatcatggcgatggcggcatgatcgttctgccggcggtcggccgtggcgtggtcgcctacaacagcgagatgatgaacttcggataccgtagcgcgcaaggaggtaaggtgcagggctgattgccccctgtattgcggcatatatcataatggccggtgtgctgcggattcttggtaaggaatccgcagcacaccggccattcatgtatgcggcaagtgccgccgatcagtgcggcagtgcgcgctacttggtgatcgtgttgtacgtgggcatgttcgtgtaatcgaactgcacgttcttcacgttctgtgcagacacggcggcgaaacgtttgaccgggaatactggggtaatacgcaacttcatcgctcctcttcctcgaatgaaactatgttccattggtatgagccagccacgtacggtattcgtgtctggcctgccacacaatgatgcagccgtatatacgggcacagcattgcgcggcagttcattgtatggaagacatgcaaactcaatgtttccttgtccaaataaaaaaacgagcgcggctgatgtgcggcaccggtccaaaaactcatgtccgccagcgcaacgcgactacgtaccttatgctggtctgcgcgtaaaatagaatggttgcgatattgggttattcacggaggaatggatgcgacgctggctgatcaatgtagccaaaaatgagacgattctcatcgtcgccgcaatactcgccctgatttcgtgtttcattgtgccgccggacgccgattacaaaagctacattcacgccagcaccatcagccagctcatctgcctgatgattgtggtgtgcggattccagcgtatcggcgtgttccgcatcatcggttcgcgattgctggagaaggtcagcaccatgcgcggactggtcattacgcttgtcgctttgacgttcttttccgcgatgttcatcaccaatgacgttgcgctggtcacgtttgtgccgttcgcggtggccgtgctcatcatggctgggcaagaggataagaccatcctcgtggtcacgctgatgaccattggcgcgaacgtgggcagtatgctcaccccgatcggcaacgcgcacaacctgtatctcaaagccctgaccggcatgccgaccatggaattcctcggcatcatggcaccgtattccggcacggcggccgtgttgctggtcatcgtgatttccgtggtgtttggcggcaaaccggtcggcgacctgggcgacctcgaaaccggcgtgctggctcccgagcgcaacaaacaccagcccgacgagattcgtatcaccggctacggcgccggttatggcggctggcgcaccatcgtctactcgctgctgttcatcgtctgcctactggccgtctccgacgtgattcccctgtgggtgatgtgcgtgatcgtggtcgtcgtgttcctgttcaccgatcggcgcgtattcaaatacgtggattggggactgccgctcaccttctgcatgttcttcatcttcatcggcaacatgaagcgcgtgcccgaattctacgaactggcgcgctcgctggtcggcggccatccgctggaggtggcggtcggctccagccaggtcatcagcaatgtgcccaccacgattctgctttccggcttctgcgaccaatggcgcgatctgatcattggcaccaatttgggcggcatgggtacgctcatcgcctcgatggcctcgcttatttcttacaagaacgtcgtgcgccaatacccgcacaagaaaggccggtatctggccgtctactccgccgtcaacgttctgtttttggccgtattgctgaccttgagctggatcatcgagccgagtctctgagccgccgttgtgggttgggccggtctaccgcgcgtatacggtgggggagccggtcagtcggctcatggccgactgcgggatgtcgtggatgcggccgatggtggcatccagcgtggatacgccggatacgccgtctgtgttggctgtgttggctgcagaggtgatgctggatacgccgactgcggacgatgatacggccgcaaccatcggctgacgataggcgttggagttgcgggccagccgggcgagcgcagggcgctgcctgcggaacagattgataaacataccgcatactccttcatcgttggccggcggtcttctggccgccgtggtttccatcctgccctcccgtgcttgtattcgctatgggggatagcccctattattccctgaatctgcacgattccccctcatccttgagggtgattctaacggcaaaggaatcggcctaatggccgatgtcgatcagcgcgaagccaccagcgtgacgctgtacggcttgatcttcatcgccagcaatgaagacggcgacggcaatgtgtaagcccgacgttccggcacaatcgcccccgaagcctcgccgcggtatccgatagtggtcttcgccgtcggattggcgcttaacgtcgtcacctccaaacgcaccggtcgcgatggcgaggcgcccagcccggccagtccgcgcgcgatttccaacgtcacatccaccggggaatcggaggtattgacgattttgatgtaacggcaggcgtcatccccgtcatgcccggtggcactgacatacagatgtttggcggggcgtgacgcggtctgctcgatggacacggcatatgtcgtgtcgcccagatgcgtggaaaacagccgctccacctcataattcaccgtggggttcacatgcgccgaattgagttcgataagattctgcgcccaccccttagccgggatatgcgcgagcagcggtgcataggaggtcatgcgcaccacgtcggaattgcgctcgcaaccggtcaggaacgcggcctcgccgagtgccgacttccacgtgttcgcgccctgttcggtctgcggttggccggcaaaatagccgttggctgaatattcgccgaaatagacgccggcgccgcaacgcgggtaagcgtcgaatcgtgacgcttggtatgcaaaccattcgggggagtgataagaatgttcgtcgacgataatcgcgtcaccggtggcggaatcatgtgccccggaatcggttgcggccaacgctcgcgcatggtcccagctgcgtttcatcgtcggctggaaggggaacagtccggcgctcatcacacacagcatatccgggtatcgttcgtgaatggcctcgctgatcatgtcaaacttggccacgtagtcagccccgaaattttcgttgcccacgccgatcatgtccaggccgaacggttctggatggcccatatcacgccggaccgcggcccacgagctggactccggatcgccattcgcgaattcgatgaggtccaggtagtcctgaatcacattgttgcggaaagtggccgaattgatatccatgtggtgcggatcgcggccgggcgactggcatgcgatgccggcgaacagagtgggcagcggcttggccttgaggtcctcgcacaggcagaaatactcgtagaagccgatctgatagctctgcgaatagctggaaccatccggcatcttgaacgaccacatcgaatactgttggcgtcgcgcggccagggagccgacggtatccttccagcgatattcattgccgggcgtcacaccttcgacgatgcagccgccggggaatcgcagaaacgctggatgcaacgcctgaatggtttccaccagatcgcggcgcagcttgccgtaacgccatttcgggtcgcccgcgccccaatagtccgcatccatgaactgcaccagatccagatcgaacgtggtgcgttcgccggcgtcaatggtgatacgcagcttgccgtaatcggtgttcaggccggttacgtcggcgttgaaccggtaccagccgtcacggccgatggcgatggcaccatccgacgaatccggactgatcgaaacgccggaatcctgcgcattggcaccatcgtcctgcctcagaccggtctcttccgtatcgtcaagcggatctgcgtccacgatatacgacaatcgagtggtgctggtgagcggcagaccgtacctatcgaccacgccgacggacagcttggcccgcccatgaaccggacgtaccgcgagactgacggaataggtgtggtcggcgacgatggagaacgcgggctcgcccccgttgtcgccgcctccgttatagccgaggttttccagatatgcagggccggtttcggaaggaacatcggacgtgatgcgagcgtatcggctatgtgcgtgaattggcggggcggggcagtcggtggtcacccgctgaccgtgaatcccgcgtatctcactgccgaggctggcggcggaacagttgatgaaatcccagaaacgcagggaatcggcctgtgtacgccatcgttcggcgccggccatacgccacgtgtgatggtcgagatagacgccgtcaaaactgtagttgttcaccatgttggcgttcagcccgccatccgcaccatggttgatgtcctcgaagaacacgccgtacagccgcccgcttgtgtgatgggtggggcttcccacgctaatccgcaccatggttttgattgtagagggaatggagcggaaaggtaaacggaagagttcgctcaccgttcatgttgcggtcaatccaagtcgactgttcgccggtatacagccggtaccctcgaaacaggaatggaaaatacggacgactaggagcgcggctgtgcaatcctcggtgggaatacgtgagcgcatcgaccacgtgtatccgtcgctgcgtccggcggagcgcgccgtggcccagtatattcgggatcatatcgaggaggcggccgacctgaccgtcggccagatggccgacatcgcccacgtcagccagccgacggtgattcgtttcgcccgcaagctcggtttcggcggttaccgtgaactgcggtacgtgttgcgccatccggccgccgagcacaaagtgaccttcaatccgttggctggattcgatctgaatccgtgggatggcgaagatgagattcccggcaaagcggcctatggcgcgaaggcgctgatcgatgagctgcacagtgcgttggaccccaaggcctatcgcaaggcggtcgccctactcgccgaatcggagttcatcgatattttcggcgtggagaactcgttgacaccggcgatggatctgttcaccaagctcggctacctgggactgacatgccgtctcaataccgacgcttacctgcagcagatcggtgccgggcacctgccccacggcgctgtggccgtcgccttctcccattcgggcagttcggcggatacggtcaaagcgttgcgattggcgaaatcgcatggcgcgaaaaccatcgccataaccaatgccatcggcgcgccgctggccagctgggccgacgtgacgttgctgacgggtcgtgactcgcacacgatctatggcaatgcgattttctcgcgcgtggccgataccgcgctcgtggacatgctgtacatgggcgtgattctgtccgactacggccgtttctccaccgcgctcgacgaatccggtcgcatgattcgcgatcgcgtattcgagaactgagctgctgctttatcgtgccttgggctgtattgctctggtcgttgctgcttgggttgttgacgatttggtcgttgtcgccctggtcgctaccgtcctgaggcatgtgccagcgaatacgtagtggacttggcgtgcgtatgacgttcgatcttgccgctcaactccagctggtccaagagctgcgtcatctgatccttgttcaggccaagcgctttctgcatggttttacggctgagcttcacaccgcggaacgcgaggaaattgagcgtgaactgttccaacgtttgaggcgacggttccagcgtcgctgtatcgagcgggcgggtactggcctgatcgtcaccgtccgggcgttcgccgaatccactgccgagaatcagcgtctgcagtggcgcgcagccgatgatgcgtgcgccggccaaagcatctgcggcgttatccgtcatgcgctgaatcgtggggaatgagtacattttggcatgctgtgcttcgtcagtggtgctgggcgcggcggaagcatcggcatcggtccgatgcgaggacgcggcctcggccgatacagggataggcagtaccattgccaccgaagtggggcccacgcgcagttgcggactgaccgcgctctgcgcgtaggcgtccataatgcgttgaatgccggtaccgcagttctcgcagaggcccaaatcggcgaacaattcagccaaacgcggggtgcgtggctggcatacgccgttgagtagatcgttgatttccaaaccatcggtcaggccgccgagcgacacgatttccaagcgggaatcgaagatattgatcagtgtggggccggagtacgtgtaatcgcgatgttccagtgcgttgaccaatgcttcgcgcagggctatggccgggtattggccggattcgttgatgccgttcagcagggcgctggcttggtcgagctggcgcagcaccgagccggtgaatgtgtgacgttcgcgaatggcgtttttgccattgccctcgaaaatggtggccttgataacgaacgggcattggttggacagcagggtggcaagcgacgattcggtggtgctggtgaaggtgttgttggtgccggtgttggtgatgctgccggcggggacattaccggcatcggcagagacggatgcagccatgttggtcacaaccgggctttcccaatccttgccttcactggcaaaacgaccctgtgcgtatgtgaaagtgagctcaccgctatcgcctgcgacggtctggcccgatgcggcgtgatctacgttgctctccgttgtccccatatcgccgatggtaccggtgcaagccgacgttacgccgaggtgttttacacccctacggctagacttacacgagtttggccccgtagctcagctggatagagcatgtgacttctaatctcaaggtcgacggttcgagcccgtccggggtcacgatgtaataagcccttggtccctcatcgtttgtgaggggcaggggcttttgaatattatgccggtctgggtccgtctggagcctgaactgtcgaccttgagattagaagtcacatgctcatcaccaccatccgggaacacccttaaggggtgcgtctcctgcataatggttatactctgacttgagatgtgctgaataataaccagctatcgcgcgtccgccaatggcgacgaacgagggaagaaggcccgtgccacgagcaatcatcgaggtaagaaacctacgcaaggaataccccgtcgaggatgagacggtggtggcgcttgaccgtgtcaatctcagtatcccgcaaggccagatctgctgcattttcggcgaatccggctccggcaaatccacgctgctcaaccagttggccggcatggaaaaaccgacgcgcggcggcgtgagaatcggcggcgtacccgtcagcaaactcgacgagcgtgagctggcggccttccgccagaagcatcttggcttcgtattccagtcgtacaacctgctgcccaatctgaccgcgctcgaaaacgtggcaatgccgctgatgttccgcggcgtgcccaaggaacagcgcgaacgtgcggcgcgtggcgtgctcacaagggtcggtctgggacatcgtctcagccattacccgcgccagatgtcgggcggccaacagcagcgcgtcggcatcgcccgggcgtttgtgaccaagcccgaggtggtgttcgccgatgagccgaccggcaaccttgactccaaaaccaaaaccgaggtcatgacgatgatctgcgcattcgcccatgacttcaaccagaccatcgtgctggtcacacacgatccgcagatggcctcatacgccgaccgcattgtcaccttgctcgatggccgcatcaccagcgatcggctcaacaccgacctttcccgcccaactgttccgtccacgccgtccgcccaaagaacccaaggagttgaccgatgaagcacctctcccaccgcaccatcgccatcatcgtcgcgttgctctccacgctgtcactggcacttgccgtcatctcccttccgcaccaggcgtacgcggtcgacggcacagacggcacaagcggcacgaacagtacgtctcagggaagcgacggcgattccgcgccaatcgccggcccggtgccgaacatcatcgtcaccaacttcacctatggcggcgattccgtggccgccggcgccgatttcaacctcgacttcaccttccagaacatgggtcaggtggcggtgacgaacatggtcatcaccgtggacggcggcgagagcttcgccatcgcgggaggcacgaacacgttctacgtcgacgcgctgtggggcggttacgccatgacgcaaagcgtgccgatgcaggcgctcgcctccgcgaaaagcggtgcccagcccgtgaccgtgaacttccgatacgagtatgtggacgccagcgcccgctcctcaagccagtccgatgtcaagatttccgtgccgatcagtcagcctgaccggttcgaaatcagtgatcccgtagtgcccgaccaggtgatcgccggtcaggaaaacacggtcacgatggaatatgtgaacaagggcaaaggcgatatcgccaacgtcgaggccacgatggagggcgaaggtttcgatgccacgatgaaaacccagtacgtgggcaatgtggcttccggcgccaccggcacgattggttacgcctttacgccgcacgcgtcaggcgagctgaagaccacgctcaaagtcacgtacgaggattccgacgggcagaccaaaaccaaggaattcccgctcgccatacccgtaaccgatatgcagccggtggatgattccgacatggccgatccgaacatggaccagagcgccaatcagggattgccggtgctggtgtatgtggtcatcgtcgtgatcgccgtggtcattatcgtggtgattgtgctgctggtgcgtcgccggcgcaagcagaaggccaagaagaacgatattgatgaggactgggatgattggtccgaaggcaaggatgataagaccgataccggcgtgacggatggtgctgcggcagacaccgctcctatcacaccagtcaccccagcctcatcagtcgcaccagccggctcatcccacaaggcctgaaaggcccgaccatgcgattcggcgacatactgcggctctgcagacaaaacctatggcggcgtaaatcccgtacgattctgaccgtgctgggcgttatcgtcggctgctgctcgattgtgctcatggtctctttgggccagggcattaacgagcagaacgagaagatgctcaaatcgatgggcgatctgtccatcgtcaccgtgtacaccaacggttatgccggtccgatgggcggtggcggttcgtccgagatgggcgataccaagctcgacgacaaggccgtggaatccttccgcgcgatgagcggcgtatccggcgtgacgccgatgatgaacttcccttataacgtgacggccagagccggcgcgggcggccgttacctctacgattacgtgcagatcatgggcatcgacatgacccagttcgaccagatgggctacaagctcgtcggtggcgagaagccggtcaaaaaggatcaggtgcttgccggcgaatggttcgcctatggtttcatggacaccctgaagaacggcgaacaacgcaccagcacacgcggcggtcagtattcctcatgcacgtttgaccagaccaccggccagtgcgaggaagaccaggacgaggatccgttcttcgatccgctcgccacgcaaatcagtctgaccaccggcaccaattatcagggcgaccagtacaccatgaacatgtacggcggcggtggcggcacaggcggtgcgggtggcaacaccgcgggtcagtcggaaaacgtcaccctcgatgtgctggcttccggcattgtggcgggcgactacaacaagggctatgccacctccgacggtctggtcatggatttgcaggcgttgaaggaactggccgccaaagtcgatccagccgccgccaaaaaagccaccgcctatgatcaagtgctggtcaaggccgccgacctcaagtccgtgcccgaagtcgaatcacagatcaaagcgttgggctacgagacctcctcctatgaagacatgcgtaagtcgttggaagaacagtcgcgcgcgattcagctgattctgggcggtatcggtgcggtttcgctgttggttgcggccatcggcatcgccaacacaatggttatgtccgtaaccgagcgcacgcgcgagatcggcattatgaaggcgcttggctgctacgttcgtgacattcgcgtcatgtttcttgcggaggccggcgcgatcggattcttcggcggatcgatcggctgcgtgctgagcggactgatatcgctgggcatcaacgttgtcggcgcgttgtatgcgggcggcatgagcggcggcatgtctggcggtatggtcagcggtgccggcgggggctccggcgacggtaccggtggcggaacatctatctggaccatactctggcaggcgatagttggtggcgagaatgtgacccgttattcggtgattccgtggtggctgttcctgttcgccgtgctgttttccacgctgatcggcttgctattcggcttcggcccggccaataaagccgttaaaatcccggccctagacgccatcaaaaacaacgagtgatcgcctctgtcacctgctccaccgttagtccataacgttcgttcagttcgcccagcgacacgcggtcggtaaattccttggctgcgccgaagttcagcacacgaggattacggctgccgtccgagacatgatgattcgcatagtatgcggtcactttctcgccccagccgccttcaagctgcccgtcttcaagggtgatgacctgctggtggccatcacgcaacgactccagtacgtctgaatccagcgacgtgcactggcgcgggtcgataaccgttgccgtgatgccataatcgtcagacaatgcggcggccgtctgctccgccaacggatacgcattgcccagtccgatgatcgcgacttgcgagcccgtctgattgacccgccaatccagcatgtgacgcgcaccggcatgctgagccgttacgctaacggtcccgcggactgttgcggcagatatgcccccgctggcggagctggcggaggctggcagcgaagctgactgggggcggtcagcaatctgcccacccgtcaccggcagcagcgtcgcatcccgctccgccgccaaaatcgcctcgcccggcacccgaatcaccgccggaccagcaggggcgtccgccgaaccggccggcgcggtagcccatgccaaatcagccagatagtcgcgagccgaagtcggcaccagcatcgtaacccctggaatattggagaacatcgtcacgtcatatgcgccggaatgcgtattgtccgaaccggacaagccgcccagaaaatcaagtaccgtgactcgcgaacggttcaggctcatctcctggaagaactggtcgtaggcgcgctggaagaaggacgccgtggtggccaccaccggcgtgccacccgcccgtgcgatgccggcagcgtacgccacggcatgcgattcggtgatgcccgtgtctacataatgtgcgcccgcgcgctctcggaactcatgggtgatgccgttcgagcccggcgtggcgggggagatgaccacgagtcctggctcggcggcgaaacgcggttcgagcgcggccatcgccattttgccgtaatgcttgcgcggatcgtccggcttgccgattgcggcatccggattctgccaatgcgaggcctcgcactggccttcatgtggttcatggtcggacaggttgcagtgatccgaatgccacggttcgctgtgcagcacgttgctcgtggggcgcacgccggtgtcggagactgccggatccagctcatggacgttaccggccgaggccgaggatgcgccggccacgtgaccggcgccgtcatatcccgcgcccttcagcgtatgaatatggaccaccaccggatgatcgatatcgcgcacttcctcgaaagctgcgaccagcgcggaaacatcgttgccggcctccacataccgataatccaagccaaacgcgttgaacagattcggctgggcggtgccaccggacgcgcgcaggcgggcgagcggaccgtacatgccaccgaaatcgccggcaatcgacatctcattgtcgttgaacacaatgatgagattgccgccctgctcagccgcgttgttcagtccttcaaacgccacgcccgaactcagcgaaccatcgccgatcacggcgatcacattgccgatgccgctgttcgggccttccatatcgcgggttttcgccaaaccgcaagccaatgaaatcgaggtaccggtgtgaccgagcacgaactggtcgtgtttgctttcgtccggattggtgaagccggtcacctcgctgaaacggtccgggtccagataggcggcggcgcggcccgtgagcattttatgcacgtagctttggtgggatacatcgaacacgatgcggtcacgcggcgaatcgaatacgcggtgcagggccaccgtggcctccaccatgcccagattggagccgatatgaccgccgtgttggtggccatatgccagcagcgtggcgcgaatctcgcggcacagttcggcgagctcgtcgggggcaagggccttgacatcggccgggctggcaatgcggctcagcagatgggagtcgtcgccatgggaaggggtaatgctcggggggatgtcgtgaaggcgcacggccccctcggcggcaccggagacggcgaaggaatcgcttgaatcaaatccgtttcctgacgcgttgcgcataccctcgaatctcccttcgctagtctttccgaagttgaatgctaacgcccggcattgtccgaggtccacatgacgaatcaatgcccccaacatctccgtaaatgggtgattcgttcgctgcgcgatgtgggacaatgaatgcggtaattccttttgataccaaggagcgcgcaatgaaggccgtatacgcatccaccgtcaaccatgacgatccgcttgccgcgttggcggtgggcgagcagcccgaaccccaggcccgcccgttctggtcgaccgtttcggtgcgcgcggtgaccgtaaaccatcacgacgtctggtcgctacagggtgtgggtctcgccgccgaacagacgccgatgatcctgggcaccgatgccgtgggcgttctggacgaggacatccccggcaagcatgggctcaaggctggcagcgaagtggtgctgtacacgttcgtcggcaccgatggggcgggcgtggccccgggcgagcgccgtacgatcctctccgagaaataccccggcacgatggccgagaagacttccgtgccgtccgccaacgtgttcgccaagcccgcaaacctcaccacggccgaggcggccgcactcggcaccagctggctgaccgcctactcgctgctgttcgaggccgccggcatcaagccgggcgactccgtgctcatccagggcgcgggcggcggcgtgtccactgcggccatccaactcgcccatgccgccggtctggaggtgttcgtcacctcgcgtgacgcggacaagcgctccaaggcgctgaaacttggcgcgaacgccgcgctggagaccggtgcgcggttgccgcgcaaggtcgatgcggtgatcgagtccgtgggggcggccacatggggccattcggtgcggtcggtgcgtcccggcggcaccatcgccatctgcggcgccaccaccggcgaccagcccggtgccgaactgacccggttgttcttccaggacattcgcgtgcagggctgcaccatgggttcgcgcgaggatttcgcacgattgctgcgcttcgtggagcacgccgacctgcatccggtgatcgattccgtggtcgacggattggactgcgcccccgaggcgttcgccaggatgatcgccggcgacatgttcggcaagatcgttattgagctgtaagcctcacagaattatgtattgagaacgattcgctgcgtggcttaactccgctatcaggagtacagtgggccttattctcaataactagggagtaaatgataatggcaaatgaatccaagcccgaagtcgcagtggtcatgggatcctccagcgactgggagaccatgaagcgcgcctgcgatattctcgaccagttcggcgtcgcctaccacaagcaggtcatctccgcgcaccgcacgcccgagctcatggccgagttcgcgcacaacgcccgcgccaatggcctgaaggtcattatcgccggtgccggcggtgccgcccacctgccgggcatgatcgccgcgcagaccacactgcccgtaatcggcgtgcccgtgcgctcccacgccctgtccggctgggattcgctgctgtccatcgtgcagatgcccggcggcattccggtggccaccaccgccgtcggcaactccggtgccaccaacgccggcctgctcgccgtgcagatgctctccgccttcgagcccgaactggccgacaagcttgaggattaccgtaacgaactgaaagaaaaggtagctgaatccaatgcccagcttgtctgaggaaacaggcggtcgtgtttcgatgctgatgccgggatcgaccatcggcatcatcggcggcggccagctcggccgcatgatggctttgtccgcccgctacatgggcttccgcgtcggcgtgcttgacccgacgccgaactgcccgaccggtcaggtggccgacttccagatcaccgccgaatacgatgacagaaccgccatccacgatctggccgtgcagtccgacgtgctcacctacgagttcgagaacgtggacgccgacgccatcgacgaggtgcgaggcatcaccgccaccccgcagggcaccgacctgctgcgcgtgacccagcaccgcgtgcatgagaagcggttcatcaacgaccacggcaccgccaccgcaccgtggcgcgccgtcaacaacttcgatgagcttgacgccgcattggatgatattcattatccggccgtgctgaagaccgtgtccggcggctacgacggccacggtcagctcgtgctgcgttccgacgccgacttggagaagatccgctcccgctccgaccgtggtggtggcttcccgccgagcatcctggaaggcttcgtcgacttcgcattcgaggcttcgattctggtctccggcaacggcaaggacttcgtcaccttcccgattgtgcgtaacgagcaccgcaacaacatcctgcatatgaccatcgcccccgccgaggtgtccgaacatgtggctcgcgaagcgcatgaactggcgattcgcctggccaagggcttcgaactggctggcacgctggccatcgaactgttcatcaccaaggacgatcaggtcatcgtcaacgagctcgccccgcgcccgcacaactccggccactacaccatcgaggcctgctcgatggaccagttcgacgcccacatccgcggcatcgccggctggcctctgcccaagcccaagctgctctcgccggccgtgatggtcaacgtacttggccagcatgtggaaccgacgcgcgcgctgatcgccacccacccggagtggaatgtgcacgactacggcaaggccgaagtgcgccacgaccgcaagatgggccacatcaccgtgctcaccgacgacccggccaagacggtcgctgaccttgaggccaccggctgctgggacgacctgaaaaagaaggcgtgaccttaccgatggttgaacatatcgaacgccagaccaagcagaaggacgcgattcgcgccgccttggccgactgcgaggagttcatctccgctcaggacctgcaccgcaggctggaggacgaaggctcgaaaatcggcttggccaccgtataccgccagctcaacgccttggccgatgccggtgccgccgacacgatccgcctggacggccagcagctgttccgcctatgcggcgacgacggacatcaccaccacttggtgtgcaggcggtgcggcaaaaccgtggaaatcgacccgcccagcgaggcttggctgcgcaaagtggccgacggccacggcttcaccgttgaatcccacaccttggaggtcttcggactgtgctctgattgccaaaaggagcagaaagcgcagaaggctcagaaagcagtgagcgaataacaaatgggatcggcttcaaagccgatcccatttgttattccgctgctattccactgacttcagcgcgccgagcatgctgtttctttgaggtcgtgttctgcacgatgcctttcacgccgtccagcttcatgagcttggcgctgcgcgactccacattggaggtctcgtggttcttgagccgcaccatataggcgttcgactggtgctgctcgccgaacacgtgcttatagccacccgaagtcatgaacatgaaatgcccgaagtagggaagccggcttgtcacgcagcttgcgtttggccgctacccaggccggtaccacggtgctcgcccaggccagcaggaacgccgccagggtgatggcagggtggaacgccagcatgacacgccgatgtaaatgcaaatgataataattctcaatatatgttattctgtcgtgttggtggctgggcgatgatgcagcaacagcagcatcgcccagccgttcggctaattagagaggaaaacccaatcatgtccatcatgtccaacgccaagcgcgcgctcgccatcgcggccgccgcggcgaccctgctctcgatggccgcctgcggttccagcaacgccgccagcggcaagtccgattccagcggcgccgcgtcttccggcaagatcgaggtcgtcgcctccatcaaccagtggggttccgtggccgaagacctcggcggcagcaacgtcgaagtcaccaacatcatgaccaagaccaacgtcgaggcgcacgattacgagcccaccagccaggatgtcgccaagttcggcaccgccaaggtagccgtagtcaacggcgccgattacgacccgtgggccaccaaggccgcccagccgaccaaggccacgctggtcaccgccgccgaaaccgccggcatcaaggaaggcgacaacccgcacgtctggttctccgccaaggtgcgttccaacaccgccgacgccatcaccgccgcctaccagaaggccgacccgagccacaaggacgactacgccaagctcaacaaagaatggcacgccaaggaagaccagcttgagtccaagatcaaggagacttccgccaagaccgagggcctgccgtacgccgccaccgaatccgtggcctggtacctggccgacgacctcaagatgaccgacgccactccgaagggctacgcccaggcctccgccaacgagagcgagccgaccccggccgacatcaaggacttccaggacaccctgaaggccggcttcatcaagatgttcgtcttcaacagccaggaagcaaactccactattgaccagatcaccggtgccgccaaggacgccaacgtgccgatcgtggagctcgccgagcagatgccgaagcagtacaccaacctgctcgactggatgagcgcactggtcgaccagttcgccgccgccgtgaagtaatgcggcagtagccgtcaatccgcaacagcgataaggggaataatcaagtcagatagcgaggcgttgtctaggggagaacagaacacttcgctatcagggataggctccttatatatcagggtgcttcggggatgtcccgaggcaccctttgcgttagggtgaatagttaggaaacggtaagaaaaatagtggaactatggattttccaaggttcagcggcaacaatatgcccttgaaaagtcacatacggaaacaggcgaatgagcgagaacactagtaataccaccacagtgaaaccccatttcaagctttgggccaaaaaggtcgaagccaatgaagtcacgccccaacacccccacaagcccttccccggctgggtgtacggcgtgctcttcgttatcttcgacatcattgtcgtgacggcgctcgaagtgggcgtttcgtccagctccacccgtgtgcagctgtccagtccgatcgtcggattcggcttcgtgagcaagatgtggaccgacggcaatttcgtattcgtgctcaacgtgatacttgtcgcgttgctgtacctcatgttgctgatgctgttcaaccggttctggacggcaagcatcgtgattctcgcggtcggaatcatcgtggccgccatcgaacatttcaaggtcgagatccgttacgaggccattctgcccgccgatctaggcttccttggctcgaacaccggcaacatgctcaccttcattccggccggtgcgcatgtgaccatcctcgtggcactcggcgcgttcgccgtactgctcgcgctgattctggtgctgcgtcatttcgatgggcgcaaaggtcgcatgattcgtacggataacctgagcctgaacctcacctcccgtctgattcttctgctgctgccgattctggtgttcgcgttgtactgcattcatgtgagcaccaccgattcgctggccaacaagttctcccgcgccttgggagacacgccatccatgtgggattccgtgtatgacgcgcagcgcaatggtccgctcgtggccttcacccgccagctcaacccgaagatcatggacaagccgagcaactactccgaggagaccatgaagaaggtcgccgctcgctatcagaaggaagcggagacaatcaacgcctcccgcaccaacaacctcactgattcgacagtggtgtacgtgttgtccgaatccttctctgacccgagccgcgtgccgggactgaagaccaataaggattcgatgcccaacatccgcaagatcaaggcgggcaccacctccggcctgatgctctcctccggctacggcggaggtacggccaatctcgaatacatgggactttccggcctgagcatggccaatttcgagtcctccctgtccagcccgtaccagcagctggtcccgagccagcattggactcccaccatcaaccagctgtggggcgcgcccgtcaactcgctcggctaccacccgtacgaatccagcatgtactcgcgtgccacgaactacaagaagttcggcttctcgcacttctacacgttgaccggtccggacgtgatcaagtatcaggacaagatcgacgagtcgccgtacgtctctgataagtcttcctatgattctgcgttggaaggcatcaagtccggcaagacgaacaagttcattcagatcattaccatgcagaatcacatgccctaccacgagtggtatgagaataacgactacaccgccgaatccaccacgggtacgccgctgggtgatgatgaacagcagtcgattgagacctatcaaaagggtgtggagattaccgatcaggccactcaggagttcctgaatgaactggatgcgctggataagcccgtcaccgtggtgttctatggcgaccacttgccgggcatctactcgtccgccagcgaggatgacaacaactccttggccctgcacctgaccgattacttcatctggtcgaataaggcttccagctcccaaggcaataaggcaagcgatgcagcctactcctcgccgaacttcttcgtggcgcaggccgccgatcacatgaacgccaaggtcagcccgtatctggcgttcctgaccgaaatgcattccaagatcgccgccatggaaccgcctgtggtcaacaagatccaaggctgggatcgtatccccgaaggccagaacatctatcttgatcagaacggcaacccgatgtccaccgatgacttcgacaaggaaaccaagcagttgcttgccgactacaagctcatccaatacgacatcaccgccggcaaaaactacctcaaagacacggactttatgacgctgccgtaaagcagacagcctagtaggctgtctgtaggcagcgtgcgagccgacagacgagccagcaaggcgcggggcgtagcccgtccaaaattgcagtagcgctgccgtaaagcagggggtgctttcatgacgaaccagactttcgaacaactgaagaagacttacgaatccggtcgtacccggccgctggcatggcgccgcgcgcagctgaacgcactacgccgtctggttacggagaaccgtgatgcctttgtctcctcggctatggctgacttgggcaagcccgcggctgaaaccgtgctcatggaactgaacctggtggctggcgaagcacagttcgtgcgcaatcgtctgagcctttggaccgcccggcatcccaaagcgatgcattggatgttgcagccggctgccggatggacaattgccgagcccaaaggcgtggtgctcatcatttcaccgtggaattatccggtgctgctggccttggaaccaatggctgatgcgctcgctgccggtaacgccgtctgcttgaaaccgtccgagctttcaccgaatacgtccaagctccttgctgagttggtgccgcaataccttgactccgaggccgtgcgcgtggtcgaaggcgggcccaaggaaaccggcgaactgctgaaatgcccgttcaaccacatcttctataccggtggcggccacgtcggcaaaatcgtcatgcgcgcggcggccgagcatctgacgccggtcacgctggaactcggcggcaagtcgccatgctttgtggatcgcactgcggacatcaatgtggctgcacgccgcattgcgtggggcaaattcaccaatgccgggcagacttgcgtggcacccgactatgtgctcgccacgccggatgtggccgaggctctggccgagcgcatcgccgtagccatcaccgaattctatggcgaagatccgaaggcctcgcctgattttggtcgtattatcaacgatcgtcattttgaacgactgtgcaagctattgccggtcggcaccgtgccgcctgaggagccgagctcgccgctggtgcaggtggcatcggcggtaggcgcggccatggatatggttgggcggcgcttcaatgccgtgactactgggcgcggtggcgcgggggagatggccggcagcgcgaacaatgcggcgaagccgacggccggttcgaatatggcagccgctgatgatggtgcgactgcctcggccgctgttgagccgagcgagattcacaaggtgcccggcgtgttcgacctggccggtcgaatcgtttgcggcggcaaggtcgatcgtgccgcccggtatatcgcgcctaccgtgctgtacggtacgtcgccagatgcgccagtaatgaaggaggagattttcgggccgattctgccgattctggtggtcgaggatgccgagtccgcaatccgattcatcaacaagcggtcccggccgttggctgcatatgtgttctcgcgcgatcacgaggttcggctgactttcgaacgtcagaccagctccggagccttgggatattcgctgccgttgggccatctgctgtccagccggttgccgttcggtggcgtgggcgcgtccggcatcggcacctaccacggcaaagcaggcttcctcaccttcagccacgtcaaaaccgtggttaccaagccgcagttccccgacactctgcgcctcgtgtacccgcccttcaatgaagccaaggccaaactgttcgacatcatcgccaaattcagctagcgtgatatcgctcgctgatattgggtgatggcgttgtcatagtgacgttcgctgtcccggtaattacgtcaatcgattgattcgtgtaccgggccagatttttctgtcctagtatttgatttcgggtcatttttgcttaccgggacaaaactgacgccggaagtatcgtccgcgtattacgaaaatggcggaatagtgcggtttcgtatggaagggaatttcaaatattcctatattcgaggggttcagctgtcctggtttgcgaaaaagagccgaaatcggctaccgggacagaaaaatctggcccggtagccacgtcaatcgattgacatgtctgccaggccaaaaatatgcagcagatgcgccgcttctgttacttcagggctttgaagccgatgtcgtggcggtaaaacagtccgcgcagctcgagcttgtcgatgattgcgtagaccttgtcctgggcggacttgatgtccggagcggaggtttcgacgagcagcacgcggccagagttggccacaaggttaccgtgctcgtcagaggcgacgccggcgtagtagacgtgcgaatcctcgtcgacttcgatttcgggcacacgggcacccttgatgacgttctccgggtagccgttggaggcgatgaccacgccgagggtggcgttggactcatcccaggtgaattcgggggtttcgccgtcgagaatggcggagatgccggcaccgaggtcggaggtgagcttcgggagcacgacttcggtttccgggtcgccgaagcgggcgttgaattcgatgaccttcgggccgtcggcggtggcgatcagaccggcgtacaggataccggtgaatggcgtaccttcctcggccatgccttcgacggtggggcgcacgattttctcgatggcctcgtcgaccacggactgcggaatctgcggcaccgggctgtaggcacccatgccaccggtgttcggaccctcgtcgccatcgtgggcgcgcttgtgatcctgggagatgggcatcggccagaaatcggtgccgttgacaaagctcatcagggagaattcctggccgtccaggaagtcctcgataacgaccttggcaccggcggagccgaagcgatggtcgatgaagatgtcttcgagtgcgcgctgggcggtgtgctcgtccatggccacggtcacgcccttgcctgccgccagaccgtcggccttgatgacaatcggggcaccgtgctcgtgtacgtagtcctgcgccatctcgagatcgctgaaggtcttgtattgggcggtcgggatgttgtgtcggtccatgagctgcttggcgaagtccttggagccttcaatctgggcggcggccttggacgggccgaacgccttgatgccggcggcggcgaaatcgtccacgatgccttcgatcagcgggacttccgggcctacgaacacccagtcataaccattgttcttcacgaattcgataagtgcggcgtgattcgactggctcagctgcgtggtgtggatgccgtccttgagcatgcccgggttgccgggagccacggtgacttcgtcgatgctcggtgccttgagcagcgtgtaggcaatggtgtgctcgcgcgcgccggagccgataaccaatactttctgacccatgttgttcctttcctgcggaaagcgagttacttcagtacgatttgcgtgccggtggtgtcggctgcgatctggccgagcacgtaggcgggctcgttgttgtcggcgagcagcttcagcgcctcgtccttgcgagcgaggtcgatggccagcaccatgccgatgcccatgttgaagatgttgtacatctccttatgatcgatgttgccagccttctccagcacgtcgaagatcgggagcacgggccaggtgccgagctcgatttcggcggccaagccgtccggaatcatgcgcgggatgttctcgatgaagccgccgccggtgatgtgggccacgcctttgaccacgcccgccttgaacaggggagagagggccttgacgtagatcttggtgggggtgagcagcacgtcgccgagcttttcgccgcccagctcgtcgagttcggtgtccacggtgtagccggcctgctcgaacagggccttgcgcaccagggagaagccattggagtgtacgccggtggagggcaggccgatgagcacgtcgccttcagcgatggtggaaccgtccacgatggcggacttttcggcaacgccgaccgagaatccggcgagatcgtattcgtcttcgtcgtacatgcccggcatttcggcggtttcgccgccgaccagcgcggaaccggcctgtacacagccgtcggccacaccggccacgacctgctcaagcagtgccgggtcgttcttgccgcaggcgatgtagtcaaggaagaacaacggctcggcgccctgggcggcgatgtcgttgacgcacatggccacgcagtcgatgccgatggtgtcgtgcttattggccagcttggcgaccatgagcttggtgcccacgccgtcggtgccggagatgagaaccggctccttgtagcccaaggaggccagatcgaacaggccgccgaagccgccgatgccgccgaccacgccggggcggttcgtgcgggccacgtgcgacttgatgcgcttgacgacttcgtacccggcttcgacgctcacgccggcgttctcatatgcttttggcatttggttggcctttctacttattttggctcccctctggaggggagctgtcggcaaagccgactgaggggaggcaagcgcctctggttcaaagaattgttattgagtggattggtggtgagctattcggcatccggctgcacggtgttgtactcgttgccgatgtacttgctcttgtacagcgcgaattcaggcagacgcacacggtcctcgggcgtgagggacttcaggaagtcggcctcgtagtcgtcgagcgcagtggggtagtcgccgttgaagtaggcgacgcacaggccaccgtatggggcgtcggcgttcagtccgatggattcgaccagaccgtcgagcgaaaggtaggccaaggaatccgcgccgatgtattcacggatttcctccacgctcatcttggctgcgatgagttccttggtggtggagatatcaatgccatagaagcaggggtacttcagcggcggggagctgatgcgcatatgcacttcagcggcgccggcttccttgagcagctgcacgatgcgcttggacgtggtgccgcgcacgatggaatcatcgatgacgataacgcgcttgcctttaaccacgctgcgcacagcagagagcttcatacgcacaccctgctcgcgcagttcttgcgtgggctgaatgaaggtgcgggccacatactggtttttgattagacccatttcgttgggcaggcctgctgcttccgcatagccggatgcggcggacaatgaggagttcggcacgccgataaccatatcggcctccaccggggattcggcggcgagacgtgcgcccatgcgcttgcgggcggagtgcacgttgacgccatagatatcggaatccgggcgggcgaagtagatgtactccatcgagcagatggccagctgcgtgttgttggtgtactgcacgatcttgtagccgtgatcgttgaccaccacgatttcacccgggcgaatgttgcgcaccagctcggcgccgacgacatccagtgcgcaggtttcggaggcgagcacgtaggcgccgttcttcatcttgccgagggagagcgggcggaagccgttcgggtcgagtgcgccgatcatggcgtcttcggtcatcagcaggtaggcgaaaccgccatgcaccgtgttgagcgcttccttgagcttgtccataaaggtgcgctgcatcgaacggcgaatcaagtgcatcagcacttcggtgtcggagttcgaatggaagatggcgccttcgtcttcaagcttgcggcgcagtgacgggcagttcgtcaggttgccgttatggcacagagccacgtcgccgtcatggaagcggaagatgaacggctggatgttgtctgtggtgcccgagccggccgttgcgtaacgcacgtggccgatggcgcaattgcccttcagtcgttcgatttcgcgctcatcgccgaacacctgggtgagcaggccgagtccgcgatgaccgatgagatgaccgttatcgttggagacgatgccggcaccttcctgaccgcgatgctgcagcgcgtgcaggccaaaataggtgagtcgtgaggcgtcggggtggccccatacgccgaagatgccacattcctcgtgaatgtcttcgagttcagccgacaagccaaagctcctttttcaaacaggggattaactatctatcaaccctaccaatcggcggctacatcgcgtgttgtggggtggtggaacttgttggggtttgcggacgcggtttaagcaccagatcagtcaagtatgaatagtggcttaggattttggcctttcgctgtttgtggtgggtggttgtggtgtggggtgatgccgacgggtaggttggaagcatggatacctcttacctgttcaccgccgcattacctggtgctccactttgtgctcaagcgtgataccgaattgtcggtgtgacgtgatcggttgactttcgtcaacgcaatttgaaaggctccgacggtattatccgtcggagcctttcgtcgtatgaatccggtgcttgtttttcggcttcgtctcagtgcctgaaatggctgaagaactcgatggtctcgggatcctgcgactcgtccatcacctcagcgggtgtgccgttctcggcgatgacgccgtgacggagcagtacgatgcggtcggccgcttcgtgggcgaagctcatttcgtgcgtggccatgaggattgtggtgccttgggcctttaactcggcaaccatgttgagcacttcgccgaccagcatcggatcaagagcggatgtgatctcgtcaagcagcagcagttccgggtcggtcatcagtgcgcgcgcaatcgccacgcgctgctgctggccgccagagagctgatcggggtaggcactggctttatcgcgcatgccgatgcgttcaagcagttccatagcgcgggtttcggcgcgatccttgctccagtggtgaaccttgattgcggcaagggtcacgttcctgagcaccgacatgtgggggaagaggttgaactgctggaacaccacgccgatacgtgcgcgaatcttgtcctggtcggcacgcgggtcggtgatatcggtattgcccagccaaatctggccgtcatcgacctgttcaagcaggttgacgcatttcatcaatgtggatttgcctgaaccggaaggccccagcaaagccaccacctcatgttggtgaatgtcaaaggaaatgccacgcagcacctgcgtgtttccaaaggatttgcgcacgtcatcaagacgcagcaccgtcttgttgctcacgggggagtcactcgcctcggtggtgatattggtcatttcgctcataccgttcctccgctgagttcgcgcttacgcagacgttccgtgtaccagtcgttcagcaggatgaacggcacgctcatcaggatgaacagcaggctggcgaccacatacggcgtgaagttgtaggtgctggccacgtcgatctgtgcggcgcgcacggcatccaccgcacccagcacggaaatcaggccgacgtccttttgcatggagatgaagtcattcatcagtgcgggcgccactttgcgcaatgcctgaggaatgacgatcagtcgggtcgtctggccggaggtcaggcccaacgagcgggccgaggctcgctgagaaggatgtacgtcgttaaaaccggcacgcagcacctcggagacgtaggcgctgtatcccattaccactgcaatggtgccgagtaccgagggatcgatacggccgaacaagcctaggccgggaatgccgaaaccgattagatacagcacgacgataataggcacgccgcgcatcacagtcgtgtagatcaatgccaggatacgcagcgggaacagaataggggagcggctggtgcgcaccagcgcgatcagcgtgctcagaatcgccacgccgaccactgcgacgagcagaacgcggatgttgagccataggccgtcaagcacatggggaaacgatttgacgaagtattcgccggagaagaaggtctccttgactcgtggccagccgggggagagcttcaagccgatgacgatgaccaccacgaacacaatggtgctgatcagactggtaatcgtcgattgaatttgctgatgaacacgatattggcgtcgttcgagctcgacctgacttacctcgtgtccgtcaggggcattgtgctgcctggtttcggttggtgctgcggtcatgtgatgaatgtcgctcgcttcctgaatgccgggatggccgggtgccacaggaaaattcccgcagcgcccggccaaggtgttgtgaccttatgatgtaagcctacttcacttacttcttcagttcggtcaggtcggtggtgtactcggccagccacttgtcctgaagcttcttgatggtgccgtcggcgttcaggtcatccactgccttggtcacggctgcagtcagcttggaatccttcggcagcacgatgcccatgccgctcttgtcttcggagtcaggcagacggccgagcaccttggcgtccttgacctgctcggactgcaccatgtacacgcattccacggtgctggtgaccagtgcgtcgatctgaccggcgtcaagtgcctgagccagtgcggcatcatcattgaacgtctggatgtcgtccttgatgttcgccttggcgtagtcgtaggcaagggtgccgaccatgacgcccacggtcgcatccttcagatcggataccttggtggcgttggcgaacttgctgtctttcttgaccacgacggactggctgtcgttgtagtagctggacgagaagtcaacggccttcttgcgctcgtcggtgatgccgaactgctggatgttgaaatcccagtccttggcgccgggagcgatggcggtgtcgaatgcggtgcgggtccacaccacgtcgctcttcttgaaaccgagcttgtcggccactgcgtaggcgacggccgcctcgtagccctcaccgctttccggcttgtcgttcataacccacggctcgtaggccggctgtccggtggcgatggtcagcttgcccggcttgtacgtctgctgggtgatgtcgtccgaatcggtggaattggatgcggtggactggccggaaccgcaggctgcggtgaacgacagagccaggatgctgacggtggccgcaatggtacggacgatgtgtcgcttattgaacatgggtttcctctcctcaagtgttcgtcatgcacacggttcaaaccgtgcttgatgcattcgcgccaattgtatggctattgggttacaaaacatcgatattttcggatgctggctatcgccattgcttatggccgactagagccgcgcaatctggcgcgtaagcggacggatatctcatattggcgcagagcgaaatggcgttcactgttcgagtgtgaagccgtcgaatacgaatcccggactgaccacacaggagaccagcgcatcgccctggcctggcactgtgcgctgccagacgccagccggtacgaccgcatgtcccgatacggttacgtcggcctgatcggtggtgatgccggaacccaaggtgattacggttcgcttggattcgtcggattccggagtctcgtcgctgccgccgagctccagtttgaccgatgccgggccatgccacagccagacctcatccgcatcgaccttatgccaggcgctggcatctccctcgggcagcaggaagtaaatcagtgacgatagcggtcggcttgaggcctcatccgtgtgcggggattgccagtcacgcgtgtaccagccgccttcggggtgggtttccagtccaaggcgttccactatggaccgggcgtatggactcatgtcttgcaaagcgacgctcataatgagatctcctgttcttggcgggtttgctggtttttggcttcttgatatcaggtcaggtcagcggtgtcaccaggcgttgttgtaggcttcgcgcccggatatcaccgtggctcggttcgtgcctgcgccgtgcctcaccagtgtttccagcgtttcttcgatgccggccggagatgatgtgtcgacggggatgtcgaagaacgcgaaatcagccaatgcgcccgcgttgatttgtccaatgcggttgcggcccacgtgcatgcccatggaggcggcgccgcccagcgtcatcatacgaatcaggcgatgtgtcagatcgtcgctggcatagccttgttcgcgggccaggtcgtaaagcatcgacacatcatcaagcagatcgagggtcggcgtgctggagagcgaatcggtgcccacgcttaccagattgccttcctcgaggtattcgcgcaccggtgcatctttgccggtgttggtaatgcgattcgatcgggggcacaaggccacgcccacgccgcgctgacgtagaatacgccgatcctcgccattggcccacacgccgtgtgcaatgtgcacatccggtccaagcgagccaagctgatcgacgaactggatggcggaggcgcctttgcccacttccttgagctgccggtagctttcccaatcgtggtcactccagtcggccgccgaataagtggtgagcaccggcggataagtgccggcctcgagcggggtctccgccagatggatatgcagtcgcatgttcagctgacgagcaatgtctggaagatcaacgaacggttcggactccagcgtatacggagcatgcgggctgatgccgaggtttggcagctgctcctcgttcatccggcgcaactgccggatgagctcagtgcggcccttttccatccattcggcgttgtgccagcccattacctcccaataagcgatgccgtgcatgccctgcgaagccagcgcgccggcggcgtccaaatcggtgacgatgtctgcggcggccgtcgttcccgattcgaccatctggcgagcgccgtcctcggcccactgcttccatggctgggtcttctgcgcctcggcgtacacctcgttgaatgccagttcccaggcgcggaaccgatcgtaggtgccttgcccgacctgcaccatgccgctgtactgcagatgagtgtgcgcgttgatcaatccgggggtgagcaccccatcccaatgccgttcatggatggtgccgtgagccgtcatttcctgcttcagtgccttcagcacccagcggcgtttacctacatgaaccacgcggtcgccatgtatggcaactgcgccatcgatgatgacggggcccgtcacggggatgatgagtttggcggaatacagtgtcacatcatcgataagctcggtatcgacggtcggccaggtgttgtcggtcatattctcctcgctgcgttgtgttcggtgccgtgtctatggctatcggtcggcgttctctcggtcgttttccgcgaatctggtcagtcgccaattgtagccgttgtcctccacggcatggctggctcggtatccgcgcgccttgagcgcgctggcggcgatgcgctggtcggtcgctgcgtcaagtctgataagcgtgtgatccagtgtgcctcgatgttccagaagatatgcgacggcgctggcctgtacggcgaagctcagatccatgatctcgattggattgccgcctcccaccgtgtagttcacgccatcgccgtcggcgattagcgtgagcgttggtccgtcgggaacattgagttgcacggtgtccctgttgacctgtggggtgaagtcgcttacctcgtccaaggcgatttcgttggcgatgccgccgatcactgcgagcgccgcgccctcgtgcattgcgcgcatgtgctcaagtgtgaccgtatgtctcacgccagtggcggacaccaccatatccgcgcaagggagtgcctcgtcaatgtcttgtgcggcgaagccgtcgaacaccgctttgagtgaagccactggatcgatatcgcagatggtgacttcggcgccaagcgcgcgaatgcgccgtgcgaagccttggccgaccgggccgtagccgatgacggtgacgttcttaccgtcgaatgcatgctcgccgagaatgcgctgcatggtggtcacgcatgtctccccagtgccgtgggcgttgtcgaatccggttttcagcacactgtcgttaacggctacgaccgggtaggtgagggctcccgcttcctgcatctgctggaacgcgcgtacgccgctggtcgtttcctcggccactccaatgaggttcgccgtgagttcggggcgttcgagcgaagcgagacgggcgaagctggcaccatcgtcgatgatgatgtccggctgtatttcgtccagcaggtgcagggccgcctcgtgcgcctgttccgcggtccagtctcggctagattcgaccgtgattccttcccggcgcagctgttccgccactcggggatccgtggaatccgggccgcaatatacgccgacgattgcgccggcggccttaagcttgcgcagcagaatcgcggtctttggctccagtatcagacagacggcaatacgaatgcctgagaaatcgacgcgagtggtgaggctatccatggtgtcgcgtaataccggcatgtgctgttccgcgtactccattgcctccagtccgcttgccttgcgcatatcggtgatggaatcgatgctttgtgtgccgtcgcataggaattcctcgttgtgctcgtcggtcatcgtggcatcttcgacggtcatgccccattgctgggcctgagacttgatttcggcatgcttctgtggctccggaatcgcgagtcgggctcctgccagtgatcgattcgtcttctgggatcgggctgccgcccacgctgcaaaatcgctgtctgctgtaatgcttttcttcatattccccatggtacgcatgcatgccgctgctccgccgctgcgcgtgtggcgtgggtgaagagcgtgcttgggcgcgttgcgtgcgtcgacttcggcagcttcgaacaggcatgttgcatcgaacaaatgttcgactgtgttgatatgctggtcgggccagcggtggtaaggaggtgatggcgatgggcagcggaacggtatcgacgcaacgcgagcatacctatattgccattgatctcaagtccttctatgcctcggtggagtgcgtggctcgtgggctcgacccgttgaccacgcatctggtggtggccgatgaaacccgcaccgataagacaatatgtttggcggtctcaccctcgctgaagaactatggcattcctggccgtgcgcggctgtttgaggtaaaacagcgcctgaatggagtcaacatcgagcgcgcggtccatgctcccggcggccgattaatcggggagtcctgcgatgcgtgcgacctggaacgctcgccggggctcaaagcctcgatggtcatcgccaagccgcgcatggcgcactatctggaaatcagcgggcaaatatatggcatctacctcaaatacgccgcacccgagcacatccatgtctactcgattgacgaggtgttcatcgacgccacgccatatctgcgctcgctgggtatggggccgcatgcgatggcgcgaaccatcgtgcgcgaaatcctcaccaaaaccggcatcaccgccactgccggcatcggctccaacatgtatctggccaaagtcgccatggatatcgtcgccaagcacatgcccgccgacaaggacggcgtgcgcgtggccgaactgaatgaaatgtcatatcgtcggctgctttgggatcatcgtccgctcaccgatttttggcgggttgggcgcggctatgccaagaagctcgagcatgccggactgatgaccatgggcgatatcgcccgatgctcggtgggtcgtgcttcggattactacaacgaagacctgctgtatcgcatgttcggtgtcaatgccgaactgctcatcgaccatgcgtggggctgggagccgtgcgaaatcgcggatatccgatcctatgagccaggtgcgcacagcattagcagtgggcaggtgctcaccggccccgccgactatgccacggcccggctgatcaccaaggagatggccgatgcgctggccctcgatctggtcgataaaagcgtgctgacgaaccgactgacgctcgccgtcggctatgacatcggcagtcttgattcgtcaaagctcgattcgtgcgctgattatgcgatgaaacgtgccgctgagcgagcagcgaaaagctatcaagggccggtgaccatcgaccgatttgggcgcaaggtgcccaagagcgcggtcgggtcgattggtttgggtgatttcacctcgtcgtcggcacgtattcgtgaggccatgacgatgttgtacgagcgcattgtggattcacgcttgcttgtgaggcggttgaccgtcatcgccgatgatgtggccactccggaggagctggccgccggcaaacgctatgaacagctcgacttgttcggtgatgacgaggcccaatcgtatggatccgattccaccagcgaaaaagatggagagcatgatatccagcgtgcgctgctggatgtgaaacgtaaattcggccgcaacgccgtcatcaaagccatggatatggaagacggcgccaccggtcaggaccgcaaccgtcagatcggaggccatcgcgcatgaccctgcaagagacccatgcatacgacgacatcatcaacctgccacaccatcagtcgcgcaagcatccgcacatgtcccgccaccagcgggccgcgcagttcatgccgttcgcggccctgaccggctacaaccaagtcatcgagcaaacagcaaaaaacgccgaaaccgccatcgctcaggccgaagcccaaggcgataccgatttcggcgcttgacaatcgctcccgttggaggaagtctcagattcgtcagcctacgtgacgttcgaagcggtggaagccggtgatcttgtcgatttcggccatcgcgtcagccggaatcacaaagcccgcggccttcatgttgttctccagttggctgggcttggaggcgccggcgatcacacagctgatctccgggtgctgcaggatccatgccatggaaagcaccggcaggttcgtgccgagctcgtcggccaccttgcgcagctgctcgaccttgtcgaggttctcatcggtcagcagatcgttgatctggtggtcggactgccaggtggcgcgcgagccggccggcagcggctggcccttgcggtacttgccggtcagcagaccctgcgcgagcggggagaacgtggtgatgccgatgccgagcttgcggcaggtgcccatgatctcatgctcgatgtaacggtcgtttaggttgtactgcggctgaaccacggtgatcgggtacaggttgtagcggtcgatgatgcgctgggcctcttcaaggcgagccgaaccccactcctcggaaacgccatagtacagcaccttgccttgggcgaccaggtcgctcatcgcgcgcaaggtctcggtaaggtcggtggtctcgtcaaaacggtggcagaagtacatgtccagataatcggtctgcatgttcttcagcgtctggtcgatgctctcgaaaatgtgcttgcgggacaggccgcggtcgttcacgccttcgccggtggggaagtagaccttgctggaaatgaccagttccttacgcgggtactgcttcagcgtcttgccgaggaagcgttcggccgcgccgccagaataggcgtccgcgcagtcgaagaagttgacgccggaatcgtaggcgagcttcacggtctccttggccacgtcctcagccgccgtgcccttgagatccgtgacccagctgcccagtgcgacctcgctgatcttcagtcccgacttgccaacgctgcgatacttcatgtgtgctccttgataatcaatcgtcaccgtcgtctcttcatggccggccgtgaacgctaacaattcttattgaaacagttcaaccccacttgaacgcaagttggcggctattgcgacacgccggtggtgacttcgcgggcgcaacgaatgaaatcatcaatgacgctccaccgatacgatgtggccggaacgccgaactgaatggcatatgcggtatccgggccgcaatccagcacgcgcaaagtacgcaaccgttcgccgtcaagcagcgctggcaggaaccgctccgggcataggcaggcacccatgccgtaatggcacagttccagcagagtcagtacgttatccgaacgggctgtgactttcggctcaaaaccggcacggcggaacagcagatcggcaatgcgtccgtcaatatcttgtgggctgcctaggagaaacgggcaatgctccagtgaggaaaggtcacctgcggcaatggcgcgctcgtccggcgcggttctgacggcatcgacttggccattcgccgcgccaccggtagcggccaaatccatccacagtgattgtgcgaggaccagcaccatgcgctcgttatagaaatccataagttcgatgccggccggtttcccggcgaagtccgccaccgccagatcaagatcgccgttcgccagccattgttgaatctgatcgttgcggccctcaatgagttcaacgatgatattcgggcagtcacgttgcatcgccttcacaatcggcggcatgatcgcccggctacgcgtgtaggcaacacccacgcgcagcacgccggcctgatcgccggcgatgtcgcgcatttcttggccaagtgcatcgcgatcgcggcggaatcgctgcgcatatcgcgcgaacaccgtgccggcataggtcaattcgagcggcacatggcgtacgaaaagcgtgcatccgagctcccgctctagggcggcgatgttcgcactcagcgtctgctgcgtgatccccaaccgtttcgccgccttgctgaagctatgttccgaggccacggcggcgaagtattcgatgctgagaaagttcatggcgatactcccgtgtgtatggcgtttgcgtggtgtgtgtatgacgtgtcgtggcgcgaatcaatgccacagtattaaacctgtaatagatatcagtttagtctgtatttctcctgttatcttaggtcatggctcgtgcgaatagcgttgatgtttgcgactgcgggtcatgagatggaatctgagatgaggctgtagccggaagaggagaggatcgcatgctggaagcgggcacgatgttgctgttctgtgcggtgctgtttgccagcgtcgccctcggctggtcgattattcccgcgctgttcgttggtgtgctgctgttcatggggtatgggctggttcgccggtgctcgttgcgcgcgatggcgagccgtgcggccggcagcgtacggtccgcggggaccgtggtggtggccttcgtgctcatcggcgtactgacctcgctgtggcgggccagcgggaccatcgccttcatcgtggcccattcgaccgcggtgattcacgccgccacggtgattccgctgtcgtttctactgtgctcggcgatgtcggtgctggtcgggtcgtcgttcgccagtgcggcgactatgggcaccatctgcatgtcgttgggattgtcgatgcaggcgaacccggtgatgctcggtggcgcgattcttgcgggcgtctatgtgggcgatcgttgttcgccggtttccaccagtgccttgctggtcaaacagcttacgcatacgaacctgttcaatactattgcccgcatgctgcgcacgggtgcggtgccgtttgtgctgagttgtgtggtatacgttgcggctgcggtggtggagtggctgtgcgcgagcggtggttccggatttggtgcggctagtgcggctgctacggctggctcggctggctcggctagagcggctgtttcaaccaacgcaagcagcataaccgatatcggcggattgttctcatcggccttcgatttgcattggcttaccctagttccagcattactggtcatcgtgttggcgttgctgcgtgtggatgttcggctgcttatgctcgccagcattgccgcctcggtcgcggtatgcgtgggcgtgcagcacatggaatgggcagaactgttgcggctgcttattttcggttaccatgcgcaaaatccgcaggtggccgcactcctggacggcggcggcatcctctccatgctcactgtgatggccactgtctgtatctcctccgcctacgccggcatttttgccgagacgcggatgcttgctcggctgcagcaggtcatcgagatgctcggtcatcgcatcggcgcatgtggtgccaccatgattaccgcgacttgcgcggcggcgctcgcctgcaaccaaaccctcaccatcatgctcactcaccagttgtgcggtgggctgtacggcgacgacgaatccgaacgctccgcacaagctatcgatttggaagacagtgccgtggtgatcgctccgctgattccttggtcgatcgccggtgccgtgccgcttgccaccatcaacgcgcccacactcagcctggccgccgcgaccttcctctacctgctgccgctctcgcggatgctcgcctcggctgtacgccgccgctcgggatttcggactcggcatcgatcccaaaatcaaaacccgggactcgccatcccacaccggcccaaacccatgctccacatgttcgctcatggtttccatcctaagtcgggcgattgagcgcacgaggcaatcaggccgagaactgtttgccgaattccgagaagagctgacggcgggcgaagacgagcaggccgagcagcaccagcagggagaccagcccgctgaccatcaccagtacatcccacggagcccagccgagcggaatgaacgtcagaggcatcagaccagcgacgatgtcgaacgccagatacttggcgtactcgtcaatggccttggcccgcagcacgataagcagcaccacgtcaaagaccagcgaaaccagacacgtgatcggtatgacgaacatggtgacgacatgattcatcgtcgccacaaaccagaccagcgcaatcgccagcatgatatagaaatatcgaaacatgaggcgaagcggccgcggcacgtgcagaatcgcactattgatgaacagcacgctgatgatcagcgcggccgccgatgcactggcaatcggtatcggccacgaaaacagatagctgaagaagccatgcagcagcaaaatcgcgccggttacaaacgtgatgatttccaccgccaaacgcctcggacgcagatagatctgctgcgcggggaatgcggcgggggaggcctcgccgcgcaattcgttctggcagagcgggcaacgggccatatcgccggtgaaatcgacggtgcaggcatcgcaatgcttcatgccgacgctcctttctccacatgcacgccagcgatgttcatacggccgctgatgccctgcgcggcgagaatccgacacaggttcttgatgacgttcagatcatggtagatggtggagatgccgatgctcaggtcgtcgccgaacgagcagaccgtgaaattcaggctggccggtgtggtgaggaagctcaccgaacgtacatggcgcgcgagtcgttcgtccaaggtgactcggccaaggttcgagacggtggtcgtggtctcgcggtcggcgatgaaccgggccagctccagcacccagtccttggcaggggagggcgcaagacgcagcaccggattcttttccagcgcaatcatgcggttcatatgcgattcgacgcgctcgcgactggtggcatggccgagctgctcctgcacatggcgggcgatgtcggccaacggctcatcggtcagcaatccacccataccgttgccgtgcgcggtgcgggcggcggactgctggccgtcgccggctgcgtctgggcttgttgcggaagttttcgcggagtcctcatcggcttcgatttcggccggcgtgtacgccacgtaagtcatgccgtagaagttgcgcacggtctccgacctgaagaaggcgcgcaagtcgaccggaatatccacgcgaatcgcgcgattgcgggcgcgcgagggcatgacgtcgcgaatcgcgcacagtatcgcggcgatgaggtaggaggtgagactcactccgcactgatgcgctgcaccaagcaccttgctggcgctgacgtggtattccatgaacgtaggcgcggcccggtcgatggggccggccagccggtagatcttcgtgcctggcgcagcgccggccttgtctttctcgtagtatttgtcgaagctgttttcggctttgtcgctatccgaaccgtcgtaatccgaaggcacgcccggcacgtcgtatcgctcggcgatgtaggcgtgcagcagcgacttgaacaggttgatggcgccgcgaccgtccgaaatgatgtgcgagacctcgagattgacacgattgcggaaatagcttacgcggaacagcatgcttttgggcccgtaatgcagtcgcgagcatatcggcagatgttccggctccaccagcggccggccgtctgactgttcgaggtaatgccagaacatgccgttgagcaggtgcacgttgaagctcgggaactgggcgatggcatggtcgagcgcgtgctgcaggatgtccggatcgatgccgtccgccagctcggccgaatagcggaacacggtctgcgaggagcggccagcctgggaggagtagaacttgccgatgttgtctagtcggtaccaagtacgtcttgccacgcgtcgcctccctccggtgcgttggcggtggtgccggtgccgggagctggttccagcggtgtgccgtcgaggaaatgctcgatgattcggtaggtggtggccaccagtcccacggccgacgtattgagcaggtagccgtggatgccatcgtgaattcggtaacaggagacgttgtcgttcaccaattgcaggcgacgggcgtacgcttcgtcctcgtctctgagcgggcagtattcggcggacaacaccagcgtgcgcggctgattgctcaggtcgtgcgcggtgagcggcgcgaaatacggattggtcagatcggccacggacgaacggtacatgtcgatgtagtcggccatgtcctgtgcggtgaggatgtagtcggtgccgttggtccgcaccgattcgaacgggctggtctcgggattgtaatcgttgccgactaccgggtaaagcagcatctgcgtgcgcggcatgaactcgccgcggtcgcgggccatgagcgagacggcggccgcaagattgccgcccgcgctgtcgccaaacagcacgatgctgtcgggatccggtgctgggattgtcgcagatatatcgcccccgccggcgggggctgtcggcgcagccgactgggggtgatcaacatcaacagaaccacccaccccagaaatcggcaattccccagcaaacagctgccgggctacctcatagcaatcctcaacagcagtagggaagcggtattcaggagccagccggtactcgactgagatcacacggcgttgcagacgtacggccatatgcgcgcaagcctgcgtgtacaggttgatgccgcctgtggtccaaccgccaccgtggaaaaacaggatcgtgccacgcggcgtgactgagggaagttccgtgttggcattgccggaaataccgtcggcgttgccgctcgacgtgctttccttgatgagtattttgggtaggactttgggtaatacggcgggcagaatcgcggatattgccgaggccacgggcgtgccattggcggaagattcctccagggcttcgggcaggggcgctccataggcgaccagcggcgtgaacactcgcaatggtacggcatatccatccgccataggcgcgaaggcgtcctcgacacggcatttcggattgtcgggtgcctgcttggcgataagctcttccgccacgcgctgcaatttgtacgacttgcccgcgttgggcttgatgtagctggcggccttcatcgcggcgaacaatgcctcgttgatcggcatgacgacaggtcctttcagcggcggattcggtagtgcgaacaccccaaccttagcccatgaccggcatgaacaaaaaagggaaggaacccgagagttccttccctgtgtgccgtatcagacgcgatacgcgccgattatcaggcggtgaagtattccacgccggcctcgaagatcggctggtacttgttgccgggcacgttgacgtacaggccgttgccggaacgctccgagtgacccatcttgccaaacacgcggccgtccgggctggtgatgccctcgatggcgagcagcgagccgttcgggttcacatccaggtccatgccgggggtgccggtctcgtccacgtactgcgtggcgatctggccgttggccctgagctgggcgagcacctcgtcggaggccacgaagcggccctcgccgtgggagatggccacggtgtgaatgtcgccgaccgaagtcttggacagccacggggagaggtcggaggccacgcgcgtgcggaccagtcggctctggtggcggccgatggtgttgaaggtcagcgtcgggcaggcgtcggtcatcggcacgatgtcgccgtacggcaccagacccagcttgacgagcgcctggaagccgttgcagatgccgagcatcagaccatcgcggttcttcagcaggtcacgcacggcctcggtgacggccggcgcacggaagaacgcggtgatgaacttggcggaaccgtccggctcgtcgccgccggagaagccgcctgggatcatcacgatctggctcttgttgatctcgtcgaccaacgcctgcgtggattcggcgacggcggccggcgtcaggttgttgacgatcagtgtggtcacatcggcgccggcacgctcgaaggcggcggcggaatcgtactcgcagttgttgcccgggaacaccgggatcaccacatgcggcttggccacggaagagccgacgtacacggtcttcttcggcgcgtggaagtcgatggtctcgacggtcgcgcccttgtcctcgcccttggaacggtacgggaacacggattcgatgccggactcccaagcttcctgcacagcgtccaggtccagcgtctcgccggcggccttgaacacgtactcggaggtggtggtgccgatttcgccgatctcgaccaaattggagacggccggaagcttggcatcgtccgccagctcgacgatgaacgaaccgtatgccggggtgaacaggtcgtccacggcgatgctgttgttcagggtcacgccgatgcggttgccgagcgtcatcttgaacagggcttcggcggtggcgccatagcccggcgtagagacggccagggcatcgtggaagtcggtgagctcctcgatcacggagaacacctcaagcagcgcatccttgtccggggtcagaccgtcggccaggtagcgcggcgcgatgcgtacgatacggtgatcggcgtccttgaattcaggggaggtggcgcgcttcatgttgcccacggccacggcgaaggagatcagcgtcggcggcacgtcgagatcctcgaacgaaccggacatggagtccttgccgccgatggcgccggcgcccaggtccacctgggccatcagcgcgccgagtacggcggccgccggcttgccccagcgttccggctcgtcgcgcagcttctcgaagtactcctggaagctcaggtaggccttctcatgctcgaagccggccgcgaccagcttggccagcgactcgaccacggacaggtaggcgccggtgaactggttcttggacatgatgtacgggttgaagccccacgccatcgccgaagcggtggtggtctcgccgaacaccggcagcttggcgaccatggccatgttcggggtgagctgacgcttgccgccgaacggcatgagcacggtgcccgcgccgatggtggagtcgaagcgctccgaaaggcccttgttggaggccacgttgatgtcggtgaccagcttgttcatgcgttcggccagcgtgccctcgccccacggggtctcgtaggactgctgttcctcgacatgcacggtctggtgcttggaagcgccgttggaggccaggaactcacgggacagattcacgatcttgtcgccgttccaggtcatcaccatgcgcgggtcctcggtcacggtggcaatcaccgtggcttcgaggttctcttcgcgggcgtaggccaggaactcgtccacgtcctcggcggccacgtccacggccatgcgctcctgggattcggagatggccagctcggtgccgtccaggccctcgtatttcttgggcacggtgttgaggtccacgaacaggccgtcggccaactcgccgaccgccacggacacgccacccgcgccgaagtcgttgcagcgcttgatcagacggcaggcatcgccgcggcggaacagacgctgcagcttgcgctccaccggagcgttacccttctgcacttcggcgccgtcgagttcgagcgattccacgttatgcgccttggacgaaccggtggcaccgccgatgccgtcacggccggtgcggccgcccagcaggatgattttgtcgccaggggccggggtttcgcggcgcacatggtcggccggggtggcggccacgaccgcacccacctccatgcgcttggccacgtagccggggtggtagatctcgtcgacctgaccggtggccagaccgatctggttgccgtaggagctgtagccggcggcggcggtggtcacgagcttgcgctgggggagcttgccttccagcgtctcggagaccggcacggtcgggtccgcggcgccggtgacgcgcatcgcctgatacacgtaggagcggccggacagaggatcgcggatgcagccgccgatgcaggtggccgcgccaccgaacggttcgatttcggtggggtggttgtgggtctcgttcttgaacaggaacagccagtcctcgtcgtggccgttcacgtcaaccttgaccttgacggtgcaggcgttgatttcctcggactcgtcaaggccggtcaggacaccgttcttcttgagccacttggcgccgatggtgcccatgtccatgaggcagacgggcttggcgtcacggccgagctcgtggcgcatcgccaggtaacgctcgaaggcggccttgacggtggcgtcatcgatggtcacttcgtccagctcggtgccgaacgtggtgtgacggcagtggtcggaccagtaggtgtcgatcaccttgatttcggtgatggtgggctcgcggctctcctcgctgaagtacttctggcagaattcgaggtcggccagatccatggccagaccgcgctcgtcgatgaacttctggccggcttcggcgtccatctcgttgaaaccggcgatggtctcgaccttgccgggcaccggcacctgggtcttcagggtttccttggtctccaggctggcctcgcgggcctcgaccgggttgatcacgtaatgcttgatggtgtccacgtcggcgtcggtcaggtcgccttccagcgcgtacagcttggcggagcggacggtcgggcgctcgccctgggagatgagctggatgcattcggcggcggagtcggcgcgctggtcgaactggccgggcaggaactcggtggcgaagaccttggcgccggcgaagtcgggcaggtcgtaggccacattgtccacctgaggctcgctgaacacggtgggcacggtctggtcgaacagctcctgggagatgccttcgacgtcatagcggttcacgatgcgcagggccttgaggccggtcagtccgaggatcgtgcgcagttcgcccgcaagctgctgggcttcgacatcaaagccgggcttcttttccacgtacacgcgaaaaaccatggaaatcctttcttgaaattaaagacaattggctcccctcgagaggggagccagataatgcattactcggcgacttcgatgccttcggacttggcgagttcggcgaggcgctcctcgatctcttcgtaggccgggatgatgctgccgagaccacggcggaacaggtccttgtcaaggtgctcgaccttgccggagtggtccttctggtcccacagacggcaggaatccggggtgatctcgtcggccaacagcagcgtgccgtcggtggcgcggcccatttcgatcttgaagtcgaccagcttgacgtcgatcttggcgaagatctcgatcagggcctcgttaatcttgcgggccagcggggcgatctcggcgagatcctcgcgagtgcatacgccgagggccaccaggtcatcgtcgttgacgaacggatcgtgcagatcatcgttcttcaggaagtactcaagtaccggctccttgagcggcaggccttcctccacgcccagacgggagcagaagtggccggcggccacgttgcgcagcacgatctccaacgggaacatgttcaccttgcgcaccagctggccggtgtcgtccactcgcttgataaggtggctgtcgatgccgcgcttcttgagcaggtcgaagatgatggtggtgatgaggttgttcagacggcccttgccggtgaagtcttccttcttttcaccatcgccagcggtggcggtgttcttgtattcgacccacagaacctcgggatcgtcggttgcgtacagttgcttggccttgccctcgtagagcttttccagcttctccatgactcacctttcaggagtggaatttctgggtgaactaacggtaaaagggtaccaatcgagggctacaacaacactcagcatgacgctacgatgcggccggcgcatcatacgtcgctgcatcgaacggccatacgctgttgggatggcggaggcggccgtcattggccagtacgatcagctcgtctccggtcgtgtagccttccggcatgaagatatctgcagaagcgcgtgtgaatactcagatgttcgtcaatagacgaaacatgactcttcggccatatacacacgataatgggagtgacgaaatggtacaaggaggttcgtcatgatcgttcatccacgacccggacggcaataatattgaggccatgctgagctgatcaggccgtggactactccacggtaatcgtcaacgcatcggccacgaggccggccttggcacgggcgtcggcttcggactcgccgacggccagtgccacggccatgcggcggtggccatgcacttcgggcttggcaaaaatgcgcaggtccgtgccgggttcggccagagcagcggccacatcggtgaactcgacctcaccgtcgccggccaccacaatcgcatggcttgccgccaccgagccggccggaatcgtgagcgacacatgctcgggggtgatcggcaggccgagaatcgcgcgggcgtgcagcgcgaactcgctcagacgctgggaggccattgtcaccataccggtatcgtgcggacggggggagacctcgttgaacagaatcgagccgtcggtgagcacgaacagttccacgccgaatacgccccaaccggtttcgccggccgcctgagccttggccaccaagccttcaacggcggtacgtgcgatgtcgcgcgcccgctcggcctcaccatcgggttcggtagccggctgccaggactcgcggtaatcgccggactcctgacgttggccgatcggcgcgcacgtcacaatgccggcggacgaagaaacagtcagtaccgtcagctcacgctccagcggagcaagcgcctcaacgatcacgcgcgacacatcgccctcatcggcggcgcggcggccctcctgcgcttcggtccaagcggcatcgatggcgtcggcggaacgcaccaccgactggccgtgaccagacgagctcatcaccggcttgaccacgcacggatagccgacttccgaagctccggcgcgcagctcttccagcgagccggcaaaacgatacggtgtagtcggcaagcccaattcttcgtgggccagtacgcgcaggcgctcgcggtccatgcaaatcgcggcgatttcggcgctcggcaccacctgggcgcccgcggccgcggtaccggccagcacatcggtggcgatggcctctacctcgggcacgatgatgtccggcttgatttcatcgaacaatgcctgcaattcggcggcattcgccatatccaacgcgcgatattcatgcgccacctgctgggccggagcgccggcatacgagtcagcggcgcacacccacgcgcccagtcgcatgagctcgatggccacttccttgcccagctcaccagcgcccaaaaacagcacgcgggtggggtgcttgcccagcggtgtgcccagcgggcggttggctgcgcgagttgcgggggagacggcggaagtctcggcgggaattgcgggagaggaggtggaagtcacggcagtatttacggcgttctcagtcatacccacattctgccatgccgcgatgatttcgcctatgcggggctcggattcggcgacgtgcgctgcggagcgcgtgattcaatattgggcaaaatgcggcagcccataccatttcatacgcgttcaggcagcgcggccgacgccattgcagcgcggtggtttaggatggggcaatgcgcgaaaacgggattgaagagagcattgatcgtcctctgactatcgctcttgtggtcgatacggtgggcaatcagggcaacggcacctccaattcggccttgcaatgggctgcagaattggagcggcaaggccatcatgtgaggcttgtcggtataggggcgcccgaatatccggcgcgcgtgaatagggtgccgctcgtctcgtgggtggccgccaagcagctcatgcaattcgccgaacccagcgacacgttgttccgcaccgcctttcaaggcgtggatgtggtgcatatctatatgccgttcaaattcggccgtcgtgccgctaaagtcgcccaccaaatgggcattcccgtgactgccggattccacctgcagccggagaacgtgctgtattcggccggcccgctacgtcgcattcccggtatttccagcttcctgtactggctgttcaagcactggctgtacaagcacattgaccacatccatgtgcccaccgaaatgaccgcgagcctgttgcgcgcgcacgggtataaagccaagttgcacgtgatttccaatggttattcaccggtgtattcgccgaagaagccggccgatccggatgcctcggctcccgtgccgttccgcgtcatcgcttccggccgactggctagcgagaaagatcagattacgctgatcaaggcggtgtcgatgtcccggcacgccggcgatattcagctggtgatcgccggtactgggccgctcaagcagtatctcaagttccgcgccgggcgtttgctggcgcgcaaggccgatatcggattccacaagcacgccgatatgcccgatttgttgcgttcgggcgatttgttcgtgcattgttcgattgccgacatcgaatcggtgagcgtgatcgaggcgatggcgtgcggattggtgccggtgatcgccgcgtccgaactgtcggcggccagccagttcgcgctgatcgacgagtcgttgttccccgtgcgagacgcggccctgctggcccgacgcatcgattggtggatcgcacatcaggccgagcgcgccgaatggggcgagaaatacgccgaatacaccaaggcgcattattccgtggaagcctcggtccacaagttcgtggatatggaacgcaaggcgataggggaataggagccttctcgtttgcggagaggtctttccctcagtccgcctgcggtggccagctccctcatcagagggatctacgaaaaaacctccctctgatgagggaggtggcatcgcgaagcgatgacggagggagagattagcgaagggttttacaacaactcaataagttgatcgacctcttcaggcgtggtggcccagctggtgcagatgcgcatcacggtgtgcgtgtcgtcggccttttcggtaaagccgagcttgatctcgcgctccagacggtcgatggtcggctgatccatcgtcacgaaaatctggttggtgggcgcttcgaaagtgagcgtgtagcccttggcgcgcagggcctcgcgaatacgatcggccgcctcattggcgttgcgggcgatcttgaaatacaggttgtcggtgaacaaagcgtcaaactgcgcgcccagcacaaagcccttggccagcaaggcaccgtgctgcttgatgagggtcaagaagtgcttcggcgtgttgtgcttggtaaacaccacggcctcgccgaacagggcacccaccttggtaccgccgatgtagaacacgtcggcgatggtcgccagatccgcgagcgtcatgtctgagccggtggtggtcagcgcgtagccgagtcgcgctccgtccacgaacagcggcatgtcgtacttgtgcgccacatcggcgatggcctgcaactcggccttggagtagatggtgccatattcggtgctttgcgagacgtacacggagcccgggaacaccatgtgctcgtagttgccgtccgcatagaaggtcttgcagaactcgtccagttcggtcgggtccattttgccgttgtgctggggaatcgtgagcaccttgtgcccggagaactcgatggcgccggcctcgtgcacgttcggatggccggaggcgaccgcgaccacgcctgcatacgccggggtgatggtgtcgatgacgacctggttggtctgcgtgccgccgacgaggaaccacacatccgcgtccggctggccgcaggcctcgcggatcttggccttggcctgatcgctcagttcgtcggacccgtagcccgaatacagatggttgttggcttcagccacggcttcaagcaccgcgggatgggcggcgcgggagtaatcgttctcaaaagacagcatgacggaccttttgtccttatgttcggtgaattggatatgccctgagtgtacaacgcggtggttcccggcatgcctatttggcctataacccaggagcggggaattcatggagaaaaaacaaaacccttccgcgaacggaagggttttactggggtggccaacgcggctcgaacgcgcgaccttctgaaccacaatcagatgctctaccaactgagctatggccaccatagtgccgcattcagcaagctgaattcgcgcaacaggtgaatattatacacaactttgcggatgtgtgctcatcggtgtgtcgcgatggaatcaagtggtcggtttcattcttggggccaggctgtgggctgtctcagatggcgggatgtggatgagtgggtcttgtgcggcgattgatgaaaagtcaaggcacacgacggcgtgatggtacgactggggattgcagaaatgattacgtgagtgttcgcaatgtgagcattatgtttcatgtcaaccgcgaccctcctagtttcatgcgatgttacctacaccaaacaagggaagagaaacaccatggaaaaggttaaagcctttgcggattggctgaccaagtggtttacggtcatcgtcatcgtctgggccgtcttcaactacttcgtgccggccgccagcctgtggggcaaggcgtacaccggctacatgctgggcatcgtgctgttcggcatgggcctgactctgacgctggacgacttcaagcgcatcctgacccagccgctgatggtcatcatcggcaccgtagctcacttcatcatcatgccgctcatcgccgtggccctgtgcgcgatcttccacctgtccggcccgctggccgtgggcgtgattctcgtcggctgctgcccgtctggcacctcctccaacgtgatgagctacctgtcccgtggtgacgtggccctcgatgtctccatcggcatcctctccaccctgtgcgccccgttcatgattccgctgctgatgcagctgctcgcttctcagtacgtgtccgtgccgactcagtccctgttcctcaacgccgtcaaggtggtgctcttcccgatcgccctcggtgtgatctgccacatgatcttcggcaagaagatcgagaaggttacggtcgccctgcctatcgtttctcaggtggctattctgcttatcatcggcgtggtcgttgccgccaacggtccgaagctgttcgtggccagctccctggtggccatcccggtggtcatcctgcacaacctgtgcggctactcgctgggcttcggcttctccaagctgatgtacaagatctacccgaagggcttccgctacgcacagcagaaggccatcaccttcgaagtcggcatgcaggactccgctctgggcgcaaccctggccctgacctccttcgcaaccaacccactcgctgccgtgccgtccaccttcttctccgtgtggcacaacatctccggctctatcctgtccagctggtggcgcaaccacgatgacaagcacgagatccactgggattccgacaatggcgagaagggctctgccaagagcaccgtttcagcggcccacccgttcgacgccgataaggccgccaaggtcgctgcctgaaatcctgaaatggtgagaaaggtcgggtaaggcacgactccagtcagtcggtcatccacctttcctacctcgcataacatagccgctcccgcttactcccgattgaggtatcgggcgtttcgcgagggcggttttgctataattggtaatgcagaaagcggcaaggtaatacggcaaagaggccgggtcgctagaggttcccatcggatatggaagagcacgaggatgtgctggaaacagataacacagaagcggatgtggtgaaaagaaacataatgtaacctccttggcggtgcccccgtgtgacatagtctccgcgggggcacctgctgtgtggcgttcctttttgcgacgcattcccgggaatattgcgttgggaggagaggaaaagtacagggcgcaagaggtccccaaaccagtgagttgtggcccggcgcgtcgttgtccggaggaatcgtaatataggtattcgtgtgtgccagcagcacgccttatgtaacaggcgagcatgctgggatatccttcaaaccgctgatcgcacgcagtaatgcgccgacgggaggggcgaaggccatcgggccggtggactgggctatcttttccgattcgtcgggtgccgccaacaggcggataccaagcgagtgtgctgaaaagtgtgggtgcagtgcggcggtcacacaaaagcaagagaaaccactgaatcggagaattcaagttgcctactattgaacagctcgtccgtaagggacgtcaggcaaagccgaagaagtccaagactttggccctgaagggcagcccgctgcgtcgcggcgtgtgcacccgtgtctacaccaccaccccgaagaagccgaactcggctctgcgtaaggtcgctcgtgtgcgcctgtcctcgggcatcgaagtcaccgcctacattccgggcgaaggccacaatctgcaggagcactccatcgtgctcgtgcgcggcggccgtgtgaaggatctcccgggtgtgcgttaccacatcgtgcgtggcgcgctcgatacccagggtgtcaaggaccgtaagcagggtcgttccctgtatggagcaaagaaggcgaagtaagagatatgtcacgtaagggaccttccaagaagcacgtcgtgctgcccgatccgatctacggttccaccgtggtggcgcagctcatcaacaagattctgcttgacggcaagaagtcgatcgccgaagacatcgtctactccgcgctcgatatggtcaaggagaagtccgaccaggagccggtggctgtgctcaagcgcgccctggacaacatccgtccgtccctcgaggttcgctcccgccgtgtcggtggcgccacctaccaggtgccggtcgaggtcaagccgaaccgcgccaacaccctgtcgctgcgctggctgaccgacttctcccgcgcccgtcgtgagaagaccatggctgagcgtctcgccaatgagatcctggatgcctccaacggcctcggtgcttctgtcaagcgccgcgaggatactcataagatggcagaggctaacaaggccttcgctcattaccgctggtaatcactcgccctgagtaaaactaaggaaaaagatggctgaagagatttcggacctccacgacgtccgcaatatcggcatcatggcccacattgatgccggcaagaccaccactaccgagcgtattctgttctacaccggtaagaactacaagatcggcgagacccacgacggcgcctccaccatggacttcatggcgcaggagcaggaacgtggtatcaccatccagtccgctgctaccacctgcttctggagccgtcagtcccacgacaccaaggacaagttccagatcaacatcatcgatacccctggccacgtggacttcacggccgaggtggagcgctccctgcgtgtgctcgatggtgccgttgccgtgttcgacggcaaggaaggcgtggagccgcagtccgaaaccgtgtggcgtcaggctgacaagtacggcgttccgcgtatctgcttcatcaacaagatggacaagctgggcgcgaacttctactactccgtcgacaccatcaaggagaagctgggtgctactccgatcgtgatgcagctgccgattggttccgagaacgacttcactggcgttgtcgacctggttgagatgcaggcttacgtgtggaacggcaccgaggagctcggcgccaagtacgacaccactgaaatcccggacgacctcaaggacaaggctcaggagtaccacgagaagctcgtggaagccgctgccgaagccgacgacgacctcatgaacaagttcttcgaggacggcgacctgtccaaggaagacatccgcgctggcgtgcgtaagctcaccatcgccaaggaagccttcccgatcttctgcggttccgccttcaaggacaagggcgttcagccgatgctggacggcgttgtcgattacctgccgtctcctgaagacgtgccggccatcaagggctacaagcctggcgatgagtccgtcgagatcgaccgtcacccggtcaagtccgatccgttcgcggctctggtcttcaagatctccacccacccgttctacggcaagctcgtgttcgtgcgcgtctactccggctccgttgtgccgggcgactccgtgctcgactccacccgcgagaagaaggaacgtatcggcaagatcttccagatgcacgccgataaggaaaacccgatggaccgcgctgacgccggtaacatctacaccttcgtgggcctgaagaacgtgaccaccggtgacaccctgtgcgccatcgacgatccgatcaccctcgactccatgaccttcccggatcctgtgatccaggtggccgtcgaaccgaagaccaaggccgaccaggagaagatgggcatcgccctgtccaagctggccgaagaggatccgaccttccaggtcacgaccgacgaagagtccggccagaccctgatcgccggcatgggcgagctccagctcgacatcatcgtcgaccgtatgcgccgcgagttcaaggttgagtgcaaccagggcaagccgcaggtcgcctaccgcgagaccatccgcaaggccgtcatggaccagggctacacccacaagaagcagaccggtggttccggccagttcgcaaaggtcctgatgaacttcgagccgctcgacaccaccgagggcaagaccttcgagttcgagaataaggtcaccggcggccacatctccgccgaattcatcggccccatcgaggccggtgtcaaggaggccatggagtccggtgttctcgccggcttcccggtcgtgggcgtcaaggccaccgtcactgacggccagatgcacccggtcgattcctccgaaatggccttcaagctcgcaggttccatgtgcttcaaggaagctgccccgaaggccaagccggtcattctcgaaccgatcatgaaggtcgaagtccgtacgccggaagagtacatgggcgaagtcatcggcgatctgaaccagcgccgtggcaacatccagtccatgaccgacggtgtcggcgtcaaggtcatcgacgccaaggtcccgctgtccgagatgttcggctacatcggcgacctgcgttccaagacccagggtcgtgccatgttcaccatggagatggactcctacgacgaggtgccgaagagcgtctccgaggagatcatcaaggcccagcgcggcgagtgacacgcgccactgcatgaagtagccagtgtcttcagtcagcggtaatatcgtataccgctgactgggttctggctcttcaaagtggcacataacccagaaacccagtagaataagcgagttcctgtgcgaaagggtgcaggaaactcacgagacgtccaggaggacaaaagtaatggcaaaggaaaagtacgagcgtactaagccgcacgttaacatcggtaccatcggccacgtcgaccacggtaagactaccctgactgccgccatctccaaggtgctgcacgaggagttcccggatgtcaacccggagtacgacttcaaccagatcgattccgctccggaagaggccgcccgcggtatcaccatcaacatcgcccacatcgagtaccagaccgagaagcgtcactacgctcacgtcgactgcccgggccacgccgacttcgtgaagaacatgattaccggtgctgcccagatggatggcgctatcctcgttgtggccgccaccgacggcccgatggcccagactcgcgagcacgtgctgctcgcccgtcaggttggcgttccgaagatcctcgtcgccctgaacaagtgcgacatggtcgacgatgaagagctcatcgagctcgtcgaagaagaggtccgcgacctcctcgacgagaacggcttcgaccgtgactgcccggtcatccacacctccgcttacggtgctctgcacgacgacgctccggaccacgagaagtgggtccagtccgttaaggacctcatggacgctgtcgacgactacatcccgaccccggttcacgacctggacaagccgttcctgatgccgatcgaggacgtcttcaccatctccggccgtggtaccgttgtcaccggtcgtgtcgagcgtggccagctggccgtcaacaccccggtcgagatcgttggtatccgtccgacccagcagaccaccgtcacctccatcgagaccttccacaagaccatggacgcctgcgaggctggcgacaacaccggtctgcttctgcgtggtctcggccgtgacgatgtcgagcgtggccaggttgtggccaagccgggctccgtcaccccgcacaccaagttcgagggcgaagtctacgtgctgaccaaggacgaaggcggccgtcactcgccgttcttctccaactaccgtccgcagttctacttccgcaccaccgacgtcaccggcgtcatcgagctgccggaaggcgtcgagatggttcagccgggcgaccacgctaccttcaccgttgagctgattcagcccatcgctatggaggaaggcctgaccttcgctgtgcgtgaaggtggccacaccgtcggctccggtcgtgtgaccaagatcctcgcctgattttcatcagacaagaatcttcgcttgaactagcgttataggaaatccccttcgaggaaactcggaggggattttctataaccgcagcaggatatggatatgtaccacgacttccggcctggatgcgctagtgttgcttttcaatagataaacggactgctgcactgcgaggatatgacactgatggcaggccgggaaagaaggtcgatgatgactggtgcacaggccgctcactgtggttctgtatccgcaatttcgctgggactgcccgtttccacggcgattcccgaagccaaaggcacactgccgaaagccttgttcgtaggcaaagcgccgatttccggcaaactcaagcagcgattggtgaacgagatcgaatccatcaccatgctggcgttggcccggtcggccaacacggggcttgcggacggcaaactgatcccggaagtgctggtcatcggactgaagcttacggccaaagccaccggcataccgaacgaagtcatcgacctgatcgccggacagcgcaaatcgggcatcgtgttcgtgtgcgtacgcgacgtgccgttcgagggcagcacgcgtgaggaatgcgcgttcgccgtgcgccgcgccataccggggcgtgccgggcacacgccgatctatcaggtatatgccggcgactggcagccggcgggggaggcccagctggagctggccggctctactattgatgagctgtgggcatcgctgtgctcacagaccattttgggtacgccggaggtcgagaatctggatgcgcgcatcattcgccatactgaaattgctcggctcgaatccgaagtggacaagctcactcgtgaccatcagcgcgtcaagaacccggcccagcgcaacgagatctatgccaaactccacaaggccaaggcgcagctcgcaaaactgcgcgaggcatagtgatgtgaaagccattgggcttccgctggcgggagctggctcgcgaagcgagactgagggtggtccaggtccgtggcctagggctacgcccaagctaattgaaatattcgtgcatcatacagcgtacagttaaaccatgttccctctgctcgaaaccctggtcgccgtatacgaggtgggtcagttcacgctggccgccgatgagctgaaggtatcgcagtcgacggtgtcgtcgcgtatcgcccaattggagcagatggtcggcgcgccgctgttcgtgcgcaatgcgaaaagtgacgtgacgcccacacaggccgggcggatgctgtaccagactgccatcggcatcgacggattatggcgggatacgcgtgagcagatcgcccgcgtgcaggaggcgcgtgagccgctggccgtgtcgttctcgcacacgaccgcggcgattctgctgccgaaggcgttgccggtgatggctcgggacatggacggtttcgacttcgctgtacacgtgatgaactcggatgcgattctcgaacaggccagcatgaaggctgtgcagctcggcgtggtggaaaagccgatcgtgaacgattcggtggaccgcgtcaccctgtgcgaggaccggctggtgttggcgggggaacctgacggcgtgtggatggtgcgcgaacacggttccggcgtgcggtattacacggatctgtatttcaagaccgctcaggttgtgcctgcacgcacgatggaagtgtccagtaatgcggcgattgtggcggcgctgtccgccgggttcgggcagtcgttgatttcggaagccgccgtgccggcgggcgtgccggtgcagcgggagcttggcgatgagtttgtgcggcggttctatgcgctggtgccgagatccggtctgacgcacgatcagcgggagttggcggagacgattattgctgcgctgcgcgggtagtcagatagtcgactgaggggaggttgcgaacgttgtttctctccctccgtccgcctgcggcggccacctctctcatcagagggagatcaattaggtatcgacaaaatcgatgatatgtattggttgcaatgatttgaccgatgtaaacgcttgagcttcaatagacatcatgagagagttctgtacaaaatggtggaagcgcattgccaccgttgacatgctgttcattggtgttctgactctgctggcctccctgttcgcctcctggctcaagcagttccccggattcagcctgttcggcgcgctcatcatcgcgctgctcatcggtatgatcatccagttcccgatccgcagtgcctacgtcggttccaatgatggccgcaaggcaggcgtcaaggacgccgctggcctgatttccaacaagctgctgcgcctcggcatcatcctgctcggtttcaagctcaacctcgccgtgctgttcacgcagggcatcaagtgtctgccgatcgccgctgtggtcgttacgctgaccatcatcgtgtgctatgccatcgcccgcaaactcggtgtcgacccgatgctcgccatcctgaccgccggtggcaccggcatctgcggtgcggccgccgtcatgggcctggccggttccatcaaggtgcctgaggacaagcaggacgagaaggacaacgacgtgaccatggccgtggccatcgtagccattatgggtactgtgttcgcgttgctggagatcgcgctcggcccgctgaccggcatgaccaaggaccagctgggcatcaccgccggtgcttccctgcacgaaatcgcccacgcggtcgcgggcggcgacgcgttcggcgcggtggacatcgccaccatcatgaagctttcccgcgtgctcatgcttgtgttcgcggccatcatcatcgccatctggtgggagaagaagcattccgaggttcagagcaccggcaagaagaccgtggccttcccgtggttcatgctcggcttcatcggcgcttcgattatcggcaccttcgtaccgttcgtcacctccatcaccccgcagctcgtggactttgcgtacatcgtgctcggcatggccatggccgcgctcggcatcaacgtgaacttcaaggccatcgcttccaagggcaagaagccgatgctcgccagcttcctgacatcgattctgctcatgtgcttcgctgcaggtgttgcgatgctgttcttctgataagcgctccaaatacaaataggcgaaggcgaacgacagtgagcaattggaatgtgtcacctaaaaatcacgtacttgcacaacggataaccccagccgaactggcaggccatcgcaatgaacttcaccacatatggactcagcccggtcgcacccggcatccagccgatcagcagcgtgctgaacgtgaagttccagatccacagcagcacgaacagcgccacggaacgggtgaagttgctggacgatttgaatgtcacgttgcggttcatcacgaagttgtaggtcgccgaacacaccacggcgatgccgttggcgatctgtgagggtacgccgatcaagtgcagaatggcgaacgtcgcatactccacaatggtctgcgtggcggaaacacccacatacttgcccagcacggcgagtccattttgcttcggggttgccgtgcccacggtattttccgcagtattcgttgtggtcgaggtatttgtggcgcccacaccttgattcggcttcacatccgctccattgttcgccatgcccatatacctcccggatgtacctgtgacgttcgacctcgcaatgataccgctgaccgcgtcgggaatcggcgtggcggtcagacgagaaaaccgcaggccgcagcaacgaccggcacacccagcgacagcaccagataggccgctgcggtggggtagcggtgtttgcggaagagcgtcaccatttcgttgattgcggtcgagaacgtggagaagccgccgaggaaaccggtggccagcactagccgccatggttcatcaagtgtcccgccgagtgccagcgccgcgaccaaaccggctaggaatccggcgatgagattgatggtgaacgtggaaagtgggaatgcgcgctgccagtacgttttgatggtcacgtcaagcagatagcggcaggaggcgcctacgccgccgcacaggcagaccaagattggtaggaatacggtcatcacgccttacctcccttgctggtcgtagcggcattcgtatcagcggacgcttcggcggatacgttcgaggagccggccagatgcgttcctgcccacacgccggcagacgcacaaaccagacccagcgcgaacgtcaccagtagataggcaatgccggccgccacctgaccgtcgcggattgcggtaaaaccttccagcgcgagtgtcgacatcgtagacaaaccaccgcatacgcccatgccgagtccgcgactggcaagttctttggaacgtgcgccgaaccgggaagcgccggccaagtaagcggtcaaccctgcatagcagaagcaagccagcatgttggccacaaacgtgccggtatggaagctgccagccgcgggaatctgtgcgaacgcatagcggatagcggtgccgatcgcaccgccgcagaagacgaccaacacaatatcaagatgaatatcggggagcttgcgcgccgggggagtggtcgtgtgcgtaatcggccgggcacctgcggatggggattgcgaatccataatagcctttcctgaaaccgctgaatcctgctgaagacacaacgattccatgcaatatcaaatcgtgtgtaggaactatcagcagtgtgcggttcgaaacgagttcaggcgggttccatcgccggttccttagcctactcgtggcggcgacaacaaacggcagcagtatctcggatattggcctatcgcggtggatttcggcaagagacttctgcaatgccgatgaacttggttgccgtgaggcgataaagcacgtagatgaattgcttggttgcttccatacctcgtgggtatggctcaacatggtttatggctattggctaatacagatcgattgtcgtttaatggaacatgaggataacgggccctaatcgctcggtgccggaaacaaggagttgtgaatatgtctgaaaccatgaaagccgcgattttcgtggagcctggcaagatggccgtggaagaggtgccaaaggcggcacttcagcaggatgatgacatcgtgattcgcatggtgcgcacctgtgtatgcggctctgatttgtggttcttccgtgggctgagcggacaggccgcacacagtcaggtgggccacgaagccattggcgtggtcgaggagactggcgcggcggtcgaatccgttaagccaggtgatttcgtggtcgtgccattcccgtacagctgcggcaagtgcccggtatgcaaggccggcttcgaatccgtgtgcccgcacgggggctacttctccgcttgtcaggccgaatacctgcgtgtgcccgaggcggacggcaccgtggtcaaggtgcccggttcaccggaagattattccgatgaacagctcgcatcgctgctgaccatttccgatgtgatgtccaccggttatcacgcggcggtttctgccgaggtcaagcccggtgacacagccgtggtcatgggcgatggtgcagtcggcctgtgcggtgtgattgccgccaagatgcgtggtgccacgcgcattattgccatgagccgtcacgaggatcgcgcggcgctcgcccgcgaattcggtgcgactgatatcgtgcccgagcgtggccaagaggctattgacaaggtgctggagatgaccggtggctatggtgcggacgcggtgctcgaatgcgtgggctccaagcagtccttcgacacggcgattggcctgattcgccgcggtggcgtgattggtcgtgtgggtctgccgcacgacgtggagatcagcgccgaaggcacgttctacggcaacatcggcatcaagggcggcccggctcccgtgcgccactacgatattgacggtggtctgctggatgcggtgcttaaaggcgagattaaccctggccgcgtgttcaccgccgaatatgacctcgaccatattcaggacgcttatgaggccatggaccagcgcaaagttattaaggcgttgatccggttctaatcgcgtggtgtgacggggtttaccgcagtggtatttaacgtccgtatgtatgcgtcccctttgtagggccgcatacatacggacgttgtgatgtgtctgacgcggtttacgctgaacgattgtggtgacgcaaaccggtcacctgttactcggcgagcagtgccttgtactgtgcagcggactgggcgagggcctcgtcggtgatgccgaaagcgccgcacgtggcgaacggcttgagtcaggtcgcgccgatgtataagccgtgccctcgatcggaataagcagctgctcgatggggtagtggccggggtgccggtctggtaggccgattccggcgaaccggtggacactgcgcatcgcgtcgggaaccgtggccaaggcgtacaccgaactcgccgactgcggcatcatcgacaccggtgccggccgcgcggcgcgtgtaaaacgggtcaagccgattcccgaaccgctggtgcgcgcggccaagacctatgccgacgaggcccgccggcttggcgcgagcctcgatgacgccttcaacgccctgtgcgcgcagtggtaaagcgcgcaccgatgcgaagcctacacggggtgcaccgtcagcgaaaagtcgccgatggtgctgacggtcgagggtgaggccagattgcagacatctcgcaagcagtacgtggcatacagcggaagataggttgttccgccgtcctgcgcaatattggagcgggacagcaccacgccctgcgagatgcgatattcggcattggccaatacggcgtcgatggcggcgtgcgtgcggtagctgcgccccgacttgacctcgaacggcatcacagaatcggcgttcgtgtcagcgatgaaatcgacttcaccatgtttctttgccatgtagtaatacagcggaatgccttgcgccgtcagctcctgagcaatcacgttctcgtagatggcacccagattcggtgaggaatcatcaaggtatgcggcttgcgcggtcggttgcgggtatcgtgccatgagcataccggtatcagactggtacagtttgaacttcggtgattgcgccgtgcgtttcaatggtgttttcggctcggtgacgcagttggttttcaatgccacacccgcatcgacaagccaaagaaaatccttctgattgcggtcgtaccgagcaccggggctgatggaggagacggcgaatctgccgttaccgtcaatcagctgagtggggagctggtcgaagatctcctgcacctgcaatgcgcgattgcctgcgtactgcgaaatatcgtggcgatattgccggttcaactcgttctgcaccgcgcgcacagccgccaaatcacccttggtgtccagaaaacgttgcacgacttccggcatgccgccgactaccagataggtgcggaagttcgtcatcattgcatcgtgaatgtaccggtcgattggcgtgaccgaccggcaggattctcggatgttttcaagtgtcgacttctgtacgccgatggcccaacagaattcctcaaaatccatgggacgcatggttttttcgatgaccgagccaacggggtaggagcgtacgcccttgaactcagtgccgagcatggaaccggagaacacataatcgaaacggccatcggccaccagaaacttgaccatggtcatcacatccggtgcctcttgcacctcgtcgatgaaaatcaacgtatcaccgggaatgagcgttgaaggtgagaacaaggtaaggcggctgatgaactcctgcacgtcgttcgccgatgcgagcgctcgggccgcctgcttgttctcgtacaggttgatttcaaggtaatgggcgtattcgtgcttggcgaactcgcgtaccgcgtagctcttgccgatctggcgagcgccggtcagcagcagtgctttgccggtaccgctccgcttccattccagcagatcgtccgagattttgcgctcaagcatggcagctcctttccgaatcccttatgagggtagcattttctgccttgtatgtgcaaaatgccgcatttcaaaatggggctttggtgcaaaatgccgcattttaaagtagggttttggtgcaaaatgccgtgtaaatggtgaattggacgtgcttgtaaggggagctggatgatcgtgcggctggatgaccttgtaactaaatgattgaacgattgcgcggccgtcgtttgcgtggccgcaaagttgtgtgggctgttcgcgaattatgcgcggtcggccgtcatgtgcctgcgcttggggtgctcgataagtagcgctcgcttcttggcgtcctcggcggtcgaagccggtacgccgtcggaggaggcgtcgatgatgcgctgcaggtagccgtatagggtgtgcagctcgtcgtcattcagacagtccagcatagaggggcctgatcaaaaccagttcacgaggtcctttttgctttaatccccgctgagagcgcgtagcgccggaggatgatcggatgccgcgacgccgaatcaagattcagccgctcgccgaccagcccgaccagcaaggaaccggattcgcgcatcggcggcatgcgcgctgctattcgcgctgaaacagcatggcatgggtgcgctgacaccgcgccggcgcaaaggccatcagtgaaactggggaatcggattgcaggtggcggacggtgcccaagacgaaagattctcgtccggcgttcagccgccgtcgttggccgtgatgatactggagaccatgaaactcaggcggcggcagccaagggcgaagtcgagaaagaggtgacggcgtgacacttgaacagaggtcagatagcgcggcggcggagcggtgccgagcatgaccaacaatcaacggccgcaggcgatcgaagtgcgcggggcgcgcgtgcataacctgaagaacatcgacatcgacattccgctgggcgaactggtgggcgtggccggcgtctccggttcgggaaagagctcgctggcgctcggcgtgctgtatgcggaaggttcgcggcgctacttggaggcgctgtccacgtacacgcgacgccgcctgacccaggccagtcgcgcccaagtggacgaagtactgcacgtgccggccgcgctggccctgcaccagcggcccacggtgcctggcatccgttcgacgttcggcacgatgaccgaactgctcaacagtctgcggctcctgttctcccgcgtcgcctcgcacgtgtgcccgcattgcggggcgcgcaacgagtcgacgctgaacgtggcggccggactgcccatcacctgtgctggctgtggcaaggaattccacgcgcccggcgccgaatcgctcgctttcaactcggccggcgcctgcccgacctgctccggaaccggcattgtgcgcgaagtgaaccgtgcggccctggtgccggatgagtcgaaaagtatcgacgacggtgcggtgctgccatggggctcgctcatgtgggaccttatgaagcaggtgtgcggcgcgatgggcgtgcgcaccaacgtgccgttcagcgagctcacgcccgaagagcgtgacatcgtattcaacgggccggccgtcaaaaagcatattctttacaagccgaagaaaggcgacgatttcgccgaactcgatttcacctacttcaacgccgtatacacggtggagaacgcgctcgccaaagccaaggacgagaaaggtctgaagcgcgtggctcgatttctcaaggagggaccatgcgccgactgtggcggcacacgactgagcgccgcagcccgggccccgcatgtgcgcgggctgaacctggccgaagccagcgcgatgaccttggatgcggcggtggattgggtgcgcggcgtgccggaatctctgtccgccgacatgcggccgatggccaccaacatctgcgaatcattcctggacgtggcccgccgactgttggatctgggcctcggctatctggcgcttgaccgcgccggtgccacgctttcaaccggtgaacgccagcgtgtgcagctcgcccgtgccgtgcgcaaccgcaccaccggcgtgctgtatgtgctcgacgagccgtccattggcctgcacccctcgaacgtggatgggctgctcggcgtgatgcatgacttggtggcggacggcaattccgtggtggtcgtggaccatgacgtgcgcgtgctcaaggccgccgaccatcttatcgaaatgggaccggttgccggcgccgaaggagggcatgtgatcgcgcaagggacggtcggcgaggtggcggcgaatccaagtagtcgtattgcgccgttcttggccgataatgtgagcgcgcgcatccgtgagcgcgtggcggaaccgcaggtgttcgaccttggccgcatccgcatgacaaccagccagttgcatacggtcaagccgctggacgttgatattccgcgcggccggctcgtggcggtgacaggcgtctccggctccggtaaaaccacgatggtgctcgaatcgctgattcccgcgctcaaagcgcaggcggcgggggagcggttgccggaacatgtgcgtgaacttgaggccgagggcatccatcgtgcgaatctcatcgacgccacgccgattggcgcaaacgtacgctccaccgtggccacctatgccgatattcacgacgaattgcgccgcgccttcgcccgcacggacggcgccaaggcgggcggctggaaggctggcgatttctcatacaacaccggccgactgcgttgccccacatgcgacggcaccggttcaatctcgctcgatgtgcagttcctgccggacgtgaccatcgaatgcccggattgtggaggctcccgctatgcgtccgaagccgacgcgattcggcgtgcggttaaagcggctaagggcaaagcggcgaagatgaaggtcccggataaacgcaaagctgccaaggaaaaattgagtgaggcgacggatcagggtggcggcaacatttccctgagcctgcctcaactcatggcaatgagcgtggaccaggcgctgtccgtgaccggcgacctcaagaaggttcacgcacgtctgaccaccctgcacgacttgggcctcggctacttgacgctcggcgaaccgacgccggcgctttcgggcggcgaagcccagcggctgaaactcgccagtgaaatgggcaaggcccaatcggacgcggtattcgtgttcgatgagccgaccatcggtctgcacccgttcgacgtgcgcgtgctgctgggcgtgttcgaccggctcgtggcgagcggcgcaacagtcgtggtcatcgaacatgaccttgacgtgatcgccaatgcggactggatcatcgacatgggtccgggcggtggcgaaagcggcggacgcatcgtcgccaccggaacgccggaacaaatcgcggccaatccgaacagcatcaccgggcggtatctgcgctgactcgtatggcggtaacgcgcctttgcataggaccctgcgcgagtaggatagccgtccatggtgcagattcatggcattagacgcgcaagcgcggacgcgaaatatcggcagatgaccgggcagccggtcaagccgctgattctcaaactgtgtttgccggccgtcatctccaacttggtgaccaccgcctacaatctcacggacacgttctttattggtcagctcggcaccgcgcagtccggtgccatcggcatcgcgttctccatcatgaccgtgatgcaggcgctcggcttcttctttggcaacggcgcgggcaactcgatgagccgcgaactcggcaaacagaacaatgagcgcgcctcccgactactggccgtgggcttcgcgggtgcggtgctctctggtttggtgattgccacaatcggattgctgaccctgcggccgctggtcgtcatgctgggatcgacctcgacaatcgccccatacgccgtgcaatacctgacgccgttgttggtcgccgcaccctgtgtatgcggttcgttcgcactcaacggactgctgcgataccaagggcaatcgacgttcggcatgatcgggctggtttcgggcgcattgctgaatttcctgctcgcgccgttgtttatcttcgtgctgcacctcggaatttttggtgccggcctggccaccgccatctgccagacggtgagcttcacgattctgaccacaatgagccgcaaattcggcgtgatgaaactgtccctgcgcaattgcaggccggatgtgctgctcatgcgcgaagtggccggcggtggcctgccctcgctgatccgccaaggcgccggttcgatttccgtgacctgcgtgaacattgccgccaatccgttcggcgatgcggccatcgccggcatggccattgtgatgcgcattatgttgggcgccaactcggtgatcgtcggcctcggccaaggtttccaaccggtgtgcggctacaactacggtgccggcctgttcgcgcgcgtcaaagaagggtactggttctgcgtgcggctcgccacctgcgtgctcgtggtgttggcggtgttgctgtgggtgttcgcaccgcaactggtcgagatcttccgctccgacccggccgtggtggcggtgggcgtggccgcgctgcacatccaatgctgcacggtgattctcaacggcttcaacatgatgggcaatatgatgacccagaccatgggccgcaccggcatcgcctcattcctggccctgtgccgacaaggtctgtttttggcaccgatcgtactgattctgccgatgatgttcggcgtgctcggcgtggaaatggcgcaatcggtgtccgacgtgctgacattcctagtcactatcccgttcatgcggcgaatcctgcatgaattgcggtgaatggtagatggcaactatgaataatcgaagtgcaaagcgggtgccgggcgttccttctcccgcgtatatcgaatcgctgtaccgcaccatggctgccgcccttggcccgaccggatggtggccggctgaaaccacattcgagattatggtgggcgcggtgctgacgcagaatacggcgtggggcaatgtgaatcgttcgcttgcggcgttgaacgcggagggtgtgctcgaaccccataagctggcgattatggggccagcgcatctgcaggaacttattcgcccgtccggcttttatgtcaacaaatccaagacggtacagtcactgagccgatggtatgtggagcgttgcggagcctcgcctgagggcgcggcagatattcccgacgccgaattgcggaccgaattgctcggattattcggtatcgggggcgaaacggccgacgacctgatgctatatgtgttttcgcgccgcacattcgtggccgatacttatgctcgccgactattcgccttccttggatttgatgtgccaaccggctatctggcattccacaaggcctattcgcccgtggtgctggatgcgagcctcagcgtcaaggatttgcaggaattccatgggcttattgacgagttcggcaaggcctaccgcgacgacgcggccaaaagcgagtcctttttgggtggatggagggcttgactgcacggcgaatcgttctcaataagaaaagtgtgaggcccgcacggtgccaatcgcacatctgaatccaagaaatggctgtttgatgctattcccgcgaatgcgcgattgagtgatattgtgcgtttgcctcacacttttcttattgagaatgattcgctgcgatatgccgcttacttgacaaccttaaaaccgctggtccatggggtctgattggtgacgccttcagccgctgctgctgcggccttgtccgggttgcggtcgatgacctgcacggtggcgccagccttgacggtgatgcctgtgacgccggcaatccgctctccaccgagcagatcgacgacccctatcgccgtggcatcatcgccgtgcatgacgccgagattgccgccgaacttgactggctgcgctcgatgctgggtgtcgaaaacgagtctgtgacagaatagttcgaccgacgcaatcgccaaaacgccgaacaggagccaatgatgaccgaagacaagccgatcgccaagccgattatcgatgatgcgacgcgcgagaaaatggcgcttatgttctctggcgaggtctacctgccggatgatgtggacggcttttttgacctgcaggccgcccagcgtgatctccagctcgaactcaacgccacgccgctgaccaacccgaagcgccgtaccgaactcatgcaggcgttcttcggcgcggcgggggagggtctgtacctcgaatgcccggtgtatgcgaactggggctgcaatacttattggggcgagcgctgttacgccaacttcaacctgacgctggtggacgatggtgagatcttcatcggatcccacaccatgatcggccccaacgtcacgcttgtagccaccggccatcccgtgcgtccggacctgcgctatcagggtgcccagtattcgttgccagtccacatcggcgagaacgtctggatcggcgcgaatgtcaccgtgctgcccggggtcaccatcggggacaacgcggtcattggcgccaactcgctggtcaccaaggacatccccgccaacacggtcgcctatggcagcccgtgcaaggtaattcgcgaaatcaacgaacgcgacgacgtctactactggcgcgaccgccaattcagtgagcgttttaagctcaaagagcagtagcgcgaaagctcactcccacacgtcgagcttgcgatttttgtagaaatactcgcggtccttgtcgccgatttcacgcacgacctcgcagggcgcgccgtaggtgacggagttggcggggatggaatgtgtcacgaccgaaccggcgccaatcacgcaattgtcgccgatggtcactcccggcagaatcgacacgttcgcgccgacccacacgttgcgcccgctgatcaccggaatgcaatacgtgtaatggtgctcgcgcagcaccggcaacacggggtggccggcggcgcattagcacggggaacggttgaacgagaagtggattggcatgtggtggtatcgaacatactgatgcgtgtgccgccgagcctgtccagatggctgcctatatgaaccagtgacagaaaagcacgggaacgcgagcgagaggagtgtgcatggggcagttcggcgtcatgattggccagttagtcggatttctgatcatgctgatggtcgggtatggatgtgtgaggcttcgattctacggtcagacggcgttggacggcatgtgctcgttgctgctcaacgtgctcatccccgtgcttgtgttttcgaacgccgtcgatggtgcggaccgcgcgcagcttgccgctaactggggcgtgatgctgctgaccgccgtgatgtacgcgctgctcatcctggtgttctggctggtcgccaaactgttgcggctcaaaggttcgcgtagccatgtatttcaggcgtcgcttattttcggcaacgccggattcatcggcattccgttgattatggcactttggccgcagaacggcgcgatttacgtggcgctgatgtcgatcatcgaccagacgctgctctggacgtacggcgtatggctgtgcgagccggtcgccgaaacgactggcggcaacgcgattggctcgcgaggtgcggtcgcgaacggttcggtgaacggcgccggttcggtgggcaatgctggttcggcgagcaatgccgcaaacggtggttctccggccgtcgtccgcccctcgccaggcacccgcgtcctcggcctgcttaaacgattcgtcaatcccgccttcgtcggcgtgatgctcgccctgattctgattctgctcggcgtcaaggtgccggacatcatcctgaagccgctgcacaccatcggcaatatggccacgccgatgtcgctaatctacttaggcggcctgttcgcgctgaccaagtggtggggcgtcctcaaacgctacgaactctatgctggcctagtcgccaagatgatcgcattcccgctcgccttctacgcgctactgaccgcgctgaccggcgcattgccgcaactgccgatcacccatgacatggtgctgatgattacggtcatcgccggactgccgaccatgaccaccattgccatgttcaccggtcgcaagaacaacatgcccgagtatgcggtcggcttcgtgctcgtaagcacgctgttctcgctggcctccctgacgattgtgtcggcagttgtgttctgaattgtccccttcgacgaaaagaatgccgggggcctccggcgcttggaatttcatcgacgccgccaacgactcggcatccgaggcggccgtgccgtatttcaaggagatattcgattacgcgcgcacgctcgatccgcagcatcgtcctctgacctacaccaatctgatgatggccgccgcaggcaaagacaagtgccatcaattcgcggatgtcatctgcctgaaccggtattacggctggtatatgcaaggcgggtatcagctcatcggagccaagaaggccttcatcgacgagatgaaccaatggatgaacaccgaacccaacaagccattcctgttcaccgaatacgttgcggacaccgatgccggtgcgcacaagctgccaagcgtgcagtggagtgaggaataccagtgtgagtacctcaccatgcagcacgaagtgttcgacatgttcgaggcagtggtgggcgagcaggtatggaacctctgcgacttccaaaccggtgaaggcatcatgcgcgtcgacggcaacaagaagggcgtcttcactcgcgaccgtcagcccaaagccgccgcctatgtactcaaggagcgttgggagactaagtagcggcccgcccctggaatattccaggagcaacgcacatcgcataacatacaacgcaacatacgaaaaagaacctcgtgaaacgaatttcacgaggttctttctagttacgctgaatgactcccattagactcccacaagagaagagcaatggcggaattccaacgttgctaagctctcaaactcagatgtggaagtagagctcgtactcgagcggggtcggagacaggcgagcctggtcgatctcgtcgcgcttgaggccaatccaggtctcgatcaggtcgtcggtgaacacgtcgccggcggtgaggaagtcgtggtcctcttccagggcgtccatagcctcagccagggagctcggcacctgcttgatgccagcgtgctcttccggcggcagctcgtagaggtccttgtcgaccggctccggaggctcgatgtggttcaggatgccgtccaggccagccatcagctgagcggagaaggccaggaacgggttgcaggacggatccggagcgcggaactcgatgcgcttggcagccggggaggtgccggccagcggaatacggatggcggcagaacggttacgagcggagtacaccaggttgaccggagcctcgaagcccggaaccagacggtggtaggagttcagggacgggttggtgaaggccagcacggaggaggagtgcttgatcagaccgccgatgtaccagcgagccagatcggacaggccagcgtagcccttctcgtcgtagaacagcggcttgccgtccttccacagggactggtggcagtgcataccagtgccgttgtcgccggcgatcggcttcggcatgaaggtcgcagccttgccggccagagcggcggtctcgtggacgacgtacttgtacttcatcaggtcatcgcctgcgtgctgcagggtgttgaagcggtagttgatctcctgctgaccagcgccggccacctcgtggtgggaacgctcgagaatcaggccgaccttctgcaggttggcgaccatatcgtcgcgcagatcctgagtgtggtcaatcggcggaaccgggaagtagcccttcttgacgcggttcttgaaaccgatgttcggggtgccgtcttcctcaacgtcaacaccggagttccacggagcttcgatggagtcgacctcgtagaaggagcggttcatgccgttctcgaaacgcaccttgtcgaagatgaagaactcggcctcaggagcgaaggaggcggtgtcggcgataccggtggacttcaggtaagcctcggccttgccggcaacctgacgcgggtcacgggagtacggctcgtcggtcagcgggtcgacgatggagaaggccacgtcaagggtcttgtgcttgcggaacgggtcaacgaaagcggtctcaacgtccgggaccagcttcatgtcggactcgttgatggcctggaagccctgaacggaggaaccatcgaacggcatgccgtcggtgaaagcgtccttcaggaattcgctagccggcacggtgaagtgctgctgaacgccgataagatcggtgaaacggacggagacatactcgatgccttccttgttgataagggcctcggcgtcttccttggacttgagttcggtcacgggaccgctcctttcgtatgaaatataacggtatctatcgtaaaatcgcgcgtttcgccggctcgaaacttgggttacgagaatgtttcgtgactgtggccgacaatcgcgcaggcgcgttatttcaacgaaacatcattacagaatggaaacggaggctatcgggggagtgggtagaggtgtccgcaacgtggacagtggatattgacaggtgacgtaggtggatgtatgtggacgcgattatgagacatatgacgaagccccggaaccgattgaacggattccggggcttctgtgcgatttggtggtgtgctgccgatcagcgaccgcgcatcgcgcggcgggagatcttctgcgggtggttcgggtccatgcccttggggatggcataacccttcttggcctgcagcgtgcgcagacgatcgttcagcgtttccatctcggccttggtcagcaggaagcgacgacgcggatgaatcttggcgatcagtgcgttcttgtggttcgtgggctcatagctcttggacttggtcaccgtgctacgcagcttgtccagtggcacctgcttggggccgtggcccacggagatgcggtacaccggaatggaggagccggcggtgacgcccttgatatcgtgttcctgacgatccatcgccttcatgatgcgaccgtattcgccttcgccgatcaggtagatgccgttcatcgaagtgccgcgccagatggcatccttggtcttcgggtcgatccacaccggctcctgcgggaagttaaagccggctttctgcatgttgctcagcacgccgatggcggcaccaggcttgccgtcaatctgcttgtagccgactgcatccgcgcggcgggtgagcatcatggtggccagtagcatgccgagcatgatggcggtgatcatggtgaagatccaggtcagccaggtccacttggcaatcagaccgatgatgatcatcacgactacaggcagcaggaaagcaccggcctcaagccacggcagggccttgtcttccttagccgtgtacttgtagatctggatgatctgcttgattgtgctctgcttcttcggcttcgcgtccttttccgccatcacttcttcctttgttgggacgaaacacactagacaacatcttatcaggtgcgctggtccgaacttgtttgtgctggttggtctcagcgtgtgtgtaacggccgtccgtcggccttgagcagcgcctcgccgagcgtttcactgaacgtgggatgcgggtgaacgaggcgggctgcgtcggcgagcggcacatggttgccgaccagctgttcggcttcggcgatgatgtcggaggccatctgggagaccatgtgcacgccgagcacgcgcggggtgtccgggttggccgcgtcgcagccggagacgatggtcagtgaaccggccgtgccgctcatcagcatgcgcgcgttcgccagcatcggatagttggtctccttgatttcaatgagatcctctctcgcctgcgcctgttcgacggtgagcccgaccgacgccgcttcggggaaggagaacacgatttgcggcacggtggcttcgtccaccggcttgggattgagtccggcgatggtctccgcgatgacgatgccttgctcaaaagcacgatgtgccagcgcgtgaccggccgtcacatcgcccaccgcccatacgcccggtttgtcggtgcggccgtacgcatccgtggcgacatgtccgtggtcgtcaatcgtcacgccccatgctgggtcggtgatcgggtcacgcccgatggcgacaagggcgatttcgccccagacgctttgttcgccgtcctggccttcgcacgtgtagtgcacggtggcaccaaggttcgcgccggtgtccacatgggtgacgctggcgcgggtgatgatgttcacgccatgacgtttgagctcacgggtcagcgtggtgccggctctccggtcccaggctgagagcacacggtccttgcgaatcagcaaggtcaccttcgaaccggcggcgttccacatcgaggcgaattcaagggcgatggccccggcgccgataatcaccgccgacgagggaaattcgttgacttccagcgcctgtgtggagtcgatgagggcgccggcgaacgggttgccgggcaatgggcgtggcttggcaccggtggcgatgacgatgttcgtggccgtgaggtccatcgtggggccgctgggctcggggacatcggccttgtgataggtgaggatgtcgctttggtcgggggaagggacgaggtggacgatgtggttggaagttgctggagcggtctcatccgcatggaacgcggcattggctcggaacacggtgatgccgcgatgggcaagcagtccggccagtcctcccaccatcgtcttgaccacgcgcaggcgatagtcgcgcagcgtgccgaagtcgatgccattcaccgaggcgttgacgccgagctcggccgcacggtgcacggtgtcgatggtgtgggtggcggtgatgagcgccttggaggggatgcagccacggttgagacatgtgccgcctacggtggcgtcacgctcgacgagtgccactttcatgccgagttcggcggcgcgcaaggccgtggaatagccgccggggccggccccgatgatgaccagatcaaactgttcgctcatgattgcctccttgatacatataagtatggctcccacgctagggagccatatgcggctatcgccgccacttcgcctaaaaacagtccactggactgttttctttacggctcagcccctcaacgaggggagccagagtatatatggacaatcagtccgccggccagtgaccgcgcttcgggtaacgcggcttgggaagcctccaacgacgcatctgaatcgaacggctccaagcgtaggagaaggagcgggagcccttggacacggaccgttcgccgtacttggcgatgagcttggccttgagcttgcgccacatcagccatacgtcgatgatcacggcaatcaggtaaccgtacataagcgccatcatgatgatggaagcccactggttctgcatcaaagaagtgacgaacatggagacgatcagaatcgcgaaggccaccgggatgaaccattcaccaaggttgaaacgggcatccacataatcacggatgtagatacgccaaggcaagcgttccgccttgggcatgtggttgatatcgccattctgcatcgcctcgtactcggcgttctccttctcacgcagacgggctttggcggccttggcgctggccctgcggtccaccggaaccagcggacggataccggcggcctgagcctgcttcatcttcggggtaggacggccttttttctcagaaggattggcggccttcttcggggcctgctcaacaggagcctggacctcttcttttttcttaaacggattccatgtcatgctttgaggttacggtgacgttcagacacttgtacactggcgcagccattgcaatgacgccgctcacacatatatataaaggaggaccatcatgacaacgctcaccgctgacgagattcgttcgcgcgtcgaaaccgattggaaccgcatcgtcaaggtactggccgaaaaggtcgcgctgcagtcgatctccgccaagggcatcaccgccgaacaaatgaagcgctccgctgaattcgtggcagacgaactgcgcctcgtgggtgtggataccaaggtggttcaggcttccaatgccgacggcactccgggcgcatgggaggtcatcggctcgcatatcgtttctccggacgccctcaccgtgctgctctacgcccatcacgacgtgcagcctgttccggacccggccgagtggaacaccgacccgttcgtggccaccgaaattgacggccgcctctacggccgtggctccgccgatgacggcggcggtatcgccatccattccggtgcactgaaggccctgggcgacgacctcaacgtcaatatcaaagtgttcatcgaaggcgaagaggagatgggctcgccaagcttcattcccttcatcgaggctcaccgcgacgaattcgccgctgacgtgattatcgtggccgattccggcaactggtcggcggacattccttctttgaccacctcgctgcgcggcaacacctgtgtggacgtgaccgtgcagggccttgagcatccggtgcactccggccagtacggcggcccgattctcgactccaatacgttggccgccatgctcatcgcttccatgtatgacgagaacggcgatctggccgtacccggcgtggccgcggaagagccgatcggcggtttgcagcacgaccttgacgaaaccaccgtgcgcaaggattctggcgtggtggccggttacgagttcgccggcaccggttcactggcctcacgcctgtggaccaagccgtccgtgaccgtgatcggcttcgacgcccacccggtcgagggatccttcaacgtgatcgccccggagacccgcttccgtctgtcgctgcgcaccgcgcccacccagcgccctgaagaagcgcaggaagcactggctgcattcctcgaatcccacgcgccgttcggtgccaaggtcactgtcgaacgcggcgaaaacggcatgggctgggccatggacccgaccgccgtggccaccaaggacgcgctggaagccatgaccgaggccttcggcgttgagcccatcaacaagggcgaaggcggctccattccgttcatccccgaactgcagcgcattttccccaacgctcaggtgctggtcaccggtcccgaagacccgaaggccaacgcccacagccccaatgagtccatctccctgcccggcctcaagaacaacgtgatcaccgaggctttgctgctggacaagctcggcaagtagccgaaccgcatcggtaatggtagtgagccgccgtcaggtaggtcacagatgtggctattgcctttgacggcggcttgctttatagtcgggagttgacacgggagctgccgttgggcggctgagaggagactcatagtctcgaccgatggaacgtgaccggataatgccggcgcacggaaatgtcgctcttacctacccgtgcctgaaccaacccgcgcgtggccacgaacatatgcatcatgtgcgtacatatatccacgtatgttcggcctgcgtgcgagcagaagaaaggcacattcatgactgaagctgtggccaaagccaattacaagtggcgcgtcgtcgatatcgtcgtcgccgcaatcatcgccgtcgcatccggcgtcattttctggggctgggacattgtctgctccgccccgctggccctgtttgaaggcgtgacccccggtttcgagggtctgctcaacggattctggctgttcgctggcccgctcgctgcaatcattgtgcgcaagcccggtgccgcactgtttgccgaaaccctcgccgccttccttgagcttacgctgggcaaccagtggggcgtcggcggctcgctgatcgtcggcatcatccagggtctgggtgccgaaattgccttcgccgtcttcgcttggaagaagtggaacatcggcaccaccatcctgtccggtgcgctcgccggcgtgggctgctgggcctactactgggccaccaacccgggctggaacggcctgcgcgtcacttggtatctggtgggctccatcatctccggcgtcgtgatcgccggcgtggtggtctggtacttgtctcgtgcgctcgccgtcaccggtgctctggagcgttttgaatccggccgcagcaaggcgcgcgtctgatgcagattaatccggctgcggtagaggccagcggctggggatggcggcacgccacgcgtaaggacttcgcgttgcgtgccgtcgatttcaccatccggccaggtgaacgtgtgttgctgctcggtgcttcgggcgcgggcaaaagcacgatgatggccggtctcgcaggcgtacttggcggcgatgaggaaggcgagcaggagggctcgctcaccatcgatggcgtcgatgcgcgcgaggcgcgaggtcgcgtgggactggtgcttcaggacccggactcgcagatcattcttgaacgactgggcgatgacgcggccttcggctgcgaaaacctcaacgtgccgcgcgaggagatttggcagcgagtgcgcgaatcattggatatggtgggactcggcggactcgaactggatcggtccacccgccatctgtccggcggtcagcgtcaacgtctcgcgttggccggcgtgctggctatgaagcccggtctgctgttgttggacgaaccgaccgccaacctcgatcccgaaggcgtggtcgaagtgcatgacgcggtcaaaaaggtcatcgaggccaccggacagaccatggttgtggtcgaacatcatatcgatgtatggctcgatctggtcgatcgcgtgattgtgctcggccgacccgatgcaagttcgcccacgggtgcggtcattgccgacggcaagccggacgaggtgttcgccgagatgggcgacgtgttggccgccggtggcgcgtgggtgccgggccgtgcgattcccgattactcaccgaagcaggagtctgcgcacgatgcgccggtgctcagcaccgagaacttaagctttggccgtggggccgctcttggcgttggtatcaatctggatttttatcccggcgaagtaacggctctgatgggtccgaacggcgcgggcaaatcgaccttggccttgaccttggccgggctactcaagcctatcgccggcaaggtgctcatcgccgacaacctcaagcccgcgcatgccgggcgtgagccgatcgactggaaaagcaaggaactgctgggccgtatcggcatggtgttccaggagcccgaacaccagttcgctgccaactttgtgcgtgacgaggtatccatcggccccaagtcgatggggcagagccaagacgaggcttatcagaccgccgaccgcatgcttgagcagatgaatctcacgcgcttcgccaaagccaacccgtacaccttgtctggcggggagaagcggcgactgtccgtggcctccatgctggccgccgcacccaaagtgttggtgatggacgagccgacattcggacaggatttcagtacgtggaatgaaatggtcaagctgatcgccgccatccgcgaccaaggctcgtgcgtgatcatggtgacgcacgatgaggcgctggtggatgcgctgggcgcacgacgtgtgatgttcgaggaggcgaaggcatgagtgacgtggtaaccgtcagcccgcaggaaacgcgcgtggagccggtcaaagcctcatcgccctcatggttcatcgcgcgcatcaacgcggtcagtcgcatcatcggtgcgctgttgctgtgcattccgatgttcatcagtctggatgcggtatccgcatccacggcgctcggcatcgaattcgtgctgctgtggattggtggcgtggctccgtggaccgtatgccgtaagacctggccggtatggatcgccgccgccggcagttttatctccgtgttcctctacggccgcacctcgggcgagatcctgtggcagggtggctggattgtgatcagcgagggatccatcaatctggccatcgccacggctatcagggtggcggccattgccgtacccggcgtgattctggccttgggcctcgatcccactgatttggcggacggtctggttgagattctgcacttctcaccgcgattcgtatacggcggattggccggattgcgcatgtttacgctgctgcaggaagattggcgcgcactcggcttgtcccagcgttcgcgcggccttggtgacggcaacgccatcgcccgtgccctctcccaagcgttcggactgctggtgctctccatccggcgtgccaccaaacttgccaccgccatggaagcgcgcggcttcggctccggcgccccacgttcccaagcccgcatctcgcgtctgaagcctatcgactggatcttctacgtcatctgtctggccgtcccgctggcctccataggcgtagccgtcggcaccgggaattggcacttcgcctttcagggtgtctgaaaggcggcagactggcacagtgcctttcagggtgtctgaaaggcgacagattagcacagtgcctttcaaggtgtctgaacgccttatgatgcccccgctggcgggggctgtcggcgtagccgactggggtggttccagcctcgaccaccctcagtctcgcgactgacgtaatgacccggcagtagggtagtggctatgcccatcaacgcccagattcttgataatccgaaatccgaccgcgtgcgccgcatcgccgatctgacccgcgccaaaggccgcgaacgttcgggccgttttcttatcgaaggcccgcaatccgtgcgcgaggccgtcacttggcggccggacgtggtgcaggacctgtatgtagaggtttcgcaggcgctggaacatccgcgtatcatctcctccacgttggagaagatcgtcgaaacctcgcaggatgccacgatttatgtgcactactgcaccggcgacgtgatgcgccgcatcagtccggacgcccaaggcatcgcggccgtcggcaatgccgagtccatgcacgccggagccgatgacgtcgaacttggcaagaacggtcgggccccgcagattgccgccttctggcaggtgcgcgacccgggcaacgccggcaccgtgatccgtgcggccgatgcggccggctgcgacgccgtaatcttcgtggacgactgcgtggacgtgctgaaccccaaggtcatccgctccaccgcaggctccctgttccatctgccggtactcgccatgagcaccgacgaattcttcacctggacaggcgaccataatatggacgtctgggccgccgacgtatacggcaccgaagaacgcaagccggaaagcctgcccgcagtactggcggacaaggcggcggtcgaggctccgaaagccgtgctgttcggcaatgaggcgcgtggcttggaaccggacatcctcacgcgctgcggccgcatcgtctccatcccgctttatggcaaggccgaatcgctgaacctcggcacctcggccgcggtgatgctgatgtcgctgtctatgtcgggtcatgttgaaagaatgtgaaaccggtaaaaacgctgtgaaacgctgagaaaacatcagacgaaagggttctcgtggcagaacaaatggtgttcgacgccgaccaggtgaccgctgaggttgccgagggcatcgagaaaatccagaacgcctccaacctggaggagctcaaggccatcaagacaacgtacgcaggtgccgattcggcgatgaccaaggccagcaaggccattggctccctgcccgccgaccagaagaaggaagccggcaagctcatgggcaagctgcgcgccgacttcggccgcgcctatggtcccaaggaggtcgagctcaaggaagccgccgagaaggccgcgcttgccgccgaaaccgtggatatgacgctgccggtgagccgtaagcctctgggcgcccgtcacccgctgcctaagctgatggaggacgtcgaggacttcttcatctccatgggctggcagatctcctccggcccggaaatcgaagccgaatggtacaacttcgactccctgaatttcggcccggaccatccggcccgccagatgcaggacaccttctacgtcaagggcaatcaagccaaggacgccgccggtttcgtcggctccaacatggtggtgcgtacgcagacctcctccgatcaggtccgtgccctcctgacccgtggagtgccgctgtacatcgcgtccccgggccgcgtgttccgcaccgatgagctggacgccacccatactccggtgttccaccagtgcgaagccctcgccgtcgacaagcacctgaccatggccgacctgaagggcgtgctggacaagctcgccgtcgccatgttcggccctgaagccaagacgcgcctgcgcccgagctacttcccgttcactgagccgagcgccgaactcgacctgtggttccccgacaagaagggcggccccggctggctcgagtggggcggctgcggcatggtgaacccgaacgtgctgaagtccgccggcatcgacccggacgtctacaccggtttcgccttcggcgtcggcatggagcgcacgctcctgctgcgcagcgacatcaacgacatgcacgacctggtcgaaggtgacgtgcgtttcgccgaacagtttgtgatgggggagtgattcagccatgcctatgatcgatatcgattggctcaaggaccatgtcgaggttcccgaaggcctgacctacgaacagctcgccaagggccttgtcaaggtgggtcttgaggaagaggagattcactcctctcaggtgaccggcccgattgtggtcggctacgtggtcgacgccacccccgaaccgcagaagaacggcaagaccatcaactggtgccacgtggactgcggcgacgaatggaacgagaccgacgaagacggcaacaaggtgccgcgcggcatcatctgcggcgcgcccaacatgaaggccggcgaaaaggtcgtcgtcaccctgcccggtgccgtgctgcccggcgacttcaagatcgaaccgcgcaagacctacggccacatctccaacggcatgtgtgcctccgaacgtgagctgggtctgggcgacaaccacaatggcatcatcctgctgcgtcagtatggcttctccgaggctgaatacgaggctctgaagcctggtcaggacgccatgcacctgctgcacctcgaccagcctctgcttgagatcaacatcaccccggaccgtggctacacgctgtcctaccgtggcgtggcccgcgaataccaccactccaccggtgccgcctacaccgatccggccgtggcactcaacgagaaggccccggaacctgctgactaccagcccggcaccccggtggacatcgatgttgaaatcgacgataacaatccgattcacggcgtgcccggttgcgaccgctactacgcgcgtatcgtcaaggacttcaatcccaacgcccacacgcccaactggatgcgccgccgcctgatccgcgccggcatgcgctccatctccttggccgtggacgtgaccaactacgtgatgcttgacctcggccagccgatgcacgcctacgacctcgacaagctcgaaggcccgattgtcgtgcgccgcgccaacgagggtgagaaactcaccaccctggacggcaaggaacatgacctgagcgtcgaagatctgcttatcaccgattcgccgaacggcgaacgcggctcgcgcatcctcggccttgccggtgtgatgggcggcctgtatggcgaagtgaccgccgacaccaagaacattcttctggaggccgcgcacttcgatcaggtgaccatcgcccgttcggcccgtcgccacaagattccatccgaggcctcccgccgcttcgaacgtggcgtcgacaccgcgctgcagcctgccgccacccagatggccgccgaactcatggccaagtacggcaacggcgagcccagcgaacacccgaacgacgtgaacaacacgccgcgcgccaaggccatccacttcaaggcctccgaagtggcccgcgtagccggcctcgacgtggacatcaaccgcatctccgacatcctgaccgacattggctgcacggtggccggtggcggcaacggtgagttcgccgtaaccgcgccgagctggcgtccggacttgaacgagccgtgcgacctggtcgaggagatcgcccgactggtcggctacgaccagattccgatcaccgtgccgccggcaccggtcgagggtctggtgggcctgaccccggaccagcagcgtcgccgtcgcgtggcggacgagctcgccgagttcggcatggtcgaatcgctgagctacccgttcgtgggtgacgacgattacaaggccttcggcttcgacccggaagccaccaagaaggtcagcgtcgagatcgccaacccgctctacggcgaccgtccgtacctgcgtcgcgagattctgccgaccctggccaccaccgtgcagcgcaacatccgccgcggcatcgaaaacgtgtccctgtacgagctcggccacgtctacctgtgggatccgaacgcgcccgtcatcccggcactgcccggcggcgtgcgccccaccgacgaacagctcgccgcgcttgacgccggtctgcccgaacagcccgaccatgtggccggcatcctgaccggtctggccgaggacgacggctggatgggcggcaagcgcccggtcgactggtccgacgccgtcgaggccgtgcgccgcatcgccggccgtatcggtgccgcaatcgaactcgaccagcccgccgccgacgatgtgccagtccaatggcaccccggccgcgccgcccgcgtcatggtgggcgacgtcttcaccggctgggttggtgaactgcacccgcgcgtcaacgaggcgctcggcttcccggcccattccgcggccttcgagctgaacctcaccgcgctgttcgccacgctgaccggcaagcccgtccaggccaagccgatctccacgttcccgccggtcaagcaggatttggccttcaccgtggacgagaccgtgaccgcaggccagcttgagaacgtgattcgcaaggccgccggcgcgaacctcgaatccatcgaactgttcgacgtgttcaccggcgaacaggtgggcgagggcaagaagtccctggcctatgcggtggtgttccgttcaccgagcaagacgctgtccgccgaagacagcgacgccatccgcaaggccatcgtggctgaggccgccgaaatcggcgcccagctgcgcgcctgacccaaccaatcatccgaatcgaggagcgccatgagccaagcggagcaggacaagccgaaatacgggcagtaccagcagcctgaatatggtgctatgtctggccaatacgggccgaattacaacccgtatatttatggcgctcccgagccggatactaagaaggattccgccgcagccgctggcgataacggtggcgcggcacaatctcagcaggctggccagccgtatggtcagcagccggcgtggcccggcaatcagcaggcgggcggctggccgtacgctcaaggcggccaacagtccggtccgggcgcatatccgggcgggtacccgggcatgcagggccagccgtatggtcaacagccgaacggtcagcctcaccagccgcattattaccacggcatcgacctgaacgatccaaaccagaacccactctacgggcactgggattcgtatgcgatcatctcctttatcctcgccctgttcttcccggtgccagtgctctcggcactgatgggcgcggtggcaatgtggcgcacgcgcactttccatatgaagggcttcggtttggccgtggccgccgtggtaatcaacgtgctgtacaccatcgccgtcatctggatggccttcaatggctatgacgccatgagcctttaccaggaagccctccagcaactgaccggcggcaccggctcctcctccgactccatctccgcataagtagcgttcacataccaacacacccactgcataaatatgcaatagtctgcataatcgcgtatactcatccgaagacacatcagtgaaaagagatgagtatggcgaaatatacagtggccgtggccggtgccacgggctatgccggcggtgaagcgctgcgcattctggccgcgcaccccgacttcgacatcacctgcgtggcaggccattcctcagtgggggagtcgatggccaagcacatgccgcatattccccaactggccaatctggtcgttgaagataccacgcccgaagtgctgaacgggcatgacgttatcatcctcgcactgccgcacggtgcttcgggcaagctcgcctcgcagctcgatccgaatgccgtggttgtggatttgggcgccgaccatcgcctcgaagaacaggccgcttgggatgagttctacggcggcgatttctatgagcattggacctacggcatgcccgagctcatcaccggcaaagctgcggacggctcctacacccgccagcgtgcggcgcttcctggcaccaagcgcatcgcaggtcctggctgcaacgtcaccgccaccacgctggccctccagcccggcatcgccgaaggactggttgaatcgcaggatatcgtggccgatctggtcgtcggatactcgggtgccggcaagaatctcaagcgcaccaacctgcttgccgccgaggccctgcaatccgccctgccgtattcggtgggcggcaagcaccgccacattcccgaaatcctgcagaacttcgcccacgcggccggcaagagcgcggccgaagccagcgaattcacgctcggcttcacaccgattctcgcccccatgtcccgaggtatcctcgccaccgtgtccgcccgcatgacggacaaggccaagacactgagcgatgaggagattcgcgccgtatggtccaaggcctatgaaggtcaggacttcatggtgctgctgcccgagggcacgctgcccgccaccggcaacatcatcggatccaacgcagcccacctgcaggtcgtcaccgaccgcaaggccggccgcatctacgcttttgccgccatcgacaatctcaaccgtggtaccgccggacaagcggtccaatcactgaacatcgcactaggcctgccggaagacgcgggcctgaccaagatcggagtagcaccgtgagcgttacatttgcacaaggtttctccgccgccggcgtggcggctggtatttcatccgtcgaaggcaagaaggacttggccctcgtggtcaacaacggcccgctcgacgcggctgcaggcgtgttcacctcgaaccgtttctgtgccgccccggtgcagtggagccgtaaggtcgtcgccgacggtcacgtcaaggccgtgattctgaactccggcggtgccaacgcctgcaccggcgaggccggttacgcccagtccgtcgccaccgcggaaacggtcgccgggctcatcggcgccgaaccgaatgatgtggctgtctgctccaccggtctcatcggtgaactgctgccgttggacaacgtgctggctggtgccaagagtgcccatgaggctcttgccgccaccgccgaagccggcaccgacgcctcccacgccatcatgaccaccgacaccaagccgaagacggtcgaactgaccggctccaacggctggaagatcggcggcatggtcaagggctcgggcatgattgccccgcagctggccaccatgctgtgcgtcatcaccaccgatgcggttgtctccgccggtcagatgcaggccgcactcgctgtggctgccgaacattcgttcaaccgcatcgacgtggacggctgcatgtccaccaacgacacggtcctgctgctcgcctccggtgcctctggcgtcgaaccggacaaggacgaattcaacaagctggtgcgtgaggcctgcgcatccctgtcccgccagatcatcggcgacggcgaaggtgcctcccacgacatccgtatcaccgtcaccggtgccaccagcgaagacgcggcacttgcctgtggtcgtgccgtcgccgcctcgaacctgctcaagtgcgccatctccggcaacgatccgaactggggccgcatcgtcagctccctgggcactgtgccacctgaagtcgcgccttacgattcgaacaaggtgaccgtggacgtcaacggcgtgcgcatctgcgagaacggcggtgccggccgcgaccgtagcgaggtcgacatgaccccgcgcgaagtccacattgacatcgacctgaacaccggctcggacgccgaggccaccgtctggaccgacgatctcacccacgaatacgtccacatcaacgccgactacgaaagctgacaaacagcccagtgggctgtttgtagcagccggcagcgatagcgtcgccggcgtcgcatataacgcaaacagcccagtgggctgtttgtagcagccggcagcgatagcgtcgccggcgtcgcagaaaagagaaaaattgtctacagaattgaagggacctgggttccatttcgacgtgcacaccgatttgcgcgccgatcagaaggcagaagtgcttattgaagcgctgccatggctggaggagttcgccggccagcgtatcgtcgtcaaatacggcggcaatgccatggtcgatgaccatctgaagcagtgcttcgccgaagacatggtctttctgcgtcaggtgggtctgcacccgattgtcgtgcacggcggcggcccgcagatttcccacatgctcaaggccctcggcatcaaatccgaattcaagggcggcctgagggtcaccacccccgaggccatggatgtggtgcgcatggttctgaccggcaaggtttcacgcgaactggtaggcctgatcaacgcgcacggcccgctggccgtaggtctgtccggtgaagacggcggcctgttctcggccatgcagcgcaggcccatcatcgatggcaagtccaccgatatcggcctggtcggcgacgtggtttccgtcgatgcttcggcagtcgaggatctggtggccgccggtcgtatcccggtcgtctcttccgtggctccgaacgaagaagatgccactgaagtgctcaacgtgaacgccgattccgctgccgccgctttggctgccgctgtgggcgcacacaagctcgttatcttgaccgatgtggatggtctgtacgccgattggccggacaagaattctctgattggccggatcggtgtggaaaccctgcgcgatatgctgccggacctggaatccggtatgcgacccaagatggaggcctgtgtcagggccatcgacggtggcgtgccccaagcccatatcatcgatgggcgcaagccgcattcgattttgaacgagatattcacctccgcaggcatcggtaccatggttatgcctgatgaaggactggaaatgaggagctcttatggctactgagcatgaggaaaaactaggtacggaagacagcaagtggctgggagagtactctcaggtccacatgaatgtgttcggtacgccgctgcgcgtcatggatcacggccaaggtgcccacatctgggatgttgacggtaacgaatacctcgatttcctggcaggcatcgccgtcaattccctcggatacgcccaccccaagtgggtcaaggcggttgccgatcaggctgccaaggtggctcatatcagcaactatttcgcgtccgagccgcaaattgaattggcatcaaaactggtcaagctggctggtgcacctgaaggctccaaagtctacttcggcaactccggtgctgaaggcaatgaagctgccctcaagctcgccaagctgtatggacgcaccttgcctggtgccctgccttccatcggcggcaagcccgcacgcattctcgcaatgactcacggcttccatggccgtacgatgggtgcgctgtccgccacatggaaacccggtatccgcaagccgtatgatccgctggtgccgaacatcgaattcgtacgcgccggcgacaaggtcgccctgcacgacgcttttgcacagaccggtctcggtcgctatggcaagggtccggtggctgctgtgattctggaacttatccagggcgaagccggcgtgcagccgttgggcgccgattacgtcaagttcgtgcgcgaactgtgcgatatcaaccacgcgctgcttatcatcgatgaagtacagaccggtatcggacgtaccggcaagtggtttgcattccagcgtgacgatctgtccggcggcgtgacgccggatatggtgactttcgccaagggtgtggcaggcggattcccgatgggcggcatgatcgctttcggcgagaaacttgcggctctgttcactcctggttcccacggctccacctttgccggcaatccgctgggtgcggctgcgggactcgccactcttgacgtgattgaagacgagaatctggtggccaacgccgaagctcgcggcgaacagctgcgcgatggcattatggccaccggtaatccgctgttcgtttccgtacgcggccgtggtttgctggacgccgtcgagctcaagcatccctgctcccacgcggtgatgaactactgcctcgaacacgggctcatcgtcaacgcggtggctcccaatgcgctgcgtttcgcaccgccgctgattgtaaccgcacaagacgtggaccaggcacttgccatcctcaaggatgtgcctacggacctgcccgacgactgatttctctctgtcactgccgacccaccgatccaaggagatcatcatgaccccagaacttcgccacatgctgcgtgacgacgacctcaaccatgaggaacagaagcaggtgctcgaacttgccatcaagttccaccacgaccgcttctacaagcagccgttcgccggtccgcaggccgtcgccgtactgttcgacaagccctccacccgcacccgttccagcttctccatcggcgttgccgagcttggcggctacccgctggtcatcgacaagtccggctcccagctgggccgtggcgagcccgtggccgataccgctcgtgtgctcaaccgcatggcttacggtgtggtgtggcgcaccttcggccagggccgcgtcgaagaaatggccaagtactccacccatccggtggtcaacgccctgaccgatgacttccatccctgccagattctcgccgacttccagaccatcgccgagcaccgaggcggcgtcgacaacctgaagaaccagaccatcgcctacctcggtgacgcggccaacaacatggccaactcctacctgctcggcggtgccgtggccggcatggacgtgcgcgtggccggcccctacggctacctgccccgcccggacatcgtggccgacgccaagcgcgtcgcggccgagaccggcggctccatcctggtcaccaccgatgccaaggaagcggtgaaggacgctgattgcgtgttcaccgacacctgggtctccatgggcgaggaggccgaatacgccatccgttccaagccgttctgggattaccaggtcaacaccgaacttatggcattggccaagccggatgcgctcttccagcactgtctgcccgcctaccgcggcaaggaagtcaccgctgaagtgatcgacggcccgcagtccgtggtgtgggacgaggccgagaaccgtctgcacgcacagaaagcgttgctgacttggttgaccggcaaggcccgtggagacgaaagcctgctcgcatgagtgaaaccggtccgtccctgcagcgccctgccaccagggcggcgcggctgagtgccatagaacaggcgctcgccacgcatatcatcacctcgcaatcacagctgtccaaaatccttatcgacgagggcattgcggtgactcaggcgaccctgagccgcgatcttgacgagatgcatgcggtgaagacccggctgaaggacggcacggtggcctacacggtgggtcgcagcgtcgttgcttcggaaggtgaggatgtaggggagcgcggtgaggcacagatgtcccgcgtgctgaacggactggtcacctcggtggctgccgccggaaatctggttgtggtgcacacgccttccggtgccgcacaatacgtggcctcggtgattgacaagcagccgatcgaaggcgtgctgggcaccatcgccggagacgacaccgtcatggtgatttgcaccaatgacgacaccgccgtctcccgctccgactggctactaagtctcgcttccaaataaccaacacgccgtgcataaatatacagtcctctgtatatacttgcatcagtttgtttttcagaccttgaacgaaagggaaccaatggcagataacaagcgcattgttctggcctactccggcggtcttgacacctccgtcgccatctcgtacctgaaggagcgcaccggcaaggacgtcgtggccgtgtccctcgacgtcggccagggcggcgaaagcctcgagaccatcaagcagcgcgcccttgcctgcggagccgtcgaatcctacgtggtcgacgcccgtgacgagttcgccaacgaatattgcatgaaggccctcaaggccaacgccatgtacgaaggcgtctacccgctggtctccgccatctcccgtccgctgatctccaagcacctcgtgcgcgccgcccaccagttcggtgccgacaccatctcccacggttgcaccggcaagggtaacgaccaggttcgtttcgaggtctccattgcctccatcgacccgacgctgaaggccatcagcccgattcgcgacctgtccctgacccgcgacgtcgagattgcgttcgccaaggagcacaagctgccgatcacccagaccgagaagtccccgtactccatcgaccagaacgtgtggggccgcgccattgagaccggcttccttgaggatccgtggaacggcccgaccaaggactgctactcctacaccgacgacccggccttcccgccggtcgaagatgaagtcgtcatcgagttcaaggaaggcgtgccggtcaagatcgacggacgtgacgtcactccgctgcaggccatcgaagagatgaaccgccgcgccggagcccagggcgtcggccgcatcgacctcatcgaggaccgcctggtcggcatcaagtcccgcgagctgtacgaggccccgggggccgtggccctgattaccgctcatcaggagcttgagaactgctgcctcgaacgcgaacagcaccgcatcaagcgcgacatcgacaagcgctggggcgagttggtctacgatgcgcagtggttctccccggcgactcagtcgctcaacgcgttcatcgaggacacccagaagtacgtgtccggtgagattcgcatggtcctgcacggcggtcgcgccgtcgtgaccggccgtcgttccgactcctcgctgtacgactacaagctcgccacctatgattccggcgataccttcgaccagaagtcctccaacggcttcatcgacatctacggcctgccgtcccgcgtggccgcagcgcgcgacgtcaagttcggcaacggcatcgaggtcccggagaacaccgtcgagtaatcatttactttggctcccctcgttgaggggccgcgccgtaaagcaaacagcccagtgggctgtttgcaggtgaggtgcgaacgacagtgagccaacaatcagcagccgtcaggctgtccgtaattacaggacgctgtcgccgcagatgactgaggggagtacgagcaaagattatgctcgtgctcccctcgtttttttgccgatgacggaagaagctcagtgctctccgtaatgagttcggcagacggctatttccaggttttgaacatcgttacccgtaatgcggtatacgatgcggttcttttcatcaatacgacgtgaccagtatccctgacattgccgccatggaatacgaacaacttgaatccaccggtatgtagcccaacgctgatagtctgacaagcagtctgatttgtttgcaatccatggtttcaaggagccttcatgactgagaacaacgaacatctggccctgtggggtggtcgctttacgtctggtccgtcgccggaattggcccgactgtccaagtccacgcagttcgactggcgcttggccgacgacgacatcgccggttcccgcgcccacgcccgtgctctcggccgtgcgggacttctgaccgccgacgagctgcagcgcatggaggatgcgctcgacacgctccagcgccacgttgacgatggctccttcgcccccatcgaagacgatgaggacgaggccaccgccctcgaacgcggtctgattgacattgccggcgatgaactcggcggcaagctcagggccggccgttcccgcaacgaccagatcgcctgcctgattcgcatgtggttgcgccgtcactcccgcgtaatcgccggactcctgcttgacctcgtcaacgccctgatcgagcagagcgaaaaggccggccgcaccgtgatgccgggccgcacccacatgcagcacgcccagcccgtgctgctcgcgcaccagctcatggcccacgcttggccgctgattcgcgacgtgcagcgactgatcgactgggacaagcgcatcaacgcctccccgtacggctccggcgcactggccggcaacacgctcggcctcgacccggaggccgtggcgcgtgagctcggcttctcccgcgtgaccgacaactccatcgatggcaccgccgcacgtgatctcgtggccgaattcgcgttcgtggccgccatgaccggcgtggacatctcccgcctgtccgaggagatcatcatctggaacacccaggagttcgccttcgtcaagctcgacgacggctattccaccggctcctccatcatgccgcagaagaagaacccggatatcgccgagctcgcccgcggcaagtccggccgactcatcggcgatctgaccggcctgctggccaccctgaagggcctgcccaccgcctacgctcgcgatctgcaggaagacaaggaggccgtgttcgaccaggtcgatacgctcgaagtgctgctgcccgccttcaccggcatggtcaggaccatgcacttcgacggcgaccgcctggaagaggaagctccgaccggcttcgcgctggccaccgacatcgccgaatggctcgtcaagaacggggtgccgttccgccacgcgcacgagctctctggtgcctgcgtcaagctcgccgaaggccgcggccaggaactgtgggatctgaccgacaatgacttcatcgagaccttcgccgcgttcctgccggccgacaaggctccgggagtacgcgaagtgctctccagccacggttcggtcgactcccgcaacggcaagggcggcaccgcttacggtcgcgtgcgcgagcagatcgccgacgccaaggccgaggtcgaagaactcaagctcttccccgcatccacgtcggatggctccgcctacaaagcccccggcacgttctagtcccaatgaagctccctctgatgagggagctctattttgttgttgtcactgcaacggcatacactgagaaaccgtaacgaacgggagccgtgaggctgagaggaagtcgccagacttcgaccggggaacttgacgcgggtcatgccgccgtaaggaatcgttgtcgcagatttgccgggttctccgatacagctttcattccgtttgcataattcagccgtgagacggtcgtgatggagccaatacatcacagcggtcgaacggtcgcatgattgggttcatgaatgggcgcaccacttaaggtacggttcgtttcgtgcacccttttttactatctgaaaggatattatgcaggtcaacggagagcaggtcacgctcgagacgccggtcagcgtcgccgattatctcgaagcgcacggattccgcgccgagcgtgtggccatcgaactcaatggtgagattatcccgcgcgataagcgtgccgacgccatgctcgacgaccagtgcgtcatggaaattgtgcagtttgtacagggtggatgaaaggaaaagctatgagcaatattaatccggttactgaagcatctgttgaggcgactccgctgccgccgcagcccgccgtcaccaatccggtcggcaccgccgcgccgattctcccggtggaagacaagccgctgaacctgggcggtcacgagttccagtcgcgattcattctgggctccggccgctacgacctgaacctcatcaaggctacggtcgaacatgcaggcacgcaaatcgtcaccatggcactgcgccgcgcgcagaccaccgagaacagcgtgctcgactacattcccgaaggcattacgctgctgcccaacacctccggtgcgcgcaacgccgaggaagccgtgcgtatcgcccgactggcacgcgaagtgtgccacaccgacttcgtcaaggtcgaaatcgaacacgagaccaagtacctcttgccggacaacgccgaaaccatccgagccaccgaaatgctggccaaggaaggcttcgtggtcatgccctacatgttcccggacccgattgcggcccgtcagctggaggaggccggtgccgctgccgttatgccgctcggttcgttgatcggctccaatatgggcctgcgcatgcgtgacttcatcgaaatcatcatcgccaacgcgcatgtgccggtcatcatcgacgctggtatcggccgtccgagccaggcctgcgatgcgatggagatgggtgcggatgcggtgatggcgtacacggccgttgcctctgctggcaatatcccgctgatggctgaggcgttcaagcacgccatcgatgctggtcgtgcggcgtatttgtctggccttggcaaagtgaccgagggacaggctgtgccgtccagcccgactacggggtatttgcactgacacttttattagctcccctctctgaggggagctggccgcgtagcggactgaggggagatggaaacatggagaaaacatggcattgactgatgaacaggtggagcggtacgcgcgccatctgattttgaagggtgtgggggtcaaagggcaaaagcggttgctggcctccagcgtgctcatcatcggagcgggcggtcttggttctccggccgccctgtatctggcggcggccggcgtcggccatatcggactggtggacggcgatgtggtggatatgagcaatctgcaacgccaaatcatccataccactgcacgtgtcggagcgcccaaagtggaatccgcggccacagccatccgcgcgctcaacccggatgtgacggttgatacctactacgagctcgtcgacgcgagcaacatcgccggcctcatcgaaccgtacgatctggtgatcgatgccaccgacaacttcgccgcaaaattcctcatcaatgacgcctgcgtgctggccggcaagccgtatatccatgccggcgtggtcggattcgccggtcaggtgatgaccgtcattcccggcgaaggcccctgctaccgctgcatcttccgcgacctgcccgccgccggtgagattccgacctgcaaggaagccggcgtactgggcgcggtggtcggcgtgatcggcagtctggaggcgactgaggccgtcaagctgattgccggcgtgggggagccgctcgtggctcgcatgctcactgtggatgccctgaccatgaatattcgacgggtcccactgccaaagcatgtgccggattgcccggtgtgcggtgagcagccgaccattactgctattgatccggccaactatattcagccggcctgcgcgatttagagctatgtggtgcccctccttgaggggtgccaagatcagaacgagaggggaagaacatgcctattgctttgcataatgcggtcgatgacgatgagagcagtgaagcatcgtaccgccgcatcacgccggcggaatttgccaagctcgacccgaatacggtcacgctgctcgacttgagggaaccagccgacttcgccgcccacccggtcgaaggtgccatcaatgcaccactcgaccctctggcccatgtgctcaaaaccgtgcccacagatcgaactgtcgtagtctattgtgctcaaggatggtggagcgaggaagtagctgaaatccttgccgatcgcggctacgatgtagcaagcctcgatggcggttttcaaggttatctcgactatcttgaaacccaccacgattaacggttcccgttgtcgttcttttggatgagtgtgcacggacatatttgtgccctacaatcggtcacggtattactcgatggattcttgaatatcgccgggtaatcgtaattcacaacaggggattgcactgaaccaacccaaaacgggaaggaccgaaaatcgtgggacatctgctcacccgaacgcagattcaacgcctggtcgccaagcacggccgtgaggtcatcgagcatcgccacatgcagatcgaacgctgctgctaccagcacggcaatgtcaccacgttcgaacattccgtgcgtgtcgcctgcctggctgtgtggatggccgaccgcgcacacctgtggtaccgcgtcgacctcaaatccctgattcgcgcggccctcctgcacgattacttcctgtacgactggcacgactgggataacggcgaacaccagtggcatggcttcacccatggccacgccgccctggtcaatgccctgaaggacttcaagctcaacgatatcgaacgcaacagcatcgagaaccacatgttcccgatgaccccggtgccgccgcgctatatcgaaggctatctggtcaccttggcggacaaatgctccgccaccgccgagaccttctcgttcgaccggttcaacaagcgcgcgttgcccgccgcgaagccttacgccgagatcgaagcccgtcgatgatcatcacactcgaacattatttcctctggtttctgttctacagtttcgtcggctggatgtacgagtccattctcgtctcctgccaacagcaccgcttggtcaaccgagggttcctcaacggcccgctgtgcccgatctacggcaccggcgcgatactcggcgtcgccattctcggcaacgtacataacccgatcatcatcttcctgatttcgatggtgggcgccacgatactcgaatacacaacctcgtgggtcatggagcagctgttccacgcccgctggtgggattactcgaacttccgcttcaacctccaaggccgcgtctgcctgctgggcgcgttgattttcggcctcggcggcgtgggcgtggtacttggttcgcagccatatgtcgagcgggtcacggatatgattccgctgccgatgctgcatacgctggtcacggtactggccctgatcaccatcatcgacttggcggtcacggttgcgggcatgctcgaattcgagcgggtgctcgattccgtctctcaggtggtgcaggatgtggcggcacgcgccggtggcacgtggcagtggggctccagtgcggtatccgacaggatgcgtgagctttcgcaggatacggttgagcgtctgcgctgggccgtcaatggcgtcatcaacgcacagcagaagcgtatgctcaagtccttcccgaagttccaggtgccggatcgtcaggacatcatcgactctttgcgcgaacttatgggcccgcgccgctagaataaggcgttttactgaatcgcgcggctcggctggtgttcggcactgtcgccatgttctgcgaaacttgactgtgcccaattgggcagtcttattcacaattcgatagggagaagcgacaagctatggctcacgtcaccgacttcaaggaagcgggtttcaacaccctgcttgaggaactggaatggcgcgggttgatttcccagtccacggaccgggatcgactcgcagaagcactgaacggcgagcccatcacctattattgtggcttcgatcccaccgctgcatcgttgcatatcggcaacctcgtgcagctcatcaacatgcgtcacctgcagcttgcgggccatcatccgatcgctttggtcggtggcgccaccggactcatcggcgacccgcgccagtccggcgaacgtacgcttaacccgaaggacgtggtggccggctgggccgatcgcctgaagaatcagatcggcggcattctggacaccgaaggcgcgaacgccgtacgtttcgtgtccaattacgattggaccgcctcgatgaccgtcatcgacttcctgcgtgacgtcggcaagaacttccgtctgggcaccatgctcgccaaggacacggtcgcccgccgcctgaactctgaggaaggcatctccttcaccgagttcagctaccaggtgctgcagggcaacgacttcctccacctgtttgacgaataccactgcacgctggaactcggcggctccgaccagtggggcaacctcacctccggcctggacctaatccacaaggtgcgcggtgtggacgtcaacgtgttcaccagcccgattatcaccgatgcttccggcaagaagttcggcaagtccgagggcaacgccgtctggctcgacgccacgatgctcagcccgtacaagttctaccagttctggatcaaccgcccggacgtggagatggaaagcctgctgaaggcgttcaccttcctgcccaaggccgaaatcgaacgactggtcgaggaatccaagaccaaccccggcaagcgcgaggcccagaagacccttgcctgggaggtcaccagcttcgtgcatggcgaggccgctacccaggctgccatcgatgcttccggtgcgctgttcggccgcggtggcaacctcgaagacatcgacgaggaaacgctggaatccgtgctcgacggtttcaaggtggtcgacgagaacggcgagcacgtcttccccgtctccaagcccggcgatcgcgtaatcgacgccgcccaggctgccggactgttcaagtccgcttccgaggcacgccgcgccatcaagtccggtggcgtgtatctcaacaacaaccgtatcgaggatgaggagcaggtgctggccgaagccgacttcctggcaggccgcttcgcgcttatccgtcgtggcaagaaggcgctcggcgccgtggaaaaccgttaatcaacaacgaattaaggaaaacaagtaatggcagaaggtaacgagcgttccggcaagtcttacggcggcggccataaggggtatggcgatcgccgaccgggcaaccgcggcggcaagggtttcaagccgcgcggcaagggcggtttcaagccgcgtcatgatggtgagggtttcaagccgcgtcgccgtgaggatggcgagggctacgcgccgcgccgtgacggtgatggcgagggccacggcggctaccgcaagtcgtacggcaagtccggcggcttccacaagggcggccgctccggcttcggcggcaagggcggttaccgcggcaatggtccgcgccgtgacggcgaaggcttcaagccgcgccgcgaaggcggctaccgttcccacgaaggcgagaacggcgagaatccgcgctaccagcaccgtgataacgatcgtcgtgatttccgccgcgatggtgagcgtcgcagcttccgccgcaacgacgaccgccgagatttccgtagggacgaccgtcgcgatggggaccgtcgtgacttccgtcgtgacaatgaccgtcgtgacttccgtcgcgatgaccgcagggataacgatcgtcgtgatttccgccgcgatggtgagcgtcgcaacttccgtcgcgacgacgatcgccgtgatggcgaccgccgcaacttccgcagggacgaccgccgcgatgatcgtcgtgacttccgccgtgacgatcgccgcgacaacaaccgtcgtgacggcgaattccgcgagttttcgcaggaagagaagcgccagtaccgtgaggagaagcgctctgaatacatgaggcgcccgcgccgtaactccgacggcacgatgagcttcccctcgcagaacccgtacaccgaccgtcgtcccgacgagcccaagatgcccaagggcatggaatggtcgatgctgtccaaggatgagcgcgaacgtctgcgcggcctgtccaaggagcacgcggagaacattggtctgcacatcctcgccgctttcgcgctggaggagagcgaccccgaacttgccttggagcacgccaagtgggtggcccgtcaggcctcccgcatcgacttcgcccgcgagacgcttgcgttcgtggcctaccgtcagggcgactacaagctggccctgcgtgagttccgcaccgcctaccgtatgaacggcttcctcgactacctgccgttcatcgctgactgcgagcgtggcgtcggagagccgaagaaggccgtggaactggcgctgtccgatgagggcaagcagctgcatggcgctcccaaggtcgagatgttcctggtgtacgccggtgcccttggcgatttggagatgtgggacaaggccattgaagtggttcacaccgtcggccgttcccaggggctgccgggtgagtaccgcatgcgtgccgtgcaggccgagcagtacttccttgaagaggccggccgcagcaaggaagccgagcagctcaacgacctgctggaccgtcttgaggaccagtatgccgacgaggagattgacgaaaacagcgacgacgtggtgatcgatcacgatctcgaagacatcaccgacgactccgacgtgctcgaaaagctcggcatcgatccggatgaggcgcagtacgccccggatccggagcaggaatacggcgatgaggatgacgaggctgaagacggtgatgccgagtctgatgaggccgacgagaccgagaccgattccgccaatgacgccgaggctgacgattccgccgaatccgccgactccgactccaccgaacccgaaaccgaggagtgaacggcgtaatgacccgtttcctcaaaggcaccgatcgcccgctcgccgaggcctatcagcttgcgctgctggacctcgacggcgtggtgtatcgcggcaagaatccggtcgaatacgcggccgattccattcgtgcggccgaagccgccggcatgaccatcgaatacaccacgaacaactcctcgcgcttccagcacgtggtggccgaccagctcaagggcttcggcttggacgtggagccgtggcaggtcatcacctcttcggtggtggccgcccgtatggtggccaaggcgttgcccgccggcgcgcgcgtacaggtattgggcgccgagcatttgcgcgatgaggtcacccgcaacggcctgaccatcgtggacggtcctcaggaccgcccgcaggccgtcattcagggctggtatccggatatgacttggcagatgatggccgatgccgcgttcgcggtcgaggccggagccacgtatttcgtgaccaaccgcgacctaacgattcctcgtgaactgggcatcgcccccggttgcggatcgatgattcgcgccgtgatcacggccaccggcgtcgaaccggtcgcctccgctggcaagccggaagcgtacatgtacgatgaggcccgcgaactgaacgccgccgaaggccacgatttggtgcccaaggaggcgtccatcgccattggcgaccgcctcgacaccgatatcgaggccggtaaccgcggcgactacgattcgctggcggtgctgaccggtgtcaccaacccgaccgaactgatgctggctccgtcacacctgaggcccacattcatcgcccctgatctgcgtgaactcggcgaagcccaaccggagccggtccgcgatgagagcggtacttgggaatgccgcaaggctagcgcttggtttgaaaacggccaggtacacgtcagcgaccccaccagtatggacggcctgcgcgccgccgtatgcgccgcatgggaagccgccgaccaaggcgcacagcttagcgaggccacggtaccggtgttcgccatcgaggcatagtcctatgcctacggatagcgaacatgcgccggtcaccgagcgataccccgaacttgcggatatcgatgaacaagacaacgaccgcaagcttgagacctatcgcaacgtgctggaatccttacaacacgagcttgataacagccgcagctagcagaggtgattcattctcccgccagcggaagatgacgtgaagtgctagatggtggctccatgccgagccaccccgttggtggatggtgggccgaaaggaagatatatgaccgagcagcatatcgatcccgcgactccacttgaccgacttgacatgatgctcgtggcttcgggactggtcgaatcgcgggccaaagcgcagcgactcatcaaggccgggcatgtgcgcgtggacggcgagaccatcaccaagccatcgttcatggtcaaagccgggcacagcgaactcgccgtggataagggcgacgactacgtctcccgaggcgcttacaaactcttgggcgcgttcgaaacctttgccggcaatggccttaccgggccggaaggcttggaatgtctggatatcggtgcctccaccggtggcttcaccgacgtactgttgcgcgggggagcggccaaagtcgtagcgctcgacgttgggcacggccagctcgacccgcgcatcgccaatgacgagcacgtcatcgaaatgagcggcgtcaacattcgcgaagtagaggccgacgacctgccttaccggccggcgatgatcgtttccgacgtctcctttatttccctgacctatgtgatcccggtaatcgcgcgcatcgcggctcccggtgcgcagattgtgttactggtcaaaccgcagttcgaggtcggccgggcaggactcggcaaaaacggcatcgttgaagatccggcattgcgggagcgggcattacacgacgtggtcgcctgtgctgaacagcacggacttgacgtggtggccactgccgatagtcccatcatcggcacccacggtaatgaggaatacctgctttacgctgtcttgagatgaatgcgttggcagtctccgttcaccagcagcacgctggaggtacggtcgatgcctagtgcggtggcacacgtggcgctttccaccgcactgccgttgcgtagcatggcggagtccgccgtcaaagtccggcattgcagatggttggcttcaaccgtgacggctgtgatatggcgaaccgtgctgccatcctcatacccatccatatcaaaacgggaaaacatcgtactgcggagtggatgaacttccagagccctgctgttgacgtcatgacccttcaacacgccgttcaagcggactgtctgaccgctaatatgacgggtgcctagggagccattgacggacagatttccggaacaaacgatatcgccgttgcatcgtagtttgccggtaaaggttatttcatcgcaaataatgtcgccgccgacttcgatgtcgccgctgccgctgatgctggatacgcgaatatcaccatcacaccgcacaatgccacttttgatgaccagtttgtccccttctataactgaggcctcgagggtgctggtcacaatcatggtgtgaaaatgcgcgccatcggcaagacgggaacgttggtccactcctatggtgccgtagactcctttgcctatcagcgtgcaattctgcgtatgcttgcccatgatgataaaactccccttattaatatggacgtacagctttatggcttattgccacaataatgagcgcatccatgttgagggggttatatcggtcacgatgtgagcagatagggggtatagcgagcgcagttagggggttagccttggatgaagtggtcgatctgatcctgcttgcccatgaggatgagttcgtcgttgcgatgcatgaccagttccttggagccgtactggaactccttgcctggggccttgaggcccaccacggtcacgccgtacttgtcatgtacttgtacgtcctcgatgctgcggcctaccgcgtacaggggcgtgtggaccttgacgacggtgtacggcccgtcgatttcgatgtaatccagataattgccggccaccagatggcccacgcgcttgccggcatcggtctccgcgttgatgatgtggcgggcgccgatgcgctgcagaatgcgcgcatgctcctgggacacggacttggcccacaggtcggaaacgccggcgtccagcaggttgccggtgatgatcaccgaagcctcgatgctgtcgccgatggccacgacggccgtgtcgaactgggaggcgtcgatctgctcgatggccagcacatcggtcatatcggcctgaatggtgggcagatgcgcggaccaacgggccacaagctccgggttcttgtccactgcgagcacatcctgacccatctggtcgagggtggcggccacggacccgccgaaacggcccagtccgatgaccagcacgcttttgttgccgctcggttttgctgccatgatgatggtcctctctatgtcagattgctgggcgccgattgaatggccgatcagccaacgataatgttttcctgcggataacgaataggttcgggagccatcggtcggctgatggagtaggcgatggtcaacgggccaagtcgtccgacaatcatctcggcggacagaataaacaggctggccggattgccggcgcttgccacgcccaccgaataaccacccaacgagaaggccgagcaggcttcgaacacggcgtccacgaacgcgcagccggtggtgaacatcagcatcatcgcaccgaccataaccaacgcaaagcaggccgtggtcacggacacggcggtcatctgaatacggcgggggatacggcggcggaacacggtgacatcgcgatggccggtgaatgcggcgcggcaaatcaagagaatcaccgcgaacgtggtgacacggatgccgccagcggtggatgaggaacctgcgccgatgaacatgagtatgctcatgaacaccttggtctcattcgtgacttcgggcacccaggaaatatcgaaaccggcggagcggggcatgacggcggcgctcatcgcacggcgcatcttcatgccggggtcatctgcggggaacaggccggtattgctccactcgaccagcaggaaccaagccagtgaggtggccaccagcacagcggtggtcaccaaagtgagtttggtgtgcaatgtccaacgtttcgggctgagccgccggcgtgcgcactgcaccagattcagcaccacggggaagccgagcgttccgatgaatgcactgatgagaatcggcagccccacgccccaacggttcacatgcagaccagtggcatccggcgtgaaaccggtgttgttataggccgacaccgcgtagaacagcgcctgccacaaggtacgccccatattgccatggttcacgcggaacaggtcgggcagcagcagcacgaaggtcagcacctcggcgatgatggaggtgcccagcaccacggtgagcacgcctttgacctcggaaagcttcgtggtgcccagctcgttcgcggtgagcatacgctgggagaccttgagtctgcgggaaacgccaagagccaccatcgaggcgaaggtcatgactcccagaccgccgaactggatggagaacaggacgacgacctggccgaacatcgaccagtattcgccggtgttcaccaccggaatgccgcaggtggacagggccgagacggcggtgaagaacgcgatcgggaaattggtgaagatgatgtccgatgtggagatcggcagcagcagcaaaccggtgacgatgatgatcagtgcgccgaaatacaccatggacagacggcccgggtgcctgagcagacggtcggtgatgctgatacgtcgaatgcgcttggcggttttatcgcttttgtctcggctcagtacatcggctgaataccaccatgacagtcccttcgaggcctcctcattggcggaggattcgtcgaagtcattggccatgggtcctcaagctcctcaactgatactgctgtacggtcatacggcatgccatcgcgctgcgcacggcacgcgtacggtgattgcgcggctgtacgccattgtatgccgaagccttacgataatcgactctgtggaacgttgccggcgacgcgccacgaagcagcatttttcgaacacctgtacgactgatgacggtgtctgcggttagaataatgagcagtgcgaccgaatcgacaggaggatgccatggccaagcgcaacgcggtggtggtgacgcataccaggctcaggcagaccggaaccgtagtggccgaggcggtgagccagctgcgagtggccggtttcgaagtcgccatcatcgacaacaccgaggcccccgatttcggcgtgcagccgccgtgcgtgtcggacgacaccgaaatcgtcgtggtcctgggcggcgacggcacgatactgcgcgccgccgaactcgtccactgcacccaagtgccgattctcggcgtgaacatggggcatgtcggcttcctggccgaattcgaaagcttccagatcgacgaggcgatccgccgggtctccacccacgactattcgatcgacgaacgcatgatcgcccatgtggacgtctggctgcccggcgccaccaagcccattgaggattgggcgctgaacgacatcacactggaacgcgccgaccggggcaagatggtcgaactgtccatccgcgtggacgatgtggagatgaactcgttcggcgcggacggcgtcatcgtctccacgcccaccggttccaccgcctacgccttctccgcgggcggtccggtcatgtggccgaacgtcaaggccctgcagttgattccgttggccgcgcacgccctgttcgccaggccgctgatcatcggctccggctcgaccttcaccatcgatattctggacgattccatgtccgaaggctggatttgctgcgatggacgccgtcagcgcgccctgccgcagggtacgcgcgtcatggtgcgcgaatcgcgcgataccttgcgcctcgcccggctctccggcgtgccgttcaccaaccgtctggtctccaagttcgatctgcccgtggtcggttggcgcgagcacgcgcgcaacgaggcctcgagccagtcgctgcatcacgggcacacgttcccggcggccgcgtatgcggctggcgttgccgttgccggtgacgctggcgtcgctggtaccgagcccgacaagccgggcgaacgtgacggcaaggcaggatcctgatgctcgaagaactcgatatccgcaatctggggccgattcgagaagccaccattgcgccggccgcaggcatgaccgccatcaccggtgagaccggtgccggcaaatccatgctgctctccgcgatccgactggtctccggcggggccgccgaatcctcgcgcgtctcggccggggcggacgaggcttgggcccaggcgattttcgcgctctcggatgatgccgtcgcatctgaacattccggcgacaccaacgatgccggttctggcgatgccgacagtgggttcaccggtgctgccgcggccgtggccaaggcccatgacgcgggcgtcgaccccgaagacggcgaactgttcctttcccgcaccgtacgcgcttccggacgttcgcgggctgtgctcggcggcaagtccgtaccgcgttcggtgctgggggccatcgccggcgaactggttaccattcatggccagaccgatcagctgaaaatcgcggcctcctcacggcaacgcgagtttctggaccgggtggccggagacgaagccgaactggccgcctaccgcaaggcgtgggatgcgctggccgccatggatgagcggctggaacgcctgcgctcgcaggaatcctctgcccgccaacaggccgactacctgcgcgaatccatcgaccgcatcaaccgaatcgacccgcagccgggggaggatgaggagctgaaggcgcgccgcgaacgcatcgaaaacgcggccgacatcgcccaaggcgtgggttcggcgctgggcgcgctggatgcctcgcaggtggatgtggacgccgccgacggcgcttcggccgtggaactcatcaatcatgcggtgacctcgttgcgcgcgattcgcgtcggcggcacgttcgctgagcaggccgatcggcttgaatccatcaatgccgatttgggcgacgtggtgttcgccctgagccaggagctgggcgacgaaggcagcgtggaggatctggaccagatcaacggccgtatccacgagcttggcgacctcacccgtcggtggggccccaccttggccgacgtgctcgcttggcgggacaaggcggcgttcgatctggaggatctggacgcctcgccggaaaaggtcgccgaactcgaatccgaacggcagacgctgtacgatgcggccctcgccgccgccgacgtgctgagcgccgcgcgcgtggctgccgctgccgacttgggtgcgcgcgtcactgaagaactcggctcgctcgccatgctgggcgcctccttggaagtgcgcgtcacgccgcgagacaaggccgatgatccgctcggcccgtatggtcgcgacgatatcgcgttcctgtttacgccgttcgaggggtcgccgcagttgccgatgggcaaaagcgcttcgggcggtgaactgagccgactgatgctggccttggagctggtggccgccgacacgcgcggcggtgccgaccagaccttcatcttcgacgaggttgacgccggcgtgggtggcaaggccgcggtcgaactgggcaaacgtctggcacggctggcccgcagcgcgcaggtcatcgtcgtcacccacttggcgcaggtcgcctcgtgggcggacgcgcagttcgtggtcaccaaggagccgccggatgccgatgacgacgatttgggcgtggtcaccaccatcgccgaagtcaacggcgaaacccgcgtccacgaaatcgcccgcatgctctccggcagcgaatccgaagcttccctggaccacgcccgagaaatcctatccgattctcggcttacgctcccgctggcgggagctggcgtcgcaggcgactgagggtggttgaagaagatggagattagcaaatgaccaaggccgccatattcgacctcgatggcaccctcctagactccatgggagtctgggaccaagtcgacatcgacttcctgaacaagcgcggaatcgaagtgccgcccgactacatgaccaaagtttccgccatgcaattccgccagatcgccgaatacaccatcgcacgcttcggccttacagacacgcccgaagagctcatgcaggaatgggacgacatggccagcgtcgcctattccaccacggtcgaagccaaacccggcgcgcttgactatctgcgcgatctgaaagactccggtgtcaaactgggtgtcgccacctcgctgcccccgcgtctgcgtgagccggcgctacgccacgtcggcatgttcgatttgttcaacgatatcgtctccgtcgatgacgcgaacgacgtcggcaaggaccagcccgacgtctacctgctcgccgccaagcgcctgggtgctgcaccggccgactgcacagtgttcgaagacctgctggtcggcatgaagtcggccaaatcagtcggcatgaaggtctgggccatgcacgacgactcctccgcctccgactggcccgaaatctgccacctagccgacggtgtcctcttcgacttccacgacgccccgcgcgtgctgtgataaaaaagttacgcccccgctggcggggctgtcggcggaacggcgttgttcggcataggtgcccctttccgaggccattgtaggcacggcccatgtttcgacactgtatgttggcgaggtgtttgttcaccgtttaactgttatgtaacacaccttgacagttaagcagaacggttatactgtgttgtataacagctaaacagctggggtgctagtcaatcacaaccgaaaggggcatagatgaaactgatcatctcatccgtgtccggtgagcccatctacgagcaaatcaaaacccaaatccgttcggcggtgctcggcggcgagctgaaggcgggcgaggccctgccttccctgagaaaactcgccaaggagttgcgcatctccgtactcaccgtcaccagggcgtacaacgaactggccgatgagggcgtggtgcagaacatccaaggcaaaggcactttcgtgatggacaagggcaacgaactgatgcaacgtcagctcgaaacccagattcgtgaaagcctggccgaggcaagccggggcgccaaagccgccggcattccgctggacgcattggaccgcatgctcgaagaggaataccgcaaggaataacctcaagaaaggaccatggccatgaccgccatatccgaatccgacgcgatggcgttgcaggtcaccgacgtcaccaaacactatgattccggcttcacgctggacgacgtgaccttcgacctgcccaagggctacatcatgggactgatcggcccgaacggcgccggcaaatccaccctcatcaaactcatcctcaacatgatccaccgcgacgccggttcgattcacgtgctcggcctcgacaacatcgccgacgaggagcccgtcaaggaacaactcggcgtggtattcgattccagctacctgtatgaacagtggcaagtcaagaacgttgaacgtatcgtcgcgccactgtattcatcatgggacagtggatgctatcgcaagtatctgggtactttcggccttggtggcgcgcagaacggcaagaaacatatcaaggatctttcccgcggtatgcagatgaagctgatgctcgccatcgcattgagccatgacgccaaactgctgattctcgacgagccgaccagcggactcgatgtgcttgcccgcgacgaactcatggatatcctgcatgcctacattgaggatggcgaacattcggtactgttcagcacccatatcactgccgacctcgaacgtgccgctgacttcattacctacatcaccgatggccgtctctactacaccggtccgaaagacgagtttgaggaatcgttccgcctgattaagggcggtccagacgaactggcacaactgcctgcggacgtggtgctgggctcacatatgtatgccaccggattcgatgcgctggtccggtcagacaggcttgatgctgttgcgtcggtggtttcggggcttgtcgttgaatcggcttccattgatgacatcattcgcttgaccaatgcccatgattccaatcgtgacttgagcgggaggtgagcggtcatgggggcaatactgagggtgccgcggtctcggcaacatgcattgaccactgcattgcgcgtcgatatggcctacctgtgcgtcggcgtacagactgtgttctcgttgttgttggcaccgttgttctccgtcatctttcaaggtgaagtttatggtgatggcttcggctatcgcatgggtgtcatcatgacggtattcacctgcgccatgtgggtgctcaccatggctgttgctgacctgcagaacggatatcggcttcgtggcattattccgtcttcaaggaagaaccaggtggccgcgcgatatgtggttggattggtgatttccgtattgtcggtagcgatgattgtgttgattgacgggttgcaagtgctggtcaatccggattggtcattcgcgggcaatctgtgggcggcgccgttgggaggtttctgcaccgcgctgatgatcgcgcttatcgtgcccacgggttatctgtggaccaaactaggcggtcttcaagtcacgatgatggtgatttatgtcgttgtattggctggatccatactgctatctattttgcctgcttcggtgaccagaggattggcccatgccgcgaatgccatcatcgcgcaatgattgtggctggttattgcggtattgacaacgacggttgtggcatatggaatctcgtatgtaattgcctctcgcatatttgcttcaagggagtggtgacgatgagctggaaatccgtagtaaagcaatgtcgattcgattgtgtcgggacgggtctgttcagcgtggcgaatatggtgtttctgctggttttcccggtgctgtctatcgtggtatcgctggtgatgatatcgacccatgtcgatgaacacgttgccagtggtctgatgggcggactcggaggtctggcatcggtgatggcatatatgagtgcattggggcctgccgcatccgaggaatctgcaggacacagtgccatgcgagggctgattcctgtttcacgcaccgcgcaagttgtaggtcggtacctctttctgttggtggctggcctgctctgggctctggatgtggtgatatgcggtggcatcttcattgtctttggcgatatagcagatatggggtggattggtgccttggcatcaggtgcctccatcttcgctttggctatcattcttgggtcggtgctgctggcctgtgcataccggttcaccttccgcaagatgatgatggcctttggcgcggtcatggttggcttgtatgccgtcattgcgctgctggctcgattgcctgtcgactggcaatggctattgctgaatattgccgatttcctgacgatctggtggcatacggcgcttgttctcgccgtgttgtgtctgctcgcattttttggctccatgctgatagccatccgcatctaccgagccaaagaactctagccgcgcatttgtctgaccacgaatgaaaagagaccgacaggaatctgtcggtctctttccgttatcggtgtgttatcagtccaccagatccagagcgattggctggtgcggttgctgggaatcgctttcattggccgtgcggcgcgcgcggatggcggcggctgcgcgcttgacggtcttgataacttcctgcagcaccaccacgccgaaaccgaccgcgatgattttcagccacatgtcgatcggcagcggcacggtgcggaacatcgcgccgccgaattgcaccactagcacctgaagtgcgaacatcagcgcgaacacgccgatcatcaccttattgcgcagcagattggcgaacaggctggcgttgcccagctcgcggctgttgaaggcgttgaacagctggaataccacgaacagcgtgaacagaatggtcgactgctgttcggcggtgccgcccatgaagttcgtccagctttgcgccatgaacaccacggcgatgaacgcgccggagacgatgatgcgctccagcatgccgcgcgagacgatgctggcgtcgcggcgggtgggcctgcggtccataagattgtctcgaatcggctccataccgagcgtcagcgcgggtgggccatccatgatgatgttgacccacagcagctgcaatgcggtgaacggcgcggccagaccactgaacagcgaggcgagtaccacgaccaccgaagacaggttcacggtgagctggaactggatgaatcgctggaaattctcgtaaatgccacggccccagtgcacggccttgacaatggtggcaaaggaatcgtccagcatcacgatatcgctggcttccttggacacctcggtgccggcgatgcccatggcgatgcccacgtccgcgttcttgatggcgggcgcgtcgttgatgccgtcgccggtcaccgccaccacattgccctgggctttcagagcgttcaccacgcgcatcttgataaccggcgtgctgcgggcgatcacgcggatgcggccgatttcgcgggacagttcctcgtcgctcatttcctcgatctggcgcgcctcgacggcgatatgccgctcgtccagaatgccgagttcgttggcgatggccgtggcggtcacgatgttgtcgccggtgagcatcttgagctcgatgcccgccttgcggcagcgctccacggcaccgggcacatcctcgcgcaggggatccacgatggccacgaagccgtcgaacatcatgccggattccaagccggcgcggtcggcagcgtaatcgagagccgcagtgtcggcgtccttatcggaaatatggcggtgggcgaagccgagcactcggcaggactgcgcctggaacttcgcgatctcccgttcgatttcgccgcgcgtcttggcgtcgacggcgcacaggtcgagcatcttctccgggctgcctttggcgaacacggtaatgccgtcgccgtcacgcaccacagtggtcatgctcttggtctccgacgagaacggatacgtgtggagcaccgtcgcgcgctcgcggcgaatccggtagtcgagtccggccttgtgcgcggcgaccaacagtgcgcattcggtggggttgccgatgaattccggcatcgcgccggcctcggcttcggtggcgcccgggaaggtcacgtcggcggtgccgttgacgcagaagttctccagcagcatgcggttcctgatctgctcgggcttctccaaggcgcggcccggcgcgttgtacgcctcgatcacggtcatgcggttctgggtcaacgtgccggttttgtccgagcagatcacgttgatgcagccgatggtctcgcacgccaccatcttcttgaccagcgcgttctgcttggacattttgatgatgttcaccgcgaggcacgcggccacgatggtcggcaggccttcgggcacggcggccacgatcagcgttatggaggtgatgaacgcctcggaaatcgtgtcgaacgaggcggtgccggaagccacgaaccgggccacctgaagcacgaacaccagtgcggccacaatcgagcccaccacggcgatcaccttgccgagcttcgcgagcttctcctgcagcggcgtcataccggtgttggcggcgcgcagttcgcgggcgatcttgccgaactcggtgtcgtcgcccacggcggtgaccacggcacggccattgccggcggtcacgaagcagccggaatagagcatgttcgtgcggtcggccaccggggtcttcgggtcggtgaacacggcgtcggtggctttggcactcggcacgctttcgccggtgagcgcggattcgtcggcggtcagatcgttcgattcgatgaggcgcgcatcggccggcagcttgtcgccggtgctgatctgcagcacatcgccgatggtgatgtctcgctgcgacaccagcgtgacctcgccatcgcgcaccacggtgacggtcgtgtcgtcattgatgtcgttcagcgcttcgaatgccttggcgctgcgaccctccatcaccacggtgattgtcacggacagggcgatggcgaagaagatgcccacgcattcgagaatgtcggcgtggccgccggccatggcgcgggtgatgttgacgcccagggtgatggccgccgcgatcataagcatgatgagcatcgggtcggcggccgtcttgacgatgcgggaaagcatcgattccggcttcggcttggtgaaggcgttgggaccgtactggttcaggttgtgcgcggcctgttcgctggtcaggccttgatgtgcatcggtgcccagcgtgctgatgactgctggcgcatcctgcatgaatggtgcgggcgtctgcccgttggccgtggtcatatgttcctctcgtttggttgacacaccgcactgaaacccgcgtaatatcactcgcgtaccgcgcaacatggcggcacgcagccaaacgaatcgttgacgaccatgtatcgcatactccgcggtacatgagtctcgtcatttaaggcaaagccagaccgtaacggaactgccgacggccacgatgttgacttgccacattgcggtttgggccgagcccttcgccgcaatgctgtctactccctcatgggactattcagttgcagaaacagaacctaacaaaccacatggattttcccgttcgccggcagcatggcgattcccgccttcctagaaaaaacaagcaacacgccattggctcgttgcaggtgaaaagccgcaagaaagccgcgcgtgacaaggctcggacatgcttgaacatgcctggaccttcgacttgtgacatcagaaaacaaaaaaccgatacatgctggtaaagcatgtatcggttgggaattgtcagttagtgccgtcagcggactatcacagcgcctgggcggccttctccacgtagtcctccatgccgtcgatggccacgacgtccttgaaccgcacgtcggcggtctcaagaccacgcagggcggccggggcggtggtgccggtctcgtgggccagcacatccatgcactcgaagtcggtgccggtggcgtcgaagcccaatgcctcgttcaccacgcgcgggaacttgtaggggctggcggtggagagcagcacgcgcggggtcagcgggtcgcgcggcatctgctcaagcaggtagtagccgcaggcggtgtgcgggtcgatcacgtagtggttctcgtcccaacagtgcttgatggactcgcgtacctgatcctcatcggcccaaccggtgccgaagatctgacgaatcttggccagcagttcttccgggatctcgtacgtgccccacttgttgaggtcgttcatcagcatggagatcagacgggtgtcgccctcggacaagtagtacagcatgcgctccaggttggaggagatgaggatgtccatcgagggggagatggtctggaagaacgggcgctggcggttgtaggtaccggtggtcaggaagtcgaacagcacgttgttcttgtcggaagccaccacgaggtgcttgaccggcagaccgagcagcttggcatagtagccggcgaggatatcgccgaagttgccggtcgggaccacaaactcgacctcatcgccgacgttgatcacctggtcggcgagcagttgggcgtaagcggagaagtagtagacgacctgcggcaccagacggcccacgttgatggagttggcggaggaaagcaccacgtgcgaattgccggcgagacgctcggccagggcgcggtcgccgaagatgcgcttgaccgcggactgggcgtcgtcgaagttgccttccacggcggccacctgcacgttggagccggcttgcgtggtcatctgcagctcctggacctgggagaccttgccttccgggtagaagacggtgatcgcggtgcccggggcgtccgcgaagccggccagcgcggccttgccggtgtcgccggaggtggcggtgaggatcatgatcttctcgtccgcgtcgccatcggccggcgtggtgtgcgccatgaagcgcggcaggatctgcagcgccacgtccttgaacgcggaagtcgggccgttgaacagttcgagcacgtaatcgtcgcccaggggcttgagcggggtgatgcgctcgtcggaccactgttcgccgtaggcgtcggcgatgcactggcccagctcctcggccgtgaagtccggcagcagcgcgcccagcacctcggcggcgatttgctggtacgacttgcccggcagggaggccacgtccaccttggtcttgcccaacgcgtccgaaacgaacaggccgccgtcatcggcgatgcccttacgaatcgcctgcttggcggtcagcgaatcggtggtgctacgggtggaatggaaggtggttgtcacgatgaatccttctgcctgaaagggatgatgaatccacatcagtctagcgtgggccgtgggcagaagggccgtccgtctcgcataaccgaccggtcgcaccggcgaaaatcaccattgccatcgaacggggaccggccatatcatgaaacaggccggctgcaaacgggccatacggtaaggcgacaacggcgaatcaattgtcgcttataccaaagagcacccatgaccgcttcaccccttgcgcagaaggcaaccgatgctttcaacgcgccgatctgcgaaaccgatcctgagatcgccgaactgctggactccgaactgggccgccagcgcagtggccttgagatgatcgcctctgagaacttcgtgccgcgagcggtactgcaatgccagggctccgtgctgaccaacaaatacgccgaaggctaccccggccgtttctaccacgccgaggcgtacggcgtgaaccccgagaccttccgcatcgacccggagatcatccgccagcgcacgttcgacggtgccaagatccttgccgaacgactactggccgacgacgtcaaggccaacggcatcttcgtgctgaccggcggcaccgatgtgcatctggtgatggtcgacctacgcaacagcgagatggacggccagcagggcgaggatctgctcgccgcctgcggcatcaccatcaaccgcaacaccgtgcccttcgacccgcgcccggcctcggtggcctcgggcctgagaatcggcacgtccgccctggccacctgcggcttcggaccgaaggaatacgaggaggtggccgacatcatcggcaccgcgctcgccgccggcccgtccgccgacgtgaccgcgctgaaggcccgcgtcggcaagctcgccgaagacttcccgctctaccccgacctggaccagattcactgattttttgcggatgtacgcagctccctcatcagagggagccgcgcttatatccccggctatcttcggtgcaatatgggtcgaaacgggcaatgcggcccattgtgggttactcttgttttttatgagcgatgaattgagtcctgaggtgttcgacgcggtgtgccgccaggccgatcaggccgcacgcgcacaggagcgtcttgcacaggcaaataccgaagccaaaaacgaactgttgcttgccattgcggacgcgttggacgagcatgctgcggacatcgaagccgccaacgcgctggacatgctcgaatccaaggaaaacggcatggatgcgggcaagctcgaccgcctgctgttcgacgtgccgcgcgtggccgccgccgcccaaggcgtgcgccatgtggccaccctgcccgatccggtcggcgagatcgtgcgcggatacaacctgcccaacggtctgcgccttacccagacgcgcgtgccgatgggcgtcatcggcatgatctacgaggcccggccgaacgtcactgtggacgtggccagcctgtgcctcaagtccggcaatgccgcgttgctgcgaggcggccacgccgccgaacgcactaacgccgccacgttgggcgtcatcgccccggtgcttgaagcccacggtttcgaatccgcactggtgcaatccgtcgaccagtacgggcgcgccggcgccaccgccatgatggaggcgcgaggccatatcgacgtgctcgtgccgcgaggaggagcgggtctgatccaagccgtcgtgcgcaactccaaagtgccggtcatcgaaaccggtgccggcaacgtgcatatctatatcgacaagtccggtgatctcgccaaggccatcccgatcatcatcaacgccaaaacccagcgcgtgggcgtgtgcaacgccgccgaaaagctattggttcataaggatgtcgccgccgaattcctgccgcagatcgccgccgctctggccgaggcgaacgtcgtgctgcagaccgacaccacgtcgtacggcatcatctccggcgcggcaatcgagggccttgacctcaaccacgccgccgaagaggattgggacaccgaatacctggccctcaaaatgggcatcaaggtggtgtcggacctggacgcggccatcgaccacatcaacacgcattccacaggccacaccgaatccatcatcgccgaggattatgcggccatcgaggaattcaccaagcgcatcgactcggccgtggtcatggtcaacgcctccacccgcttcaccgacggcggcgtgttcggctttggtgccgagcttggcatctccacgcagaagatgcacgcacgcggtcccatgggattgcgggagatgaccaccaccaagtggatcggttacggaacaggacaggtgcgcgcatgaacgaggacggcaacatgaacattacggctgacacggcaaacaaggcaagcgaactgcggcccgacatcgacctcaacgatcccaagctcggcctgaagatcgcggccgaacggctcagcatcgtccgctacgtgttccttgtgcagatcgaggacggcatcgcctccgccgcccagcgtgcgtcgctcgaatacgcggacgccgtgctcatcggttggcccgagaccgattcgcccgaagtcgcggacctcgacgatgcccagctcaagatcgtgcgcgaacacatggagctcatggaaggctacatcggcaaatacagccagatggagcacgacggtgaccttgacggcatgaccgacacgctcatccgcatcaccgagcgtgtggccgaggtccgccgcctctaccagccggacttcccgctgcccaccttcgccgaaattcgtcgcgtggtccaggacgaatgggatgaagacatgggcaagatcgatcccagggaagacaatcccaccgccggcgaaatcgaagaggaaaccgaatcagccgatgacgccgccggcgagggcgaccaggcatgagtggtgttaccgacagccacaaaacggctgcgtcagttcagtccgaaaaatcagtggaatccgccgagcccgccgaaatcgttgccgtcacccaaggcgaaaccgaacggcgcatgtctgacctgtccgcgccggccggggccagcagccatggcaaaggcaggctttccgcacgcggcaactggcatacgcgcctgcgcgtcggcatcatgggcggcacgttcgacccgattcacaacggccacttggtcgccgcctccgaagtagcttgggtatacgacctcgatgaggtgattttcgtacccaccggccgacctgtgttcaagctggacaagcacgtcaccaacgccgaagatcggtatctgatgactgtgatcgccaccgcatccaaccccaaattcaccgtctcgcgtgtcgacatcgaccgtccgggcgtcacctacaccatcgacaccctgcgcgatatccgcgcccaacatcccgacgccgagctgttcttcatcaccggcgcagacgccgtggccgaaattatgcagtggaaggacgccgacctcatgtgggacctcgcccacttcgtggccgtcacgcgccccggctactccagtccggacggcgtgaccttgcccgaaggaaaggtcgatacgcttgagatcccggccttggccatctcttcgaccgatgtacgccgccgcgccgaacacgacgagccggtctggtatctggtgcctgacggcgtggtgcaatacatcggcaagcatggtctgtattcatacgaggactgacgattcgtacgaggactagtgtgcatttgtacgagggctggtgaggattagcgcgaatcagtgcgcagcaatcctcaccagtgcaaaggataagcagtcaggccagtcccatcttgattttcaatgccattacgcgagtcgccgccgccgtcactttcgaagcgaaagccggatcggacttcgcccgttcgttgaggccgtccacaattggctttacgtaatccgtctgaccgatgcaggacatgtcgccgcccgcctcgacaagctttactcccaattggcttacatcgtagctgctcaacgcttcggcagacatcgaatccgaaatcaccacgcccgtgtacttcagggcgttgcgaatatgaccgtcgataatcgtagaagaaaacaccgccggattattcgggtcgatggattgatacgtggccaacgacatcatcaccatcgcaggatcggtcttggtgatcgcctggtcaaaggcacctgcctcggccccgcccaacgtggtggtcgtatccagaatgccttcggtggtgaagtcggtattgccgcttaccgcgcccaacccaggataatgtttgaccgccgcgccgacctgagcgtctcgcaaaccttcaataacggcgatgccatgttcggcgttgccggccgcatccaatccgaaatcacgatccagcgcgccaatcggagcatttgaggcacgatcgcccaccaccgtgccgagcaccggtgccaaatcgacatttatgccagcagcagctaattgcgaaccccacgtgcctgccgattgacgcaatgcgtcagcggacattgtgccctgctcaacggcactgggcattgtgtcgaaaccggtaccagtcagatgctgcacctgaccaccctcctgatcggtggcgatgatgagacgattgccggccggcgcatatccttggagttgcgcggtcgcggtcttgaccgtatcggcgccggtattccaattgccaatgagaatggccgagccaatgtgctcatcggtgattgttgaagccaacgaggagggatcggaaccggcaagcaacggcaccatcactaactgtcccacacgttcctcaagtgtcatggcggataccgcacgttgggcttgtgcggccggttcgttcttcttcggggaaggaacgtcggcgcgtggtaacgcacttgtctgggaggtctggggagtggtggtgttgccgtttgatgtggatttggcgaaccatccgacatgccatccgtaggctgccacgccggccaacaccactgccaaagcacatattgccgccacgattggagtgctcctgtgccgaagttggcgtgtggcgtgtgctgagggacgcatatgttgtggccgttggctgttcataccggcaagcgtagaacggagcgtagaacagaacgctgcctcattctgtgctcagggcataacctacctcccgccctttcgataggcttgagttatgtcttttaacgatcctttctcaatactgttcggcaatggcggcgattcacgacgcaacaatgcgaacaatgacgatccgatcatcctcgatgtcgaggccgatggggacggtccggcccgcaacaccaacgccggcccctccgggtcatcccgccctccacgtggcccggccaatccgcgtatcacccgtaagccagcgtccggtggctcaggaggcagccgtggcagcaagattctgatcggcgtggtgctggccttggccatcatcgtcggtctgttcttcggcctgtcccgattcatcaccgatctgatgtggtacggccagctcggcttccagtccgtggtctggacccagctcggggtgaaaatcggtctgtgggtggcctacgcgctgctcatggccttgaccggcttcgtttccgcctggctggccattcgagcacgccctgattcggccgacggttccaccattcgcattaacggcgatgtggtcgaggtcggcaaatccgtcagctcgaaaaccgctcgccgcgtggccgtggtgatttcgctgatcgtcggcgtcatcttcggttcccagtttaacgcgaactggagcgagattctgctcatgttcaacgcgcagtcgttcggcaccaccgatccgcagttcggtctggacaacggcttctacgtgttcgtgctgccgggcctgaagctcgtgctcgccgccgtggccatgctgctgggcgtgggccttgtgttttccgtggtcactcatgtgctgatgggtggtatccgcattactatgccggttaacggacgcggcctgttctccatcaccaagcgttgccgtcgccagcttggcatctggctgatgctcaacatgttcgcttgggcagtgcgccagatgatcggcgtcttcgaccagctcaccgtgcagggttcacgcatcaccggtgcctcctacaccgccgtgcatgccaacatccccgtcaccttcatcatggccgcgctgaccgccatcctcggcgtggtgctgggcatctggctcatgcgttcccacacgctcgaaggccaggcgtccatcggcgtgcgcgcctccgccgcgctcaaggcctggcgtgtgccggtgacctccattgccgtcgtggtcgtggtgggtcttgtgctcaccgtggcatggccggtgctgttgcagcgcttccgcgtcaacccgaacgcacaggagatggaatccacctacattcagcgcaatatcgacgccacccgcgccgcctacggtcttgacaagctcaagaccgagcaatacaaggtaaccgacaagggcgagcagggcgctctggccaaggagggcgacaccaccgcgcagattcgtctgctcgacccgcaggtcgtcagccccacattcaaacagctgcagcagtccaagcagtactacaccttcgccgacactttggcagtcgacaagtacgagatcgacggcgtttcccaagacaccgtgattgccgcccgcgagcttgccctggccggcaacgacaaccgcaattgggtcaatgaccacaccgtgtacacccacggttacggcgtggtggccgcttacggtaacaaggtgaccgccgacggccagcctgaattcttcgaatccggcatccccactcagggcaagctcactgaatccgaaaagtatgagcctcgcatctacttctcgccgaacaccaccgaatactcgatcgtcggcgcaccggagggcacgcaggcttgggagttcgactacccgaccggttcggaaggcgccctgaccacgttcaagggcgacggcggcccctcggttggcaacctgttctcccgtattctctacgcaatccgcttcggctccgatcagattctcttctccgaccgtgtgaccagcgaatcgcagattctttacgatcgttcccccaaggagcgcgtggccaaggtggcgccgtacctgacgcttgacggccgtgtgtatccggccgtggtcgatggccgcgtcaagtggatcgtcgacggctacaccacctctgatgcctacccatactcgcagatgaccgacctcggctccgccaccaaggattccaccaccgtctcttccgcaacggtctcatccttgggctcgcagaaggccaactacatccgcaactcggtcaaggccaccgtggacgcctacgacggttccgtggatctgtacgtatgggatcaatccgacccggtaatcaaggcatgggagaagatcttccccggccagtaccaccagctctccgatatctccggcgacctgatgagccacatgcgctacccggaaagcctgttcaaggtgcagcgcgagctgctctccaagtaccacgtgacctccgccaaccagtactactccggcgaggacttctggcagacgccggtcgacccgaccgaatcccagtcccagcaggaccaggacatcctgcagccgccgtactacctgaccttgcagaccggtggcaccaaggaaccggtgttctcgctgacctccacctacattccggctggccagtccacccgtgagatcctcaccggcttcctgtcggtcgactcggatgccggcaatgagaagggcaagataggctcaaactatggcaccatccgattgcaggagctgcccaaggattcgaacgtaccgggccccggccaggcgcagaacaacttcaacgccaacgccgacgtgtccaaggaactgaacctgctgcaatccggcgacacgcaagtggtgcgcggcaacctgctcaccctgccgctcggtggcggactggtgtacgtgcagcccgtgtacgtcaagtcttcgggtgcgacttcattcccgctgctcaagaagacgctggtcgcgttcggtgatcaggttggattcgcggatacgttggatgaggccttggatcaggtgttcggtggtgattccggcgcggccgcaggcgatgccgagaacgtgtccggtgacggatcgtctggtggccaggcttccggcgaccagtcgtccggcacatccggtgaccaatctggttccgataccaatggtggccagtccggcaccactgacggcaagtcggattccggctcgtcttccgaccgtagccccgaactccagcaggcgctgaacgatgccgcccaagccatgaaggacagccagtccgccatgaagaacggcgactggaccgcctatggcaaggcgcagaaggagcttgaagacgccctcaacaaggccatcgagctcgacaagtagttccgacaggaattggctcccctcagggtgaggggagccatcgccgaaggcgactgaagggagtcggttacctcaactgacatagcccgtccttatcataaggacgggctatttgcgtattcaaaggaacctcatgccatacaccttccgtccggccgtcgaatccgacatccaagccatcaccgacatctacaacgcctcagtgatggccggcggtgcgaccgccgacctcaccccgcgcaccctcgaccaacgccgcgcctgggtcgaatcccatacgccgccctacggcgtttttgttgtggaatcggaagactgttcaatcatcggcttcggtgcgctctccgtgttctatgaccgtgcgggatatgacggtgtcaccgatttggcctattacatcgatccggcatggcaaggcaggggagtaggcacgttcatgcttgacaggctgctcaccgaggcgcgggcccgccacatgcgcaaggcctgcggcatcattttcgccgataacgccggctccattgccctcatgcaccgcttcggcttcacccaattcggactcatgcccgccgctgccaccgactccaccggcaccatgcgggacatgtcctactggtatttggacctgtagccttgcggtaagtcatttcagtcaagaaaagtgtgagaatgccggagcaaacgagcttgacggcggcgttgagtacaatcttgacggttggattcggccgggcatgggccagtgcgcgaggcgaacgcgcgcatgacgtacggaacgtacagaacgtgcatacgggaatataggaagacggacgaggagcggattatggcatcggatttctggctgattgcgggactgggcaaccccggcaaaaaatatgaggacacgcggcacaacatgggcttcatggccgccgatgtgctcgccgaacgttggacggtgaacttcgccgatcacaagggcttggccatgctcggtaaaagcgtgatgaacctggacggccgcaccgtcaagttctttctggccaagccgctgacttatatgaatgattccggcaatgcggtggcttccattagcgcctattaccagatcgagcccgaccatattgtggtgattcacgatgacatggacttggaattcggccgtatcaaggtcaaggcaggcggctccgcaggcggccacaacggcatcaagtcgattgaccgttccctcggcacgccgaaatacgcgcgtgtgcgtatgggcgtcggtcactccaagcgcggtacgaacgcgcatgacaacacggtgaactgggtgctgggcggattcggtccggaccagcgcaagcagctgcccgaattcctggctgacggcgccgacgccgccgaggacatcatcttccacggtcttgccaagacccaggagaagttcaatggccggtgaggcgacgcacccggacctgatcaacggctcactggtaggcatcctgtctgagctggaacaggacaagaccttcctgaagctcgccgccggcgacatcgaggcttcggacgacgtcgacaactccgtcctggccggcacccccgaaggtttgcgcccggctttggccgccgccatcgggcagggtgtggccggcaaacccggcaagccggtcgtgctggtcgtggcctccggccgcgaagccgaagagaccgtgggctcgctgcgctcctggtatgatggcgacccgaacgacatcgcccagctcgaagcctgggaaaccctgccgcacgagcgtctgagcccgcgcgcggacaccgtggccagccgcatggccgtgttccgcagactcaagcatccgagcgataccgattcgatgttcggcccgattcgcattctcgtcatgccgatccgctcgctcatccagccagtcgtccaaggactgggcgatgtcgagccgctcgtgttcaccgtgggggaggacctgcccctcgacgaagccgccaaacgtctgatcgaaaacgcctacacgcgcgtggacctggtcatggaccgtggcgagttcgcggtgcgcggaggcattcttgacgtattcccgcccaccgcaccgcacccggtgcgtatcgaattcttcggcgacgaaattgacaccatcaaggaattccacgcctccgaccagcgtacctacggcgacggcctcaagaccatctgggccaccgcatgccgtgaactgcagctgaccgacgccgtgcgcacccgcgccaaagccttggtcggttcgattcccaatgctgaggacatgctcgaatccatcgccaacgccattccggtcgaaggcatggaatccctgatgcccgcactcgtggaccatctggaaccggtgggctccatgcttcccaagcacgccgtgatcctcctgagcgacccggagaaactacgccgctccgccgaagacttggcaaaaaccgcgaacgagttcctggccgcaagctggcatgtggccgcctccggccacggcgccggcgcgcccatcagcttcgacgaagccagcttcctcgactatgcggaaaccatcagctccctcgaatactccgagcatccggtgattcgcctcaccagtttcggcgtggacaccacgttgaccggccatgtgcagctcgacgcccagaacccggccgaattccgaggggatgaggccaaggcctcccaaggcatcgaaggcctgctcgatgccggcttccacgtcaccatcaccgccgctgcggccggcaccttggccaggctcaagcgtgcgatcaacactaccggcatcgccaatttcgacgtcatccgctctcaggccatcgacggcttcgtggacaaagccgccaaaatcgccctgctcaccgaacgcgacctgaccggccgcacttcagccgtggccgtggccaaaacgccgaaacgccggcgcaaggccatcgacttggtggagctcaaaaaaggcgattacgtggtgcacgagcagcacggcattggccggttcatcgaaatgcgtcagcgcaccatcggcaccggcgccaacaaaaccactcgcgaatacctggtcatcgaatatgcgccttccaagcgcggcgccccggcggacaaactgttcatccccaccgaccagctcgaccaggtcagcaaatacatcggcgccgaagcccccaagctcaacaagctcggcggctccgactgggcggccaccaaggccaaggcccgcaagcacgtccacgagatcgccgacgacctgatcaagctgtactccgcccgccagcgcgccaagggcttcgcgttcagcccggacaccccatggcagaaagagctggaagacgccttcccctatcaggaaaccgccgaccagctcaccaccatcgacgaagttaaatccgacatggaaaagcccgtgccgatggaccgcctcatctgcggcgacgtgggcttcggcaaaaccgaaatcgcactgcgtgccgccttcaaggccgtgcaggacggcaagcaggtggccgtgctcgtgcccaccacgctgcttgtccagcagcattacgagacgttcagcgaacgattcgagggtttcccggtcaatgtggcggccatgagccgattccagaccaccaaagagatcaacgagaccatcgaggggctggaaaccggcacggtggacgtggtcatcggcacgcacaagctgctgaacccgaaaatcaagttcaaggatctgggactcgtcatcatcgatgaggagcagcgtttcggcgtgggacacaaggagacgctgaaagccctgcgcaccaacgtggacgtgctgtccctgtctgccacgcctatcccgcgcacgctggaaatggccgtgaccggcattcgcgagatgtccacgctcgccaccccgcccgaagaccggttgccggtgctgacctatgtgggcgcctacgaggatgcgcaggtcaccgcagccgtacgccgcgaactgctgcgaggcggccaggtgttctatgtccacaatcgtgtgcaggacatctcgtccatcgccgacaagatccacacgctggtgcccgaggcgcacgtcggcatcgcccacggcaagatgggggagaagcagctcgaccagatcatccgcgacttctggcatcgcgacatcgacgtgctcgtgtgtaccacaatcatcgagaccggtcttgatatctccaatgcgaacacgctgatcgtcgaccatgccgaccgtttcggcttgagccagctccatcagctgcgtggccgcgtcggtcgcggccgcgagcgcgcgtacgcctacttcttgtacgacccgtccaagccgatgaccgagcagtcccatgaccggctcgccaccatcgcgcagaacacggcgctcggctccggtttcgacgtggccatgaaggacttggaattgcgcggcaccggtaaccttctgggcgacgagcagtccggccatatcgagggcgtgggcttcgacctgtacgtacgcatggtgtccgaagccgtggaaaagtacaaggagcccgaagagaacgtcgagccggtggccgtgtccatcgacctgcccatcgaagcgtcgattccgatcgagtacattgattcggacaagctgcgtctggaagcgtaccgcaagctcgcctccgcccgcaacgaggccgatctgaaggatttggaagaggaacttaccgaccgttacggcaagccgccggtcgaattcgagaccctgttcgacgtggcccgtctgaagttcaaggcccgcaagctcggcatttcggagattctcgcgcaatccaaccgcgtgcgcatcggtcgcatcgacccgcccgaatccatccagatgcgtatgggccgtatttacaaaggcacccaataccgcccggtcacccaccaactcatcgtccccaccccgttcaccggctccctgggccaaggtcccatgagctccgaccaggtagtcctctggaccaaccagttacttgatgatttggcatggaccccgtcgtcaagcaaacggcagagccgtttgtagacggggtgcgaggcgacagtcgagccagctatggctcaccgggcaacctccggtgagccatattcatattcatgccgtcgtttgtgacgatgattcaccccagacggaatcgttccgactgtccagcgagcgagattaagtgactgctatgagcgaaacgactacgagccgcacgaaccagagcgcgaccacggcaacacttgccggctatgagattccccgcctcggcatgggcacgatggcgctcgccatcgaggggcgcccctccaaccgtaatcaggcaatcgagaccatccatgccgcgctcgatgccggagtccgttatttggacacggcttggtcctattatctgcccagcgcacccggcaccggcgaaccggaggatatgggctatggcgaatatctggtccgcgatgctctgcactcgtggcatggccccaaagatcaggtgctcgtagccaccaaaaccggctggctgcgcacgcttgacggcaacggcaactacggctggcaggccgacgcccgacctgaaaccatgatcgccaatgccaaggaatcagcccgccgcctcggtgtcgatacgctcgatttgctctactcgcactgcaacgatccgcaggtgccgtacgaagaccagatgggcgcactcaagcagctcgtggacgaaggtgtggccaaagctgtcggcatctccagaatcgacaacgcggacatcgaaaccgcccacaatattttgggagatcgtctcgtggccgtccagaaccagttctccccggtccaccgcgaccctgagcacacgttggaaacctgcgaaaagctcggtttggcttttgtctgctggtcgccgctcggtggattccttgacccgttcaacgagcatctgttcgaccggttccgcgaagtcgccaagattcacgactgctcctaccagcgcgtcacgctcgcgtgggaacttgcgcaataccaatatctgttcacgattccctcggccagaaacccgcaggagattcaggactcgttcaaagccagcgaactgaaattgtccgacagtgaaatcggctacctcaatggcaaggatgttgactgagcgatttcgtccgtactgccttgcaatcaggcggcacactggcattgtgagcgctaacgctaaattttgggcgtgttgttcacaacgtccacaaatcgcactattcttaagaatgtcattcaagatacacaaccgttttaaggagtagttgtggcagtaattgaaagcgtgtacgcgcgtcagattctcgattcccgcggcaacccgaccgttcaggtcgttctggacaccgaagacggcgcccagggcctgggcctggttccgtccggtgcctccaccggtgaggccgaggcttgggagcgtcgcgacggcgacaagtccgtctacggcggcaagggcgttcttaacgcggtcaaggccgtgaacgaggtcatcgctccgaaggtcatcggcatggacgctgctgaccagcgcgctctggacgacctgatgatcgagctcgacggcaccccgaacaagggcaagctgggcgccaacgccatcctgggcgtctccctggctgctctgtacgcttccgccgagtccgccggcctgccgctgtaccgctacatcggcggcaccaacggccacatcctgccggtcccgaacatgaacatcatgaacggtggcgctcacgctgacttcgccaccgacattcaggagtacatgatctccccgtacggcttcgacacctactccgaggctctgcgcgctggcgttgaggtctaccacaccctgaagaacgtcctgaagaaggaaggcctgaacaccggcctcggcgacgagggcggcttcgccccgaagatgaagtccaacgaggactccctcaagtacatcatggacgccatctccgccgccggctacgagcctggcaagcagatcggcatctgcctggatgtcgcctcctccgagttctacaacaaggagaccggcaagtaccgcttcgacggtgaagagcgtgactccgcctacatgctcgactactacgagaacctcatcaacgagtacccgatcgtctccatcgaggacccgttcaacgaggaaggctgggaagactgggctgccatcaccgctcgcctcggcgatcgtctgcagttcgtcggcgacgacctgctggtcaccaacccggctcgtctgcagaaggccatcgacctcggcgccgccaactccctgctggtcaagctgaaccagatcggttccgtcaccgagaccctcgacgccatcgagctggccaccgccaacggctacacctccatggtttcccaccgctccggcgagaccccggacaccaccatctccgacctggctgttgctaagaacacccgccagatcaagaccggtgccccggcccgtggcgagcgcgttgccaagtacaaccgcctgctcgagatcgaggaggagctcggctccaccgctcagtacgccggctacagcgccttcaaggcctgcaagaagtacctggccaagtgagctgaaacgcccgtaaaggcgtgagtttccactgaagctcgatacccgtcgtattcgtcaagtcgaatgcggcgggtattttcgtgtgacatgagcaagtcgtcccgtaccggcaaacctggcaaaaccggcaaagcacaagttaggaaaaaagggtcggcggggcctatagcgttcttcgtctccctgttcattatcgcccttggcaccatccagctggtctccaccttccacacctatgccctgaacctggccgaactcaatggtctcaagcgtgaggaggcttcgctgattgcccaaaagcaggagttggaaaacgacatcaagcgttgggatgacaaggcctacatcaccgcccaggcccgtgaacgcctcggcttcgtattccccggcgaacaggccgtgcgtgtgcttcatcccgaagccgtgaccggttccgatagcgaatcccagaaaacggaagattccagtagcagcaacaaaaaagttctgccatggtacagcgaactgtcttactcgctcaaaaaggccgatgagcctgtgaccgatagcgagtccggcaaatccgatatttccggttcctctgactcgtcatccaacgactcatccaagcggtccgataagtcagaccagaacacccaacagaacacccaacagaacacaggggagggaacccaacagtgaccatcgatatcgccgccaaggccaaggcccttgtcgataccgtgcttgccgagcccgccaacgatcatgacatcgacctggtgcagcatcagctcggccgatacccgcgcggcatggtcgccgtgggggcgcgatgcgtctgcggtaggccacttgccgtaatcacccgtccggtgttgcccggcggaatccctttccccaccacgtgctatctgaccggtccggaagccgtcaaggccgcctcccatgtcgaggccgccggcgtgatgcagcaatacaacgacatgttggcctcggacgaggagctcaaggccgcatatgagcaggcccataacctgtatctggcattccgccacgaactggcaggacgtcttggcgacagtgaggagcatattgaaggcacttcggccggcggcatgccggtgcgcgtcaagtgcctgcatgccctgctggcccaatccctggttatgggaccgggcgtcaaccccattggcgatttggtactggaacgcgtcaaagacgaattcgatccgaccgtctgccgctgcacgctggacgattgatcaacagatgagccagcgcgaacagtccattcatacgcactaagggatacgaggagaaggcaatgagcaaggaatccgtaaccgtcgccggcattgattgcggcacgaactccattcgactgaaaatcgcacgtgtcgatgccgatggcatgcatgaggtggtgccgcgcatcctgcgtgtgatccgtctcggccaggatgtggacaagacccatcgttttgccgacgaagcgttggaacgcgcctatgtggccgctcgggaattcgccggtgtgattgccgaacatcccatcgacggcctgcgtttcgttgccacctctgcaactcgtgacgcggaaaaccgtgaggagttcgaggatgagatcgaacgtatcctcggcgtgcgccccgaagtcattcccggcaccgaagaagccgacctgagcttccttggtgccacttccgtggtcaatcgcgacgatctgcccgccccctatctggtggttgatctcggcggcgggtccaccgagctggtcatcggtggcgacggcgtcagtgcgcccactacccaggttcagggcgcgttttccatgaacatcggttccgtgcgcatgaccgaacgtcatctgaccaatgatccgccgacccagacacagatcgatgaggccgttgcggacgtcgatgaacatatcgatgaggccttccgcaccgtggacgcaggcaaggcccgtaccatcattggcgtgtccggcacggtgaccacgatgaccgccttggccatgggattgaaggaatacgaccacaccgtggtcgacgggcatcggttgagccttgaagacgcctatgccgtggacgacaagttccttaggatgacgcgcgccgagcgccgcgaatacaagaccatccaccccggccgtatcgatgtggtcggcggcggcgctgtggtctggagccgtgtgctggcgcgtgtcagcgaagccgccaaggccgatcatggtgaagccatcgattcgttcgttgccagcgaacacggtctgctggacggcattgtgctcgattatggtcgccggttgctggctcaatagcgtaagtggtaagtgcctccagcgggctgagccgttaagcaaacagcccggtgggctgtttgtaggcgaggggagcggctatgccgcgacggctgcacgaagtgcagcaacccgcaagcaatgctcagggcaggagatagcttataatagaaaagttggcctccgtggcgaaatggtatacgcagtcgacttaaaatcgatcgcttcggcttgtgggttcgagtcccaccggaggcaccttgaaatcggcctgtggccgatgccgtttttgcggctgtgccgtggtctctccccagtcggcttcgccgacagccccccccctcgtcagagggggctcgggcgggttctagtgatcgttgcaacacctgacctaccgcaaggagggtcaggtgaccagaagccaccgaaacgaagaccgtggcggggaacaccgttggacgttcaacggcgtcgaatatccgacgaggaagctgatgtgcgaggcgagacgcgccgagtacgtgcgcctgctggacgaggaaggcatgaacttcacccaggccgcgcacgcggtcggcgtctcgaaacgcaccggcaaggcgtggcgcaacggcaggacgcgcgccacgggaaggaacgagaaacccctggtggactggtatcgttccaccatggacaaacccaagaccctccatccgcgctacctgagccaggaggagcgcatccagatcgcggaccgtctgcgtctgggcgattcgatccgcgccatcgcccgcctgctgggccgcgaccccggcacggtcagccgcgaggtcgagcgcaacaggaatcccgagtccggcggttacgagccttaccgcgcccagcagaaggccgcggaccggctcaaacgccccaaaccgcgcaaggcggccgagggcacgcgactgtgggacgagatcgccgccgggttgcgcaggcattggagcccggagcagatagccaaccggctgaggctggacttcccggataatggggatatgcacgcgagcgtcgagacgatctaccaggccatctacctgcaggccaggggcgaactcaagcaggagctgaaacgcgccatgaggcaggggcgaaccgcccgcagaccccaaggcggccaaggccgcaaaccccgtttccgcgaacccatggccatgatctcggagcgacccccggagatcgaggaccgggcggtcccgggccactgggagggcgatctcatcaccggcagccgcaacaaaagcgccatcggcacgctcgtcgagcgcaccaccaggttcacgatcctgctgcacctgcccgacgggcacgacgccgaacacgtccagcaggccatcatcgacaagatgcagcacctgcccaaactcctgcgcaacagcctgacctgggaccagggagcggaactcgccctgcacaaacggatcggcgcctcgctggacatggccgtctacttctgcgacccgcactccccgtggcagcgcggcaccaacgagaacaccaacgggctcctgcgccagtacttccccaaaggcaccgacctatccgtctacccggaggactacctcgacgcggtcgccgaggaactcaacgaccggccacgcaaaaccctcgggttcatgaaaccaagcgagaagatcatcgaactgctcgacgccgcgtgataacctcaacaaccgacaacgtgaccatggaaggccgctcaaacctcaggtgttgcaaccaccactagaatctgccctcgcagctcactatgtggagagcttataaggccgaaacaaaaggccgttaggctatgtggcgttgtgacgatgtacctgatgaaacgaggaatccacatggcttcacgctggaccgatgtcgaacgagtcgaacaaggcgcactgcccaccatgcttgcccaagccgtcattgcgggcactgcactcaccgttggtgccatcgcctgctcgggattctatctgtccatgatcggcaatgtggccgcactcctgccatgggcgactatcgtgatactgatcgccgtggcgttcacctacatcgtcggcttcgccctgttgtggtgtgccgaagccctgaccctgcgtgccaacgacaaactcaagccatggctgtacggcgtcgtcggattaatcggctacggcgtgtggggcatgttcgtgatgagcgcgatgatgaacacgctgaaccagccgctgaacggcgtggtgttgtcgaacggcgatgtgatggccctgaccgtcaactacgcggtgttcggcttcatcgccttcctgttggcacaggcgtacgcgcccaaaatcgccaccaagaagggactgaccatcgggctgatggtggtgcagatcgtattggccatcatcggtatcatcgtactggtcatgatgttctccgcactgtctcactgactgacttatcgctcgccggcatgacgcgcgcggccatcatcgcacaaggcgaaagcgattccgggcgctgggctgggatacgatatcgtgatggtatgacgcctggtaacaccggcatgccgaaccagcaggggagaaggagccaaatgttcagtgtgcttgacatgttcaccatcggcgtcggaccttcatcctcgcacaccgtaggcccgatggtcgcggcacatgctttcgcctcctcgttgcaggccgaccatttggtcgatcgcaccgcacgtgtcaaaatcacgctttatggttctctggcgctgaccggtctcggccacggcaccgatcgtgctgcgatggctgggctcgaaggcaatctgccggccaccgtggataccgaccacatgatgcacatccgcgagatctgcgcgttggatgatactctgaacctcgccggcctcaaacgcatccatttcgactacgaccgtgacgtggtgttcgaacaatggaagcgcatggccgcgcaccccaatggcatgcgattccaggcgttcgacgccgccgcaagcttggtcgacgaacaggtctggtattccatcggcggcggattcgtgcgcaaaggcgctcccgaagacccgatgatcggcattcatgaacgccctccggaaggcgcctcctttgccgatgcggacgagtcatcatccactgatttcggcgtcgaggcaccctacccgttctcatcatgcactgaactggtgtcgttatgccgggaacatcatctcagcatcgccgaacttgtatgggccaacgaaaccgcttcacgctcgggcatccaggtccgatccgatattgatgccatctggcgtgttatgcgcgcctgtgtggaccacggatgcacctcggcggaacccacattgcccggtggccttgacgtaccccgccgcgcgccgaaaatgtatcggcgtctcgcctcgaattccgatgtgctgcgccgcgacagccggcgcaaagacgccgtgctcgagtcttccgacgccgcatgggtggatctcttcgccttggccgtctctgaggagaatgccggaggcgggcgcatcgtaaccgctccgaccaacggttccgccggcatcattcccgccgtgcttcactattactggcatttcgtggacaacgccaatgaacagggcgtggtcacgtttctgctgaccgccggtgccatcggatacctgttcaaacgcaacgcctcaatttccggtgcggaagtcggttgccagggcgaagtcggctcggcctgttcgatggcggcggccggacttgccgcagtcgtgggcggcacgccggaacaggtggagaatgctgctgagatcggcatcgaacacaacttgggtctgacttgcgatccggtgggcggattggtgcagattccatgcatcgagcgcaatgccatggccgccaacaccgccatcaacgccgtgcgtatggccatgctcggcgacggctcacacatcgtgacccttgatcaggccatcgaaaccatgaagcagaccggtgaagacatgatggccaaatacaaggagacctccaagggcgggcttgccgtcaatgtcgtcgaatgctgattgacatgtccggtattcaccagcatgatgaccggaattgacgtatacggccagcgtgtcgtatcgcacagggatgaaggactaccgccgattcgccgatggtgctaaggtagggcgcattgtgtctttgaaggaggactaatgacagatcagatgcctcaggtgaacgccgaatttggcaccacgcccgttatcgagttcccgacgcccgaagccccgaagggcctcaaggttgtggagctgaccgagggagacggcccgatcgtgcgtcgcggcgacaccgtcaccgtgaactaccacggcgtggtgtggggtaaggacaccccattcgactccagcttcgaccgtcatcagcccgccagtttcggcatcggcgtgggacaggtcatcaagggctgggaccagactgtgccgggccataacgtgggttcgcgtctggtggtttccattccgccggaatacggctacggttcccgcggcatcccgcaggccggcatcggcggcgaggacacgctggtgttcgtcatcgacatcatttccacccgctgaccataggtcagcacatgacgaacgccggggtcatagccggcgttttgtcataaataacgaagattgtttcagcatcgacaacggttcaggaggacgatatggctgaggacaaggtctacctgctgacgcaggaagcatacaacaagatgaaggaagagctcgcccatcgtgaaggtgagctgcgtgaggaaatcgcgcacaagatcgccgtggcgcgtgccgagggcgacttgtccgagaacggcggctaccaggccgcccgtgaggcgcagagcaagaacgagggccgcatcaccgagctcaccgtcaagctgcgcgattccaagatcatcgagaatgctccggaaggcaccgtgggcgagggctctgtggtgaccatcgagctcaacggcaacgagatgacctacgtgctcggcagccgtgacatcgtggccggcaccgactacgacatcatgaccccggattccccgattggcaaggccatcgagggcgccaaggtgggcgacgtcgtttcctacaccgcaccgaacggccgcgagctgtccgtgactgtcaaggccgccaagccgctggcctgagttaagtgactggtatgcccccgtaggcgggggcatacttatatgtcgtagcgcttattgccacagcgagacgatcaccatgtagatggccaccatatggcaggcatatccggccaccgttccgcagtggaaaatctcatggaatccgaagacgcgaggccaagggtcgggcttgcgcaaggcgtagacgatggcgccgaggatgtagcaggcaccgccggcgcacagcagcaccaccacggctggccccgcatacggcgaattccagaacatcaccatataagccaggccgtagatgccgaagatgatgtacaccaccgtatacagccagcgtggtgcattgatccagatcacatgaatcacgatggcgatggccgtgcacgcccacatcgatatgatgatcacattgcgccagaacggttccagcgcaaacgaaaccggggtatacgtgccggcaatgagcaggaagatgttgacatgatcgatacgccgcagcacatcggtgacgcgcgggctccaatcgcccagatggtagcaggccgaattggtgaacagaatcagcgacgctgtcatgaacacggcacacgcccacttcagactcgcgccatgtgccaagcatataagcacgatgcctgccgccaatgacaggggagcggcaatcgcgtgaatccagccgcgcatcaacggctttggtcgtccgtgcacgtcgagacgaatcttgcgttccacttccgcaggggcaatgccctcgattttcagcgcacggttctccgctttggcgagcttgtgccgggccttctcctcggctttggctcgaatggcctcggccttgaactgggccttggcccgtacggcatcagccttggcctgcaacgcctgttcgcgcgcctcgatagccgcctgacgcttggatgcgatggtggcatcctctgcaatcgtcgcgctgttatgagcgtcgtgatgcatcgtcttttccgagtcgccggttgttgatgccatggtgatgcccccgtttcacgagttgacgatacgcttcttacgctgccgtaacctacgttagcgtaacttttatgcttgtcaataccgactcgcacgaacactatcacccaatggcggcgatactatggaatccgaagatgagaacgtcgcagcaataaagggctcggcgatggtgtattgcacggagtgtgggtttgccaacgagcaaggaaatgccttctgttcgcagtgcggaagcccattggagcagcccgaggccaatccggcggcccctgcttctcctgaacctcccgccgggcgtcctggcgtcgatcacaccaaagcggtggtgattgtgctcatcgcgctgatttgtgtcgtggcgttagtcatcggcttgttcatcacccatagcatgggattgtggggagctcagccgcaggcgcaaacatcggcacagtcgaccggggccgatgcgttggattccgccgatgatggcatgacggattcttctgacgccaagtccaaggccaagaagaacacgtctgatagcgccaaagacaagaacagcgacgattcgtccaagaaaagctcgacggagaagtcgaagccttccactccggtgatcacatccagccagttgtctgacatcgcggattcatactcgtcctccgatgtggccgtctccgccatggtcatcgatggaacatccgccgactcctcagaggacgccaccatcgcgaccacgtcgcagtccggcaagcaattcgtggctgccgatttctatctgccggtctatcttgcggcccaggacaatggcgatgacaacgccaaagcgcaggcaaacgcgatgatgggttccatggacacagcaatgccggcaatatggtggcggcttcggatatcaaactgtacgtgatgcttgccgtgtacgataagcaacatgccggcaccttggccacgggcgggaagccgtgcaacgcgattggcgcggtattgaagatgcgatgtcgtcatagtcgtcgtacttgcccgtgtggcttgccgcgacggcggcggtgcgtctgcgtatgatagggatatggctgatttttcacatatccttgcaacgcgccccgacttcgacgacgaggaccgcgagtggctgcatcatcttgtcgccgattggcaggtgatcgccgatttgagctttgccgatctgctgctgctggtacaggatggcgatggcaaatacgtggtggccgagcaatgccgtccatccaccgttatgacgctgcgggcggaagacgtggtgggaaacgtcatgccggacgacatggtcggcgaattggacgccgccatgctctccagcgtggtgttccgctccacggtattgagaaccgtgggcaaggcgaccgtctgcaacgtgtacgcgccggttcggcacaatggcaagaccttgggcttggtcgtgcgtgagaccaatatggccacacgagaatccaacggccgatatgagtcggaaagcatcaacgccggcaagcatctgtacgagatgattccgcgaggccaattcccctacaaggattcggtgatgagccaacgccatatcgctcgcgtggcggacggcttcatcatcctgaccatggacggcgtggttcgatacgcagccccgaacgccatcagctgctttaggcgtctcggtctgctgaccaccatgcctggccattacctcagcgaactcggcacacagctattgaaggagaacgaccctgttccggaaaccctgccgttggtgttgacaggcaaagccgcggtcgactccgaactcaacgccaaccgttccgccgtctcgatgcgctcgttgcccttgtatgacaacaacggccgtatcggagcgattctgctatgccgtgacgtcaccgagctgcgccgtcgtgagcaggagctgcagaccaaggacgctacgatttccgagattcaccatcgtgtcaagaacaacctgcaggccgtctccgcattgctgaggcttcaggctcgtaagaccaagtcggatgaggtcaagaaggaattgcaggaggcgcaacgccgcgtgcagaccattgccatggtgcatgagggattgagccagaccgccgacgaggtcgtcgacttcgacaaggtgatcgccaacctgctgcgcatggccgtggacctagccacgatgaaagaccagcacatcgatatcaactacatgggcaagttcggcatgatgcccgctcaggatgccacgccgctgtccctcgtgctgaccgagctcatcaccaattcggtggagcatgggttcgaaggccgcaaggatggccatatcacgatttccgtgggccgctccggcccgaacctcaatgtggtggtcgaggatgacggttccggtctcggctccgaagaacagggtggattggctcgttcttccggttccggtttgggcacgcagatcatcaacacctttgtgaccaatgatttcggtggttccgtgcattgggagccgcgccgcgaaggcggcacccgcgtggtgcttgatatgaagctcagggctgctcaggacgagtgatgcgaagcccgaaatgaggaaaccctcccaagcgggagggtttcctagtatgacgaagcgataatcaaaacatcagatttgcatctgcatggcctgagaacggcgggcgcgcatggcgcggcgcttcagcgcacgacgctcatcttcgctcaagccgccccacacgccgtaatcctgattggtgtccagtgcgcacttcaggcatgcgtcaatcactttgcaggtgcggcacacggccttggcctcctcaatctgctgataggctgcaccggtgttgcccaccgggaagaagagttccggatccttgtcacgacatgcggccttggctcgccaatcaaaagcgctgctcattgcttgcctcccttaaaagccccgtggctggtgttgttccttaagtccagtaccaaggtaaccacgaaccgtggtgattttcaagaggttttgccgagaaaaaaccgaagttttcacgaagcgcactgcaccagacatgccgatgtgccctcgatgagcacggcccggcccgcgttgtcggcatcgatatgactcatcatatccaataggcgagcggggactccggccataagatcggacgttttctccccgcacgggaacacgattctggtattgcaatgctccggtatacgtatcgggcgaatcgtgctgacggcgaataccacgctgacggactcatcggccaacgcatgtgtgaaagacagcgcctgctcgtcggtgcggaatgggtcgaacaactcatcggcgtcgtcgacgaaccacacgatatgcggaggcggtggtgcatccgagctggcatacggcgtgcagcggccgccatgaagccattgcgagctccatacccgacgatgcggggaactgacacgtaccgccaagccatcagccatgctggcgtgtcgagccaatgttttcagcaacgtggttttgccgcgcccctgcgggccgatgacaccgatattgccaccggtgagggataccgtcgcctctcgcaggttgatgccatcgtcggcaagtccaaatcgaatgcgttgcggtgcgtggtcggccacagtccggtcttttacgtgccgggggagtggcgcggtaaacagggacggttgcggcgggcttccgacgaaccgcgatgcgaacgcgatctggcggcacaccgcatcgatatcgcgtgccgttgcacagcggaatgccgtcacctgttcggaatcgttgcagaacgccgcaccgggcattgccggactgaggtcggcggcacgaccatcgccaagcagctcgcatgattgcagacggtcccgaacccgtaaacaaatgctgacggacatattcgccttcatatcggcactgacctgacccatgggattctgcgtacaggcgatcagatacatgcccagtgacctgccgagcgaggcaatacgcaccagacgattcacataatccgggagctggtccttcagggcatggaattcgtcaatgaccacgatcaggcgcggtggtggattgaccatatcgcggatatcggaagcatggacagcggcggacagctgttcacggcgtgtcagttcggcttccagcgcacgcaacgcgcgtacggcatgcgccagatccagatcgcatacgctgcccacggtatgcggcaaccgttcgagtttgcggaacgcggaaccgcctttgaaatccaagaacacgaaattcagatgctcaggcccgttcatcgaggcgagcgccagacaccagctttgcagcaacacggattttccggaaccagtggtgccggccaccagagcatgcggcccctgacggttcagatcgagcatcagcggctcgcttccggtcatgccgatcggcaccgcaaggtcaaggggttcaagccagcggcccacaatggcgcgccatggcaggcgtgcgaagtgcagcagcgattctatcggctgcgacggcgcatgacggaggtctgcggcgcggtcatcggcgtcgcccgtgataccgacatcgatcgttgcctgttgcggatcgggagccttctccgggcctggaggcgaggggagcgtcagcagcagggacacgagacaggcgaatatgcccggtgcgatcatggcggcgaacagccattgcccgtgcaacagcagtatgaccatcatcaatgcctgcgcgatcatcgggcatgccgcggcaaacatggtcaggcgggcgcgcaatggcggcgcgcccaaacggtgcttcgcccgggatacggcggatgccgtatggacggaatgtcgcttcgaatcgttctgctgtgatgtcatgcttccagcgtgggggaacgcatgccgaaagcgcaagccgaatcaaggtatgtggttctagcttgccgagttatccacatgacattttgcccgtgcatgattggcggtgtaggcaacggtgacgatcatgcgccgatgatgaagccgatgggctccgggaaagcgtcggtcagccttccgccagattgcccacggtgccggccttatacgtgccgtcggcaagttgattgaacagttcggtgttcttggcgtcgtcaagcagcaccgaggaaccaacgccatcaacgtaataatcggggtcggaccagtacacgctgccggagatgccattcgagccggtggcgcttttgaacgccaacgccatggtgagcaacgtgtaagggttggtcttctcgtccacggtgagtgcgctcatcgcggcattggacactgccacgattttggacggattggtcagggtctcactgctggaagccttcttgacgatggccgagatgacctgtcgctggcgttcgttgcgtccgaagtctcctcgcgcgtcggcatatcgcatacgagagaaggacaatgcggtggaaccatccgccgtatggcatcccgccttccagttcagtccggaataggaatcctgaacatcctcgtcatagcacagttcgataccgcccaaggcgttcaccacgttctgcagaccgccgaacttgatctgtgccacatgatcgattttctggccggtgatctgctcgacgttgcttaccaaagccttcttgcccgcaatcagcgccaccgcattgattttcatgtactggttatcgacgttcatgagcgaatcgcggggaatggaaaccaacgaactcggcccgcttttgggcttgatcagcaccagaatcgtatcggtcctgaagccagagatattgtctacgccgccgtaatcggtggaaccgtcacgctcatcggagccaagaatcagccaagtcgaggccggcgtgttgggggtgtcggtcagccagtcgctccgattcagtttgctgtccacccattgccaggcaccgaaaacggaaagaatcaacgccgccaccagtaccgcgattgcgcatagggtgatgcgtaaggctcgcggacggcgtgccgttaccgttttcgccgttgccgccgccggccggccaagatggctgaacttcgtggacacgtttgctgctggcgatgagggccgggaaaccggcatatccgacggattgcgcacggcgttgcgggatgagccggaagacatccgcgctcgcgacggcggaatgctgcgcggtgcggcggcatccggagccgtgctgcgagtggcgcgtccggttttcggagaaaaactgggcggagtccgcctgccgttgtccgcgacgttggcgcttgccgtggcgttggcgttcagttgaggctcttcgatgtcatttcccgtgacggacggacgggccgatggagcttgacctgactggcgcgaggttcgggcgggggcgaaggagcgtggcacctgcccggaaggccgggtgcgtcgatttcccgcaggaatgaagcttggcgggttgatatgcggatccgccccacctgattcctgcgtcataacccctcctgaaactgtcgattgtctgaatgacactttgacacagcatccgccgggtgttcctgcgctatggtgttcctgcgcaggaacggcacaatatcatgtgcaacggcgtcagggcatcgcgttcacgccatagcacacagttccataaaaatgatgtaatgacacgagaaagaatttgacaaaaccgaaattgcatgtgtgtaatttagtccgtatgaaaagctcaataggcaaggagaatcgcatgtggggtgtggtcgacgattcagccgaagagccatggcacgaattgtggggactattccgacctgatggcgatgtatcttggcagcacaaggcgttgtgcgcgcaaaccgatccggaggcgttcttcccggaaaaggggggctcgacccgtgatgccaaacgtgtgtgcgcaaaatgcgaagtgcgtgagcaatgcctgaaatgggccatcgaccatgatgagcgattcggtatttggggtggcatgagcgagcgcgaacgccgtcgatataagcgagagcaccgggagcgggcgtagctccacacacccccttcaagtctggtgcgtacactgggagtttatgagtccgacaggtaatagcgatattcatgaggcgttggccgacgccatgtcttctcgaccatatacgcataggcaggatgtggataccggcattacggctgtgatcaccgttgaggaggatatgcgtttcctccggtctacattgcgttcggtattgacgcagaatgttcttccgggggtcgtcatcatcgccgacgcgaccgggcgcaccagttcgaggataaccacctcgttcgaggtcatcccctcgccatcggggccggtgatggaggtgccgcagtccaagcatgtgaccattcacatcgtctcggccaagggcgcacgctccttcggcgatgcggtcagccgggcattggatcgtgccgatctggatgacgctccccgcgcattgtggctgctccatgatgattcccgcccttcggatgactcatgccttgaacgattgcttgaggcgtggcgcaatacgccgggcgccagtgtgctcgggtgcaaacagtgcgattgggaaggctcccatctgcatgatgtcggtatgtatgcgggtcaccacgccgtgcattccctggtggtcgatggagaacccgatcaggagcagtatgacgggcggcaggatgtgtttgcggtgtcgctggcaggcgcgctggtgtccatgtcgcaattcacgcgactgcggggcatcaatgcctggctgaccacctacagcgaatcggttgatttctgccgccgtgtctgcctgagcggcggacgcgtggtggttgtcccgcaagcggagatatcacatcgtcgcgcacggtatgagggcattcgtacgcgaggcggggaaccgcttaaggacgatcacacggtcaatcatgcgatgacggtgcatcgctcccaacagcggtatctgtacacggacctggccatgtcgtcctggtttatcgtctggctgtggaggctgctccgcagttttggcatggccatatccatgatgttcggcaaggagccgtatgaagcatgggtgcaattgtgcctgccatggctggccttggccgatatcgcgggaaacatgaaatcacgcagtctggtggccagacaatcgaaggtcgccgcatcgtccctgcatgtcttgttcgcagacagccagcagatcaagcagttccatgatcgtcgggatgcattccaatcccagcagggcagagtgctgctcagtccgctggaacgtgcccatctgcggacacgcaccatatatcgctggagtgcggccgtggtgatggcgctggtgtgctttgcggccatcgcggtgatgtattggccggtgttccgttcgatattctccggcggatcgttgtattccgatgtgttgcttcccaccggtgccagcttcacgcaactggtgcagtccgccaccacgccgtgggtgtttggcagcggcaccggcattcctgcgccgcccacgccgtggctgctggtgctgatgctggcctcgttggtcacgctcggccatgtgaccgccgctttggcgatgatactgtttgtggccgcgccgctgagcgcattgtcgttctgggcgctggcgggcgtattcacccgctcggacgtggttcgtgtgctgggaggactgctgtgggcatccaccggcattatgttcggctggtatgcgcaggccaatatgccgatgcttaccgtaatggtgttcctgccggccgcgttcgcattcgtgttccgtgccgtgggcatgtaccataccgaagacccgctcaagccgcgcacatccgttcaggccgcggccatcgccgcactgtgcttcatccctgtggtggccgctgaaccgcagctgctgttcgcgctgatcgtcgtgttcctgatgttcctgctattcgtgcgtcgcaagcgcgccatgctgttgctaattccggttcctgccgcctttgcggtggctcctacgctcgtcaatgcggtgcgttacgccgatttgggcatgtggcgtcaactgttcggcgacatcacggtgccaacgtcatccgccaacgggtcgccggcgtcgctgagtctgcttgaggccgcacagcgtgcgctgggatggcgaatggggtcgactgattatgccgatttggcggtcactgtgctgtttggcgtcatcacgctgcttgctcttgcttcgctggtgctgccgttcgcgttgcggacctcgcgactgatgtgggtggtaatcgtctgcggaggcgcgctcgccctggtctccagccgtgtggccataaccgtggatgccgatggtgtcgtggccggttccgcgcagccgggcatcgcgatgatgatattgggcttcctcgcctgcgtgtgtctcgtcgctggtggggcggtgaagcgattccaaccgttgcatgcgtctggcagtgatcccgcatcgaaaaaggaccgtctgcatgtgctcatcgtgtctggccgtgtggtgcttgctctgatactggtgtgctgcattggcatccaatgcatgtatggcatcgaacgtcataaggatgcgggactgggcgtgtctgaaaacggcctgcccatggtcaccaccgattatctggaggccggtgccgatcatcgtgtgcttgccgtgagcgcggagacccgcaacatcgtcaactatgcggtgatgcgcacctcgcgcggcgatttgatcgacagctctccggtccagcgggcgcgcctgctgtccggcaagcatgatgcggttgacgaacaactggcccagtcctgtgcctcgctgctgtccaatcccgacgaagaggccatcgcggccatcagcgcgcttggattcggcggcatctacgtggttcccgagaccggcgattccttgaacgacatgccgtatgaacagttgagcgcgaatatcgccgcatcgaacggcacccagtccctggtctccacggatagcggcagctactatcgtctgacgctgcgtagcagcgcctcacagcaggtggatacctcatggcagcaacgtgcacagcatagtgtctggaggcacgcctggctgatatgcctaggtgtgatcacggcgttgtactgcttggtcgccatgcctcgcagacgaccgtcctacggattggaggagcaggcatgagcaacaaaacttctggtttcaaacgtgcgatcggcatcgtgctcggtgtgatcaccatgctggtgttgattgcgctgttcgtcgttctcgtcatggcccccatccccaatatctgggtggataaggtggccgcttccgataatgccatcgaccagaccgttagtccgacccagtccgaaacctactgcccggcacctataggattggccgataccggcacgtacggcgacagcgccttccaggccactgtcggcaatctgagcacacaagcgcgctatgcggcgttcggctccgtctacagcgccactgtctcggcgatcgggcaaaagtccagttcagatgacgtaactttgaaagacgccgattcgaccgacgattcctcggtgaaaaccggtgctcagaagatcaatcagggagctcgtctgatcaatacccgtatgctgcaggccgcagctggcaccggcaccgtcggcaccatcgcatcatgggccgatgatggcgatgtgagaggcatatcggcggcatcctgcgtatcgacctcgctcagccagtcgttcctgctctccgacagcacgaccggtaccacacagcagctcatcgtctcgaatctctccaccaagccgaccaccgtcgacattgccgtctggggttccgagacagccgggaaaatggcattgtccacccaatccacgctgtctgtgccagccgagggggagtcctcgatggaactgtccgccgcggtcgatgggcagcatggtctgttcgtgaccgtttccagcaaggagactcctatcgcgtccgtggtgcgcacggtgaccatggatggtctgacaccgaagggttctgatttcgcgctgccgctgccgaccgcatccaatgcatcggtggcgccgtccatcactgccggcgatgcggtcaccgcttatctgttcgccaaggcagacaccagcaccgggctgtcatggattaccgccaaaggcttggttcccgccaaagatgccaccgtcactgctgataaagtgacggcgatcgacttgggagaagctcctgatggggcgttgggcgtgatgtccaccgcagaggacgccgtgtcgttctccgtcaaggccacacgctccggtgactccggccaagccgatttcgcattggtcaatgccggcgagccatccgaattctcggggttggcccttcccgacggagtaaaggcctccatcacgctggccaatacgtccaatgcgcgcaggacggtcaccttgcgcgcctacgatgatgccggtgcttcggtaacctccaaggaaatcacactggatgcgaacgcagcacaaacgattgaagccggcaatctttccggcgatcatggcaccgcggtcgtgctgatgttggaggactcatccaagaaagtgagctggggagcgcggttcagtcacgattcgttgcaagacaaggacatcgccggattgtccgtcatcgacgcttcaacgctgatgcccgccacggttcatgtctgggctcggaacgattcctccatcgtcaagtagaagggtatgctcgccgaagcgtcagtttgatgatgtttcggcggcgatatagctgcgggccgtgccactaccttattacaagtgacacggcccgcagtgttgtcacaggccccagtcggggtcgatttcctcgggcctgcgcccatacaattccgctatgcgggccaccagctcatccctgacggccaattgcagttcgagcttggtaggtgcctcggtctgcaacggcatgcggtagagcacgactcgtgcaggaatgccgtggctggcggggaagcactgggacgtcatattcggctcggtctgccaaggcgtcggatccgaaggcggcacatcctccaccgcgaactggagcggacgtatcagttccggccacgcttggccgagcctgcgaacctgggccgccaccatatcgtcgaacatgccggtgcgagtgcggtaacggggcagacgggtgccgaacatcggggttcgtgtgccgcgaccgtggcggttgcggtagattcgtgcgttccaaggtggctgaagcatggttcccaccatagggcatggcggaggcaacatgcgttaggattggttcattggctgtgaacattcgtcaacgagggaggcacgacaaatggtggtacgttcgtggtccgaacttgatttcgataatgtctgctccaacgccaaggtgttcggtttcgatttggacaacacactggccagctcaaaacagccgatgaagcccgcgatgatcgaacggttctgtgcgttgctcgaccatacggtggtggccctgatctcagggggcggcatggcggtggtcacctcgcaggtgctggatgtactcaccccgaatgccaggcgcggcaatctgcatgtcatgcctacctccggctcccggtattaccggtgggatggcacgcaatgggccttggtgtatgcgcatgatctgtccgaagccaccgtggccgctgtctcggaaagtcttgagcgacatgcccgggaactgggattgtgggaacagcaggtatgggggcctcgaatcgagaacaggggcagccagatcaccttctccgctcttgggcagttcgcgcccgtagcggccaagcaggcatgggatcgcgataacacgaagaaacaggcgctggtcgaagcggtcaaggccgatctgccgcatatgcgggtcaaggccggcggatacaccagtgtggatgtcagcgaatgcggcatcgataaggcctatgccgtgcgcaagctgacgcagacacttggcatacgggccgatgaaatggtgttcgtgggtgatcgcatgacgcctacgggtaatgactatcccgcggttgaggccggtgcgatcggtgttcgtgttgagaatccgcaagatacggtacaactgctggatgcactgcttgcgcgattcgatactccagctcgatagtgacgcgttatggacgggccgagcgtatacaagtggtggcatgcgatgtgggcacaggtctgcaatctgctgtttccacgcggctgcgctgggtgtgacgcgccggatgaggtattgtgtgcggcatgctgggccctgttcgcgcaatgccgggaacgggatgcagacagtggtggcggagcccgtatatggtccgcatcgatttatcagggagcggtacgtcgtgccattctcgactggaaggaccacgacgataccgagcttgacggcccgttcggccgcatcatggtgtcgctgctgaacaagacgccaataccatcatcatgcttgggtcatcgcgtattggtggttccggtgccatcatcgcgggcgtcaatgcgccgaagaggacgtgcccatacggcaccgttggccaaatcggtggcaggggcattgcgtgggtgcggcgtcgatgcgcgaccatgcaatgccctgagctcctccaccaaggcacgctccgtgcagcaggtctcttcggcacagcgtgcccgtcgtatcaccggtcatgtcagggtgaagcgtgatctcatcggcaatggcgacgcggtgcttctcgttgatgatatcgtcaccacaggtgccactgtgcggcaatgcgttcaggcgtttcagcaggccggcaccaaggtggtgggcgtgctggtattggcggatgccgtggtgcgacggtccgatgacgatatcaacgggtgaatgacatcggtgacgatgccccagatagcaggcgaagcgccgttgctcggcatgtaatcggggtatcgcggattctcggcgtgcaatatggtgatgccggcccgtgaaaccagccgcttgatggcgatttcgtcgtccatgacagccgcaaccacatctccggggactggtgccaacgaacgatcgacaatcagcagatcgccgttgtgaatacccgcattgatcatggaatcgccggccatctgcataacaaacagcgtggcctcgtgcgccatggcctgtgactcggattgctgtgtcatgctgcgcctcccaccctgtattcgaacatctgttcgaatacagtatacggtaggacgtcggacaatatcagcgttcggcgatgtgatatttaggcaggatgatttcgaaatcggcacctcgcgtgtcgtcgaccactttgacggtgccaccgtgcaattgggccgcccagcgcgcgatggacaggccaagaccggtgccgcccgactcggtgccgggacccgtcttgcctttgacaaagcgccggaagatgtccaaacggtcggaaggtgcaatctgggagccgaaattcaccacattggtcacgatggtgccttggttttcgtcctcgtgggcgtcgaccagcacggtggtgccgtcggccgaatgtttcagcgcgttggcgatgatgttggtgaatagctggcgcaggcggtcctgatcgccttccatcgtgatgtcggccggcacggtgacgcggatgtcgtgggcgtggccaccatcggcgatttccaacggctcgatggtctcgtcaagaaagtcggcgaagttgaacttttcgatattcagactcgccgcaccggcctccatacggctcaggtccagtaggaaggcgatgagatcggagagacgctgcgtttgggtgaggatgctctccagattggtgggagtgggctcggtgacgccgtcggccatgttctcgaccatcgcctgcaaagcggaaacgggcgtgcgcagctcatggctcacattggcgatcatgtcgcggcgcattttatcggcatgctcgagttcgccggccatctcgttgaacgagcgagccagcttgccgacctcgtcatgacgatcctgatcgatatccacgcggaccgtgtaatcgccatccgccatggcttcggccacatcgcgcatctggcgtaggggagcggtgatgccgcgagagaagaaataggtgatgcccaaggccaccaccaaagtcagcggcatggcgatccaaccggaccagccgaatttcaggaggaaccagcacatggcaaacgcgatggcagtggcgataacgatcagtgcgctgagttccagcttcagagatgagaacaaatcaaccggcttgacgcgaggtttcatcgcatcaagccgggattgctgttgttttttggatgccatcacgcggtcggcggctcgaaagcgtagcccacgccatgcacggtgcggatggtatcggcaccgagcttatggcgcagcgccttgacgtggctgtcgacggtgcgggtgccggatgcgtcgacccagtcccagacctcttcgagcagcttttcgcgggtgagcaccgacttcgggcggcgggccagcgtggccagcagatcgaactcggtgggggtcagatgcacctgttcgccgttcacggtgacgatgcgctgggccgggtcgatgaccatcgaaccgaagtcgagcagcttctcgttctccgagttcttggcgatgaccttcgcacgctccacgcggcgcagcagcgccttgcagcgggcgataagctcgcgcatggagaacggcttggtcatgtaatcatcggcacccgctcccagaccgatgaccttgtcggcctcgtcatcacgtgcggtgaggatcagcaccggcaccggacgttcggcgacgatgcgtttggtggcctctagaccatccataaccggcagcatgatgtccatgatcaccagatcggggcgtagctgggacgcggcctggacggcggaagcgccgtccccggccacgcgagcggtccatccttcagcggtgatgcgctgggcgatggccgtggcgagcgtgggctcgtcctcgaccaccagcaccgtgcgcggtgtcgtattctgacgcgctgtggtattgagcataaataaaccggttacctttcagcctgttgaccagttcagtcttccggcttcaagaatacaactcccagagccggaacggtgatcttcgccgagaacggacgtgaatgatattcgccctcgaccgcttcgaaggtgccgttgtggatgtcggagccgccgtacttggcgtcatcggtggtgaacacttcggtccacttgccgccggtgggcagcgccacctggtaatcggaccaggcctcaccggagaagttgaccaccacagccaaggtctcgcccttggtaccgatgcgcaggaagctcagcgtgttgtggtcggcatcgtcgctggtcagccactggaagccggccgggtcgaagtcctggctccatagtgccggatgcgccttgtagaaggcgttaaggtcggcgaccatggtctggacctgacggtgctcctgccagttcaggcaatcccaatcgatggaggcgtcgtgatcccactcgccccactgggccagctcgttgcccatgaaggagagcttcttgcctgggtgagcccactgataggcgaacatcgaacgcacgccggccagcttctgccagtcatcgcccggcatcttgccgtacagggaacccttgccgtacacgacttcgtcgtggctgatgggcaatacgtagtgttcggagtaggcgtacaccatggagaaggtgatctcgttgtggtgccacttgcggttgatgggctcctcgtgcagatactcgagggtgtcgtgcatccagcccatgttccacttcatgccgaagccgatgccgccggcggaagtgggggcggtgatgcccggccatgcggtggactcctcggcgatcaccatgacgccggggttgttcttgtacgcggtggcggtggcctccttgaggaagtcgatggcctccaggttctcgcgtccgccgtagatgttcgggcgccaatggccgggttcgcggctgtagtcgaggtagagcatggagctgacggcatccacgcgcagtgcatcgacgtgcaggtcctcaagccagaacagggcgttggccaccaggaagttgcgtacttcgcggcgtccgaagttgaacacataggtgccccattcagggtgttcgccgcgcagcgggtccgggtcctcgtacagcggggtgccgtcgaagcggccgagcgcgaaggcatccttcgggaagtgggcgggcacccagtccatgatcacgccgatgccggcctgatggaactggtcgaccaggtaacggaagtcgtcgggggaaccgagacgggagtcgaccgcatagtagccggtgacctgatagccccaggagccggagaacgggtgctgggccagtggcatgaactccacgtgggtgaagccttcctgcttgacgtagtccacgagctgcttggccaggtcgcggtaggtcagtccctgcctccagctgccggcgtgcacctcatagatggagaccgggccatcatgcgggttggtggtgcggcggtgctgcatccaggcgtcatcgttccacttgtaggtggattcggtgacgatggaggcggtgttcggcggaacttcgtgctgacgctccatcgggtcagccttcatctcccacgtgtaattggcgttcaggatctggaacttgtaggtctcgcccgcgccgattccggggatgaagatctcccacacgccggaggagccgagctcgcgcatggcatgacggcggccatcccaagcgttgaagttaccgactacgcgcacggcatgggcgttcggggcccacacggagaatgcggtgcctaccacctgttcgccgggcgtgccgtctgcgccgcccatcggatcgtcatagcgcagcacatgcgcgccaagcgtctcccagagcttctcgtgacggccctcgccgaacagataggtgtccatgtcgccgactgtgggcatatagcgatatgggtcgtcctcaatgagcactgcgccgctttcccactcggtcctgacacggtagtcgggaatcgtgggctgcttcttagtgccggaagccggcacggtaaccacgaacacgccgttgtattcgtgggtcatcgggtattcgccatcctgggtgaggatggtcacggacttggcaagcggacgcagcacgcggattgtggcggtgtcggcatgcttgccgatgccgagatgcccgccgagaactccgtgggggttgtagaattcagcattgctcgtcgcatcgaggtcgccttgggcgacaggcacggtgacggtatcttccttgatcttcgtttctttagccatgtcccaaagtctacgtgcgttgaagtcgaaaacgctacattggcgcgttgaaaatggcgaattcttgcccttttcgttgtgtttccgtggttgtgagcgctctcataggggtggtccagaccgcatggcataattattcgagttttcgtgtgtaagccgtcagttctcggagggtacatgtcttacaaagtcggcgatatggtcgtctatccgcgtcatggtgcagcgaaggtggaggccattaccgagcggacggtcaagggagtgacgcgcgaatatctgcagttgtccgtactctcttccgatggtttggtcatcaacgttcccgtggacaatgccaagaaggtcggtgtgcgtgacatcgtctccgcatccgaagtggccaaggtgttcggcatcctgcggaccccgatcatcgagaaagagatgaactggtctcgccgttacaagctgaacgtcgaaaagatcgccaccggcgatgtcaacaagatcgccgaagtggttcgcgatctcgcccagcgcgatgtcgacgagcacggcctgtccgcgggcgagaagcgcatgctcaccaaggcccgtgccattctgacttctgagatcgccttgtccgagaagatcgacgaggcggaagcccagcgtctgctcgacgtgaatctgggctacgagcccgctcagcccggtgacgacaagcatcacaccgccgagcccgaagaggccgcggccgatactttggctcgtgttgaagccgagaagaagtccaagaagaagtgatttgattgttttgaggccccggtcgtgtccttatgcgatgcgccggggcttcgtgattcataatcgtttgctgccgttcgtctgggcaacgccatcgaaggggactgcatggggtctgtaggagtgctgatagggcaaggttttgacgctcaccgttttgcgcctgctggctcaggccgtgaactgtggattgccgggctctactggccggtgcctgattcatgcagcgaggccgatgccgccaaatacgaggggatcgaaggcgattccgatggcgatgtggccgcgcacgctctgattgacgcgttgcttgccgccgcccgattgggagacattggttcactgttcggtgtcggtgcggacgcgcatggtgccggaatgcatggcatcgatatgttgcaagaagttgtggcgcatctggcatccaacgggtatacgccggcatcggcctcggtggcgatcatcggcaaccgcccgaaaatcggcacacgccgtgctgaagccgaagccgccctgtctgcggcggttggttgcccggtatcggttactgccaccaccaccgaccatatgggattcactggccgcggcgaaggcatcgccgccatcgccaatgccttggtggagaagatataacaaagcccccgctatgaattcgccagcgggggcaagaaaaaatggatgagattacttccgcatcgtctccacggctttggcgatagcccagaacagggtggaaagcgtcacgatgatgaagctcgggggagcggggaacatcgccgacagcacgagtccggcccaaatcgacaccaagcacagcacgctggcgatcaccattgccttgaatggggagccggccagaatattggcggtggccgcgggcgtaatcaccagtgcgaaaatcagcaaggtgcccactgccggcacggcgatggtgatcacaccggccataatcgccataaacgccacgttcatcagcccgatcggcacacccttggcctgtgccacctgctcatccagcgagctgaacagcagcgggcggtagatgatggccaacaatgccagcagcagtacgtcgaacacggcgaagccgatgatctggccggtggtgatggtcaggatcgagccgaagaggatcgactgcatctgctgggaggcggaactcgacaatcgcgcgaagaacagacccaagccggtggcgaaggccagcacggtgccggtggcgatttcacgctcggaaacgcgcttgcccaaagcaccgatcaccagtgcgccgcccagtgcgaacacgcccatgcccagtgacacgggcaggccgagcaacaccgcgccggtcgcgcccggcagaccgatatgggccagcgcatgggccgcgaaggtggaacgacgggcgatggtgaagtatcccatgacaccggcggctagggcaatgcacaggccggcgatgaaggcgttggtcatgaatggagcggacagtgtatccagccattcgggatcatacgaaaagttgatggtgctcatgtctctgtattttctccatgcctgagctgcagtccgttgatgggctgtgggtcggctcgcttgatgttatcgattctcggcgctgatggcggcactgccattggtggcattgccgtgctcgtgatggtgcaattgcgccacttcggctgccgtgtgcatatcctgcggctggtcctggagctcatccggcgtcggggtcacgaacatgtctccctgcggagtggtgaccacctgcacctgtgtgccgtagaggtgggtgagtaggtcggagtcgagcactttgtgcatatcggcgtagtgcgggtgaccgtcgagcaagtagacggcaccggtcagaatcggcaagagcatattgagatcgtgcgcaaccacctggatggtcatgttcagttcgcggttcagcttggccagcacgtgtacggtggcgcgctgactggccagatcgaggttggccaacggctcgtcaagcatcagcagttgtgggtcgcacaccaacgcctgggcgatggccacacgctggcgcaaaccgccggacagttcggacagacggtaccgcgccttgtcggcgatgccggtgaactccatcgcctcgagcgctttggctttctgggccttggtgatggggtggatgccgaatcgggtgccggtcaggcccagcaacacggattgttcggcggtgagattggaatcgacattcgccacatagctctgcggcacatatccgatgcgtttgttcatctcgcctgcgggcttgcccagcacggtcaggctgccatgacagagcggcaaaaggcccagctcggccctcatcatcgtggttttgccggtgccgttggtgccgacgatggccgtgaccgaaccggtgggaatggcgaaggtgccatgctgccagatgatatggtcgccacgcttgatggcggcatcgctgaacacgatgcaatcggaagtttcactcataacgcccgattgtggcaaacgatgctgacaatcgttctcaatatcgtgtacggatggtgataaccaaagagaagggttgtgcggccatctcgacaatggtcgcacaacccttctcatgcaaggcgtctattggcattggcacgaatccgatgccggtgtcctttgcttctaactatttgccggagtcggtctggtcgttgccggaggcatcgccggaatcgccattggcggcatcggcctttgccgaatcctgagatgagtcactggatgcggccgccttgcactgacggatgtacttggggtccgtgctggaaccggtgctggccttggagtcttgcgcattggcatcatccgtggcggagccttcggcgctggaatcatcggaattcgcgttgctgtccgcggtatcgccgtccgtggcgtcttcacagccatagcttggatccaccgcgtcgatgatggtgttgatgagctggttgatccaggcgttcagcgtgtcggcgtccttgggcatttgttcggagacgtcgactaccggcacatcggcgcgaccggcagcgccagtgatcatattggtcgcgtcactggcttcctgcgtgttgttgaccagcacatccacgcccttgtcttcgatgagtttctggaaagactgcaggtccgcgggtgccggttcgccgccggaagcggtcgattgcgtataccccttgggcgtctgatctttgaacccaagatcggccatcagataatagaccacgggttcggtggctgcataggtgaggttggagtgggacttggtgaactcggacgcccatgtttccaacgatttctcgtccgcctgccatgccttgagccgcttctggaaggccttcttcttgctggggagtgcctttatatatgcatcggtgatggccgtggccatgctggatcgagcgtctttggagaaccacagatgcgggttatcgccctcgacggcacccatgacggaagcggcggatacgatattcgtggtcttggtcatcgatttggtggcccaggaatcgtagcccgcaccgttggccacgatgatttgggccttggacagcttggcgacatccgaggtctttggctcgaaatcgtgggcatccacattggtggagttcacgatggacgtgacttccacatcatcgccgcccagctcggcagccagcgagccccattgattgagggagaccaccacattgatcggcccggtcggtgcgggaacgctggtcttgttgtccggctcggtttcagcgggggaggtggctgcgcatgcggtggtcgcgaacaacaggacggcgctcaggccggctgcggcgagtcgcgtaagtcgtgtgatttgagtccccatggcacgccttcttcgtgagagcgaacgatatataatcctgacttgttccaacgatagcctatcgtttcgatagaatgcaccgaaactacaggggagggcgttgatgtccacaaaaatcgacggtaagcagattgcggccgaaatcaagaccaaccttgccgagcgagtgaacaagctcaaggcgcagggcatccaaccggggctgggcacgctgctggtgggcgaggaccccgggtcgatgaagtacgtggccggcaagcacgccgattgccaggaagtgggcattacctcagtcaagaaggaactgccggcggacgccagcttcgacgacatcgccgctgccgtacgcgaactcaacgaagatccggcctgcaccgggttcatcgtccagctgccgttgcccaagggcatcaacgagaacgcgatcatcgacatgatcgacccggccaaggatgccgacggcatgcacccgtacaacctcggcgaactggtgctgcatgtgcgcggcgacatttcgacgccgctgccttgcactccgcgcggtgtgctcgagctactcgacgcctatgacattgatctgaacggcaaggaagtgtgcgtgcttggccgcggcatcaccattggccgcacgattggcctaatgctcacgcgcaacgccgtcaacgccaccgtcaccctgtgccacaccggtacccgggatgtggccgaccacatgcgccgcgccgacgtgatcgttgccgcaatgggttcggctggattcgtgacgcccgacaaaatcaaggacggcgccgtgctggtcgacgtgggcgtcagccgcgtctacgacgaagaagccggtcgctaccgcatcaagggcgacgtggacaaggcctgctacgacaaggcctccgcctacacccccaaccccggaggcgtgggccccatgacccgagccatgctcctagccaacgtcgtggaaatggccgaacgacacgcctagagtttcctaggaaatttgggcagagttgcttgtattgtgagtatctgtatgcctgtagggtgtgcgtataactgaatatcgagaaattatccatccactattagaaaccatatatttacatggcagagaacaacactgaagtcaccaaggttgccatcaacgacatcggcaccgaagaggacttcatcaaggcagtcgattccaccatcaagaacttcgatgatggtgatctggttgagggcaccgtcgtcaagatcgatcacgacgaagtcctcctggacatcggctacaagaccgagggtgtcatcccctcccgcgagctttccatcaagaaggacgttgatcctgacgaagtcgtcgaggtcggcgacaccatcgaggcccttgtcgtcaccaaggaagacaaggaaggccgtctgattctgtccaagaagcgtgcccagtacgagcgcgcctggggcgacatcgagaagatcaaggaagctgacggcgtcgttgagggcaccgtcatcgaagccgtcaagggcggtctcatcgtcgacatcggtctgcgtggcttcctgcctgcctccctcgttgagatgcgtcgcgtccgcgacctctccccgtacatcggccagaagatcaaggccaagatccttgagctcgacaagaaccgcaacaacgtggtcctgtcccgtcgccagtacctcgaggagacccagtccgaggtccgcgagaccttcctgtcccagctcaagaagggccagatccgtgagggcgtggtgtcctccatcgttaacttcggcgctttcgtcgatctcggcggtgttgacggcctgatccacgtttccgagctgtcctggaagcacatcgaccacccgtctgaggtcgtcaaggtcggcgacaaggtcaccgtcgaggtgctcgacgtcgatctcgaccgtgagcgtatctccctgtccctgaaggcgactcaggaggatccgtggcagcgcttcgctcgcacccacgttcccggccagatcgtcaagggcaaggtcaccaagatcgtccagttcggtgtcttcatctccgtcgaggacggcatcgagggcctggtgcacatctccgagctcgccaaccgtcacgtcgagaacccggagaccgtggtcaagccgggcgagaccgtgttcgtcaaggtgatcgacgtcgacctcgatcgtcgccgcatctccctgtccctcaagcaggccaacgactccgttgacccggcttccgaggacttcgatccggccatctacggcatgccggccgagtacgacgagcagggcaactacaagtaccccgaaggcttcgacccgaacaccaacgagtggatcgctggttacgagaagcagcgcgaggagtgggagtctcagtacgccgccgctcacgagctgtgggaggagcacaaggagttcgtggccaaggagctggagaacgctgccgaatccgcagccgccgacggccagggcccgaaggaagagaagccggtcgaggagacctccaactactcttccgctgctccggctaccggtaccctcgccgactccgatcagctcgccgccctgcgcgaccagctgctcggcaagtgagtttgccgcgaagctagcgcttagcgtgtaaagaaacccggtccgattgggccgggtttcttgtgtttttggagttatccgccaatgactcccctcagtctcgctacgcgagccggctcccctccctgaggggagctgtcggcgatagccggccgaggggagcgccagctatcatgggcaccatgatgcgaataggactgaccggcggcatcgccgcgggcaaaagtacggtggcggcgcgactcaagcaactcggcgcgttgcatatcgactacgatgcgctggcgcatcagatcgtcgaacccgggggagtggcgctgccacagatcgtcgccgagttcggtcctgatgcattgctcgccgatggcactatgaaccggccatggattgccgatcatgtcttcggcgcgaacgccgcgccgggcgcacgtgaacggctcgacgccatcgagcacccattgatctatgccgaggcggcgcgactggagcatgagcaccccgaggcagccatcatcattcacgacattccactgctcgccgaggtcattgacgatattccattcgcctttgaccatatcgtcacggtcgaagctcccgtgtgcatgcggctcgaccgtatggtcgaggaacgcggcatgagcctggaacaggccgaggcccgcatccgccaccaatccagtgaggaggagcggcgggccatagccgatatcgtcatcgactccacccatccattgcccgagatgctggcccaagtgggtgagatatacgcaggatggtgcgcaggtcgctaagatgaggccctatgggattcaatatcgagcgcgcggacaagcctttcgtcgtcaaatcgccatataagccatccggcgaccagccgcaggccatcgccgaactggccgaacgcatcgaaaacggcgagaatgatgtggttcttatgggtgccaccggtaccggcaaaaccgcaaccaccgcctggctgatcgaaaagctgcagcgaccgaccctgattatcgagcccaacaagacgctcgctgcgcagctatgcgccgaattccgcgaactcatgccggacaacgccgtgagctacttcgtgagctactacgactactaccagcccgaggcatacatcccgcagaccgacacctatatagaaaaggactccaacatcaacgacgatgtggagcgcctgcgccaccaagccaccgcaaacctgctgacccgccgcgactgcgtggttgtggccaccgtctcctgcatctacggcttgggcacgccggaagaatacgccggtcgcatgctcttcctcaaagtcgggcaggaaatcaaccgcgacgacctgctgcgccaattcgtggccatgcagtacaagcgcaacgacatcgccttcacgcgcggcaccttccgcgtgcgcggcgatacggtcgaaatcatccccgtctacgaggaactggccgtgcgcatcgaattcttcggcgacgagattgaccgcatctccacgctgcacccgctgaccggcgacgagatcgacgaggaaaacgaagtccacatcttcccggcctcccattatgtggccggccccgaacgcatggaacgggcgctcaaaaccattcgcgaggaactcgacgaacgcctggcagaactgcgcaaacaaggcaaggagctggaagcgcagcgcctcaacatgcgcaccacctacgatctggaaatgctcacccaagttggcgtgtgctcaggcgtcgaaaactattcgcgccactttgacggccgcgccgctggcaccccgccgcacacgctgctcgacttcttccctgacgacttcctgctggtcatcgacgaatcacacgtcactgtgccgcagatcggtgccatgtacgagggcgatgcctcccgcaagcgcacgctggtcgaacacggcttccgcctgccctccgcgatggacaaccgaccactcaaatggccggaattcctgcagcgcgtcggccagaccgtgtacctgtccgccacgccaggcgactatgagatgggactgtccgatggggtggtcgaacagattatccgcccaaccggtctgctggacccgaagatcgacgtacgcccggtcaaggggcagatcgacgatctgctcgccgagatcaaggcccgtgtggccaagaacgagcgcgcgctggtcaccactctgaccaagaagatggccgaggacttgaccgactatctgctggaacgcggcatcaaggtcgaatacctgcattctgatgtggatacgttgcgccgcgtcgaactgctgcgcatgttgcgcgaaggcaagatcgatgtgattgtcggtatcaacctgctgcgtgagggcctcgatttgccggaagtatcgctggtggcgattcttgacgccgacaaggaaggattcctgcgctcctatcgttcgctcatccagaccatcggccgtgcggcccgaaacgtgtccggcacggtgatcatgtacgccgacgagaccaccgaagccatgcggcaagccatcgacgagactgaccgtcgccgcgccaagcagattgcctacaaccaggagcatggcatcgatcccaagcccctgatcaagaagatcagcgacgtcaacgacatgctcgccaaggaggatgtggacacccagaccttgcttgaaggtggctaccgcaacgcgggcaaggccggcaacacgcacctgggcgtgccggtactcgatcccaacgaggcagacaaacgccacgaggagatcctgaaggccggcctgcccgcgcaggacctcgccgacctgattcgccaactgagcgaacagatgcacaccgccgccgaacaactccagttcgaacttgcggcccgtctgcgcgacgagatccgagacctcaaaaaagaactccgtcaaatgacggaagccaacaagtaaccaaattcccatacccgaggcgggcagtcaggggatgcgttgtcgaccgtaaagacttggcctgagcggcccggagcgtgtcgaacaacacatcccctgactgcctggcgatcagcgctaccggaacggccccaaaaccgtcacatacataagttagtgtagggaatcatggcagaaaccccactcgcatttgaaatcatcaccttcgtggtgctcgcgttgttctttatcgtcgacctgttcgtcatcgggcgtcgaccgcatgtgccctccaccaaggaatgcgtgcagcatatcgccttcttcgtggttatggcgctgatcttcggcggatgcatctggttcttcgccggctccaagcctgccatcgagttctattccggctggctcaccgaatactcgttgtccatcgacaacctattcgtgttcgtcattatcatgtcgaacttcgcggtgcccaagcagattcagaagtatgtgctgtccatcggcatcaccattgctttgattttccgtggcattttcattctgatcggcgcggccctgatctcccgcttcacgtgggtgttcttcctgttcggtgccttcctgatctacaccgccgtcaaactggtgctcggcggcgatgaagatgaggaatatcacgagaacggcatcatccgtaatctgcgcaagatcatcaagattaccgacgactacgacggcgagaagctgcgcaccaccaagaacggcgtgcgttactggaccccgatgctcatcgtgttcctgaccatcggcaccaccgacgtcatgttcgctttcgactcgattcccgcgatcttcggcctgaccaaggatccgttcctggtgttcacctccaacgtgttcgcactgctcggcctgcagcagctgtacttcctgctgggtgctctgctcgacaagctcgtctacctgcctgccggcctgtccgtggtgctgggcttcatcggcgtcaagctcatcatggaggccctgcacggcaataccttgccgttcatcaacggcggcgaaggcgtccattgggtgccggaggtgcccacatggctgtcgctggctgtgattgtgctcgcaattggcggcgcatccgtggcttccgtgatcaagatgaagagcatggaaagcgctgaaaaggcctgaaatcgttagagaatacaacccttaaacccagtcaacacaacaatgtgagcgctcacaacacaccgtgaagaaaacttgtcatgagtcggctcgcgctagtagactgggtttcggcaaatggggcaatcgcgcctcgaaccaaattgaacaagaataggcaggcattcatgcgtaaagccaagatcgtagacaccatcggtccttccaccgaggattacgacaacctcctgaagctcgttgaagctggtatggacgttgctcgtctgaaccgctcccacggcacccccgaggatcacctcaaggtctacaacaacgtgcgcaaggccagcgaagccactggtcgcaacgttgccgcgctcgttgatttgcagggcccgaagattcgctgcggttggttcaagaagaacgccgatggcgaagacaaggttcagctgcagctcggccaggaattcgtcatcaccactgatgacgtcgagggcgacgagcacatcacctccaccaccttcaagggcctgccgggcgattgccacccgggcgacccgatcctgatcgatgacggcaaggtccgtcttgaggtcaccaaggtcgagggcaacaacgtgtacaccaaggtcgtcgtggccggtcctgtgtcctcccacaagggcatcaacctgccgggcgtcgccgtctccctgccggctctgaccgagaaggatgaggccgacctgcgttgggccatccgcaccggtgccgacatcatcgccatgtccttcgtgcgtttcgccaccgacatcgaccgcgcccacgagatcatggacgaggaaggccgtcgcatcccgatcattgccaagatcgagaagccgcaggctctggagaacctcgaagagatcgtcaagaccttcgacggcgtcatggccgcccgtggcgacatggccgttgagtgcccgctggaagaggtcccgctggccactaagcgcatcatcgagctggctcgccagtacgccaagccggtcatcgtggctaccgaagtcctcggctccatggtgaactccccggttccgactcgtgcagaggcttccgactgcgccaacgccatcctcgacggctccgacgccaccatgacctccaacgagaccgccgttggtaagtacccggatgtgaccgtggccaccatggcccgtatctccggctacgccaccgaccacggcttcgaccgcatcccggagctcaagaaccttgacatgtcctccaccggcgctgtctcctccgccgctgtggacctggccgacaagctcaacgccaaggccatcgttgcttacacccagaccggtgccaccgtgcaccgcgtctcccgtgagcgtccggccgccccgatctacggcctgaccagcaacgagcacacctaccactggctggctctgtcctggggcaccgaagccttcctgctcaaggaggactaccacgacaagtcccgcaaggatctcatggtctacacggacaaggtcctcaaggatgctggcaaggttgctgacggcgacaagatcgtcatcctgagctctgctcagggcgatcaccagccgggccgcactgactccatctacgtgcacaccgttggcgcttgcgactgatttcaggcttctggtagctgctgacagctagcatatagcacacgaaagcccccatccaaagtggatgggggctttcgttatctgttatgttgcgattgtgtggtgattgcaatggcccacagtcaccgcggtgatcgagcgtggcgatcagtcgttgagatgatcgagcgtgccgctcttcaggcgcaaaatggcgaccatggtcttggcatccacaatcgtgccattgaccaccatctcataggcatcgtccaccgacaccatacgcacgtcggaacgcggagtctccgggccgatttcctgacgggaagccggggtaagaccggtggcgaagaagattgcggtgtgctgggtggaatagctcggcgtgttcataaaacgggtgaactgcgtaagcttggtggcgtcgaaaccggcctcttcggccagcttgcgcttagctacatcggtcgggcgttcggacgggttgttggcgtgaccggccggaatctccaacgtccaacgatggttggcgatgcgatactgctcgaccagcggaatcatgccatcatcggtgacggccagcacagccacagtgtcgccattgttctcctgaacaaagtagcgttcaaacgaaccgatttgattcgactcataggagacgtgatcgacattgaaataatgcgtctccacaatctgtctacgggaaatctccttgaccggagaggggcgccagggatcgaactgacggtaagtttcgttgctcataagccctcctaacaaaagcgatacatcgaaactacagcccattgtaagcggtgaaaccacgcaggagaacgggcaacacacgggtgcgccgtccgcgatatcgacgtgtttcgcctgtttcaccggggggaatggaggattggcgcgtgtcttgtgtcgcaagagtcgaattggtatgctactctcttcagagtgctttggcacgccctcgtatcccaattggtagaggaagcagcctcaaaatctgcgcagtgtgggttcgagtcccaccgagggcactttagttaggagttcgctgaaattattgtgaaccccattgttgggtaattcaagaaagaggttggcatggctgcaaggaagaagtccgaagaaccgagtatcaacatcgatgaggtgctgaccgacgaagagctcaaggccgtggccaatgaaagcgaacctgctgagcgcaaggccaagcccgaggacggtccgcgtaccgttgtcgtggccgaggacgaagccgtgaaccgcatggatctggtcgccatgctggaagacaacggttatgaggtcgttggtcaggccgccaacggcgaggaagccgtggaactgacccgcaagtaccgccctgatgtggtgtgcatggatgtcaagatgccgcgtatggacggcatcaccgctgccggcattatctgcgatgaaaacatcgcccccgtcgtcatgctcaccgcattctcccagaccgatctggtgaagaaggccaccggcgctggcgccatggcatacgtcaccaagccgtacgaggaatccaagctgctgccgaccctcgaggtggccatgggccgtttcgccgagatcaacgatttgctggacagcgtggagcgcagcgaacgtaagctcaaggaaaccaccgatcagctcaaggaaaccgaagagaagctcaagaaggccgaagacacgcttgaggagcgcaagctcgtcgaccgcgccaagggtctgctgatggacaaggcggacttctccgagcagggtgccttccgttggattcagaagacctccatggaccagcgcatccccaagaagcgcctggctcaggccatcatcgccaagtacggcgatccgaagccttctgattcgggcgaacgctgattatcggcgtcgccgtactgagtcgtaaagcaacacaaacacactatgggagaggccagcgtgaccgtacccaccaatgaaacattgctggtggtggacggccactcgctggccttccgtgcatttttcgccctgccggtcgacaacttcagcacctccagcggccaggccaccaacgccgtctggggttttgccaccatgctcgcgcaggtgatcgatgcggagaagcccgaccatctgggcgtcgccttcgatgtgaagggcggcacattccgcaatgagatgcttccgcaatacaaaggcacccgtgaggcggctcccgaagagctgctcacccagctgccattgattcaacgcatgctcacggccctcggcgtcacctacatcgagaagccgggattcgaaggcgacgacgtgatcgccaccctcgccaccatgggagacaaggccggttaccacacactggtattgtccggtgaccgagacgctttccagctggtggatgacaacgtcaccgtgttgtacccgggccatcacttcaaagacctgaagcatatgacgccgcagtccatcatcgacaaatacaaagtcactcccgtacaatatccggatctggcggcactccgaggcgaaaccgccgacaatattcccggtgtgcccggcgtaggcgacggctttgcggccaagtggatcaaccaattcggttccctcgacggcatttgcgagcacgccgatgaaatcggcggcaaaaaaggcgaatcactgcgggccaatatcgaccaggtcaaactcaatcgcaaagtcaacgcactggtacgagacgtcgatctaggcgtcgatatcgaggatctgacattcggcaccgtggacgtggcacagatcgacgccctgttcaaggagcttgaattcggacctcgcaccaagagtcgtgtactgaaaaccttcaataccggggccaaggcatccaacacatccggagctggcgagtctacgaataatgagcagaacgagcaggatagcagcctcgatctgaacctgccggaacccacgagcatcactgctccggagcagttcgacgaatgggtcaaggcccatcgcgtcgaagtcaaggttcccggtgaaatcgccgatttcacggtttccgactatggcgatggctcgcagcggcatgccatctgcggcgacgcggtcggccacgcttggaccgtggccgcatggggcgacgaaaggccgggtcgtgccacggcacaagccattgccgtggccacggcaacatcagcggccatagtgccccttccaatcaccgataccctgcgagcacagcttgcgcggttcctgaaaagcgaacactcccgcaccatcgtgcatgggtataaagaattgctgcatcttttgggcgcggtcgatcttgacatggacctgccgatgttcgacaccaagcttgccgggtatctggcccaaccggatttccatgccgatagcctcaaacaggcggccgagcacttcctcgacatccacttcaccgaaaccgaacagccttcgcaaggcacattggacttcgacgacgatcaggtcgaagaagatccgaacgaacatcgtctgcgcgatttggccattatccgcagcctcgccgtcacgctcgggccgattatcgacgagcgtgaacaatgctggctgatgcgcgcgattgaacttcctgtttcccgcgtgctgcacggcatggagcgcacaggagccaaagtcgatagcgttcgactcgtttccatgcgtgaccagtttgccgccgaggctcgccaagcgcaggaaatggcttgggagtatgccggcaccgaaatcaacctgcaaagccccaagcagctgcagaaggtgctgttcgaagatatgggtttgaaacccaccaaacgcaccaagtccggctcatacaccacgaatgcggccgcattgcaggatctgtatgtcaagtcagtggacaatgagcgggccaacggtttcctcggagcgttgctgcgccatcgcgagatcaacaagctcaagcagatcgtccaaacgctgatcgatgccaccaacacatcagatgagcgcatccacaccactttcgagcaaaccgttgccgccaccggccgattgagctccgtggacccgaacctgcagaacatccccaatcggaacgccgccggccgcgagattcgtggcgtgttcgtgccgggggaggggtacgaggccctgatgagctgcgattactcacaggtcgagctgcgcattatggctgatctgtccgatgatgaggcgctgatcgaagcgttccgctccggagccgacttccacaaatacgtggcctcgatggtctacaagctgccggtcgaccagatcaccggcgaccagcgcagccacgtaaaagccatgagctacggattggcctatggcctgagcacgtatggtcttgcccagcaactcaagatcgcgccacgtgaagcggaagcgttgaaaaaccggtatttcgataccttcggcaaggtgcacgattaccttgaatcgctggtggccaatgcccgagagaaagggtatacggaaaccattttcggacggcgtcgctacttcccggccctgcattcgaccaatcgtgttgcgcgtgaggccgccgaacgcgcggcactcaacgcaccgattcagggatccgccgccgacatcatgaagattgcgatgattcgcgccgaacagaccttggccgaggctcacgtcaagagccgtatcattctgcagattcacgatgaactggtagtggaaatcgcgccgggagaaggcgaccaggtcaccgaactggtgcgcaacgccatggagcacgccgtcgaccttgccgtgccgctggacgtatcgtgcggcatcggttccgactggcaactcgctgcacactgacaatttctagctcccctcgggtgagggggctgagccgttgagcaaacagtccagtggattgtttgtaggcgaaggcgagccgatagtcgagcaatgaagagcacgagcatggcttgtccgcaattgcagaatgagtcccttgccgcaatagcccactacaatgggacatatgccgaatctcaagcaagtcatcgacgttctcgagaccctgtacccattgcgctacgccgaagaatgggatgagccgggcctcattgtcggagatctgagccacgacgtgcaccgcatcgtgttcgccgccgacccgacctccgccatcattgacaaggccatcgctactggcgcggacctgctcatcacccatcacccgttgttcttccgttccgtacacgagacgagcggactcggtttccggggcgacatcgtccgcagactctaccagcacggctgcgggctgtgggtagggcacactaatgccgacgctgcgtatcgcggcgtgggacaggcggcggccgactacttcggactcatcgaccagaaaccactcgtgccgattgacgatgcaaacgcctctcatccggtcggcttggggcgtgtgggtcgtttgccgaagcctgttgccctgaaggatttcgctcagcgtgtattcgacgaagtgtccgatcatggcatgaccaccgcgctcggcatccaggtatgcggcgattcggacacttttgttcagtatgtggccattctgcctggctccggggactccctgttcaacgaggtgcgtgccaccggtgcggacgtgtacgtaaccagcgatttgcgtcaccacccggtgaccgacgccatcgaacaagcccggtatgaagcccgtatgaggtcccaaggcatcatgctcggccatggaatggcgggggagagccatgtgcgtccctgcttcatcaacacccctcatgccgccatcgaatccatgtggttcaactacgcgatcgatgacgtgccagccgccatcgaacaagcgaccggagcaaggcctgaagtcgagtggttccacgacacgaccgatccatggacgctgtccattaccgcgcatcgagattaagacgctatagtaacgtggcaaaaacgttttttccgaggagatgacatgtttggcggaagcaagcaggaacaactggagcatcggctcgaccataagctgaacgcctcctcggacggcatcgacatggacgtgcccgccaaagtgatcagtagcgaaaccgtttataccgggcgtatcttccatgtggacgacatgcgcatcgctctgaccgacaagcagggcaaggaacacgagatcggccgccaggtgctgcgtcacgccccctgtgtggtcatgctcgtgcacgacatgtccaccgaccgctacctcatcgaacgcgaataccgcgccggatcggacatgttcgcctacgggcttcccgccggactgatggacgagggcgaggacatcatggacgcggccctgagggaactggccgaggaaaccggcgtggtgccggaccgtgacaccatgggcgttgacttcgtaggtgatttctactcgtccgaaggcatgaccgacgaactggcccacatcatggtgttgcatttgggcccgttcaggcgggagcagcgccatttcgatgcggacgagcatgtggaatccgcgtggattccgtggagcgaccttgccgccacgcgcatcacctcatccaattcgatgatcgccatccagcatgaggcgttacgcagactcatcgccaggaactccgacaaagataagccgtcgctgttctcctgacgttcaactccccggcacatcactgacacaaaaaaagtgggatactgaaaactatgcagatcagacctggatcaatgtatccgctgggcgccagctatgacggcgccggtgtgaacttcgcgctgtactcacaggttgcgcagaaagtcgaactatgcctgttcgacgagcacgatgtggaaacacgcatcgaaatgaccgaacggaactcgtacgtatggcataactacattcccggcctccatcctggccagcgttacggctaccgcgtctacggtccctatgacccggtgcacggcctcagatgcaaccccaacaaactgctgcttgacccgtatgccaaggccattgaaggtaatatcgacggcgacgaaagcctgttctcatactggttcaagagcccggacgacaactcggcgatgaacgaccttgactcggccgcccacaccatgaagtcggccgtcatcaacccctacttcgattggggcaacgaccagcatccgtacatctcgtaccacgattcggtgatctacgaggcgcacgtgcgcggcatgaccaacctcaacatggacgtgccgccggacatccgcggcacctacgccggcctggcctatccgagcgtcatcgaatacctgaagaagctcggcatcaccgccatcgaactcatgccgatccaccagttcgtcaacgactccttcctgcaggagaagggcctgtcgaactactggggctacaacaccatcggcttcttcgcgccgcacaacgcctactcctcctccggggaacgcggcgagcaggtcaacgaattcaagtccatggtcaaggcctaccatcgcgccggcatggaagtcatcctcgacgtggtgtacaaccacaccgccgaaggcaaccatatgggccccaccctgagcttcaagggcatcgacaacgcctcctactaccgactggtggaaggcgaccagcagcactacttcgacaccaccggcactggcaactcgctgctcatgcgctcgccgcacgcgctgcagttgattaccgattcgctgcgctactgggttactgaaatgcacgtcgacggcttccgcttcgatctggccgccacgctggcacgccagttccaggaggtcgacaagctgtccgcgttcttcgacatcgtggagcaggacccgatcatctcgcgcgtcaagctcatcgccgaaccgtgggatctgggctccggcggctatcaggtgggcggcttcccgtccagctggtccgaatggaatggccgctaccgcgacaccgtgcgcgacttctggcgctcgcagccctccacgttgcccgaattcgcctcgcgcttgatgggcagctccgacctgtatcaggtcaacggccgccgaccggtggcgtccgtgaacttcatcaccgcgcatgatggtttcacaatgaacgacctggtcagctacaacgaaaagcacaacgaagccaatggcgagggcaatcgcgacggcgagagcaacaatcgctcttggaattgcggcgttgaaggcccgaccaatattccggacgtcaacgacttgcgtcagcgtcagatgcgcaacatgttcgccacgttgctgttcagccagggtatcccgatgatttgcggtggcgacgaagtggcccgcacccagcagggcaacaacaacgcctactgtcaggacaacgagatctcctggaccaactggcatcttgacaaaggacgcaaggaactgctcgccttcgtttccaaactcattcatctgcgtttggatcatccggtgttgcaccgccgtcgcttcttcaccggccgtgagcccggcgacgattcgaacacgattccgcaggtcgaatggttcgaccacaccggctcgatcatggatatggacgactggcagaacacgcatgcgttctccatgatgatctatctgaacggttcggatatcccggaggtcgactggtacggcaaccggatggtcgacaatgacttcatcctgatcttcaacgcgcattacgagccgattatgttcaccctgccggatgagcgatacggccgcaaatggcagctggtcgtggatacgcacaacccgaatgagccggcgctgagctatgaggcgggcttcatgatcaccgcccagtcccgcagcttcctcatgctcatgagcgccaaaaagcccaagaagcccatgggcctataaccagaccgaatttaagctccctctgacgagggagctcccggtgtagccgggtgagggagagaccgcagcaaagccgcgaacccctactcgcgccccttacgctcctccacgagccgagcatcgacatgattcggctgatcagcacccgttttgaggtgccgatggcggaatcctgccatatcagcgtcgaacaggccgaggactgcatgtcggcgctgctgccaaacctcaagcggtggcggcgtcaggacgagatcgatgcggtggcagaggggaaatgagcgatggcattcgactataaaaaggaatataaggacctgtatcagccgaagaggatgcccgccatcgtcacggtgccggcgatgcggttcgtcgcggtggacggtgtaggagatccgaacgaagaaggcggcgattacgccaaggcgatgcaactgctttacggcatttcgttcaccgtcaaaatgagcaagaagtcaaagaacccggccgagcacattgacgggtacttcgactacaccgtgcctccgctggagggcttatggagcatgggggagggtgtgtccggcgtcgattacgcgcacaaagccgacttctattggacttcgatgattcgtctgccggaattcgtgaccgatgaggtctttgcgtgggccaaggcatcgtttgcctccaagcatcccgaagtcgacatcaatcgtgcatatctcttcgatttcgatgaaggcgtggtcgcgcaggtcatgcacaagggcccgtacgacgacgagcccgcaaccgtggcgattctggacggctacgcgcgttcgcaaggctacgggctcgacttctccgacgcccgccgccatcacgagatctacctatccgatccgcgccgagcaaaaccggaaaatctcaaaaccgtcatccgtcatccggtagtgaaggtgggttgactttcggcgaactgctcgaagcgctcaccgcgcagtagcgtgaacaatctgccggaatccttaccggggtcaaagagcgctaccaagaactcgataagcaaaataactagaagcactggttcctctcggagagattctgcccgagcgaccttataaatccttgcgcgggtcatctttcccggtgcaggaagcatccaggctcatgtgcattgatgacgccgatggattgcagataggcgtagacgatggtggtgccgatgaatcgcatgccgtacgtcttgagatccgctgcgatggcgtcggacagaggggatgtagtcatgcctgtctcgtagatgacgtgacggccggtgaaccgccaaatatagtcgtcgaaactgccgtacgacgtctggatatcccggaatgcgttggcattaccgaccgtcgcgacgattttgcgacggttgcggatgatgcccggatcgttcatgagttcggcgatcttgttctcgtcatagcgccggatccgttcgatgtcgaacccctcgaacgcctgacggaaacgttcgcgtttgttcagtaccgtctcccatgacagtccggcctgaaaggtttcgagcaccagcatttcaaagagatgatggtcatcgtgcgaaggaactgaccactcagcatcgtgataggcaacatagacgggattgctgaggttgcaccagccgcaacgtggtcttatatcgtccatgtgctctccctatgggtcgttggagacggtcggttttagatgttgattcgatgtgtgatccagtataaacggtgtgttcggatagcggtctggatgtgcggattgtctgaaccatatttgccggattgcgggtataaaggggttagttactgcggttgcgggtatttcggtactagttaggggtgattctgggctgtaactcgacaccttttacctgcaacccactcccgcccacgggattgcacaatcggttgcaggtattttggtgtcatttgagattgggaagcggaaatcgatgtcgcatggaatcgaactgactagcaggtggggtcccaacatcacaaaagtcccttagaccgcaaggccatataggttctacggtcatcagataaaatcggataaatcgtttagcagccggataaaagaagaagcccagaatcgttgagattccaggcttttttgtttgtcgggctagcgggatttgaaccggcgacatcctgttttcgcagggtgtttctttgttgggttgaatagctttcgttgagtccaatatcgttggaaaatggcggttcttgatttttggctgtctttgttgagccgactgggattggctcaccgtgatggtcattgttactggttttttactggaatcgaccatcacgatggcagtggcgctcggcgtgtcgaaacaatgtctcgaacttgaatcacagcgggtaaaaatcgtcaacgcaagacagttgcaacgacttagaagctacgctcagaaatcccctaacaggtccttccagatcatgcccgtcgttcggcttcaggccaagccgattcaccttctcgcgcaacttatcgagtagtacgggtcgccgagctcttccagagtgggagtatcgttggtcagcttgataagctcttcggcatcctctggccaaagcatgcgtgcatccataaaacccttcaaggcagaatgcattctctgggtccaagtttggatcgtcgggatcaagataattggggacagataggtcgtttatatcgttttccttactggacatatagttgattcagtgacgctcaagacggaactatctagcccaactcctgcgtaagagttccttcggggaaaagtatgtcttcaggaagcacacgaccccctatgccgaagactctccacccctgctcttgagaaaaagtcaaggtaaccgctgcggccgcattaattgtcattcctctgccttcggctttcttgccctgaagcgattcatcggcgacaagtaaaatgaccgcaacatgaggagctggaaagcgagcattggaagtcggcacacagttcccgtaatcgcgcttgagttcatcccaatccaccttttcccagccagttgcctggggagaaatcaatgctcgcatagcttctccattcggatccttgttaagcgtgttaagaaacattaggcaaacagccatggaattgaacggagtgaagtcttctccttttacaggtaactcatcatcttgctggtctacccaatgaggtttttccttactgcaatcccttaacttcccatcaatattgcgttcccataccctaccgttgggatcgacaaaggtgcaagcgacttgcggcgtatccatatgccgatagccaagcatcggaatcgtgatgtcgaattgcaactctcgatgggctggaagaacccgtattatgtcaggtgccgagagcggcccaagccagtgcttcccattgtcaagcgttgtattcacctcaacgtcatagaccggttcgtcgctttcattgtttacgtgaataatgactttgcggacgtaagcagtaccatctgcattcggtttgctgtcttctgagatccaggaagacaccatcttggctacagcccagcgcttctctctggtctccttaagattcaggccgaataaggcaacggtggtagcacctatagtgccaatcgcttccaagcaagtccagaagtcccattgccaattaaaagaaatgagcaagtgcttgacggagatgattcccgtgcacatcagaatagcaaagacgccaatgcacatgagtgcggcagccacaagaattccaacgacagtaaggcatacggttaaagcgattgacttgcggcgattcttatcttccatctctgtgccttacttgaagcgtgtatacttatgcccctgctgatgcactatactcgcagagctagaggcgaagtcacgcactatcaacgcagggttgtagattgacgtcggaaaccgattaaacagtcccatagagtagaaggatgaacatgccagaccagcagcaagaacaaacatggaagcccactgtgccacccagccatgttgatccagagaatcaggtgcatatcgtgcagcattccatggatccgagtcattttcacaccgcgtaaggcatttcggcatgtccaagaatatggcatcatccgactcggcggaggaaccgaatcctgaagataccgatcagccaagagacgaggcggaagtcattacatctctggagtatgtgctagctgaggccaatcgccaacaggattatcgtcgtcatcaagtcgatacatctgtgcagctcagcatgcaactgataggatttgcctcccttacctctccattcaccgctctggcggcagtacacgtagagtgcttaaagtacgttgcgctgtttttcttgttcggtgctgtggcaatcggtttgattgatatattcaatccatctcgaagcgaagacgaacttcctctcaggaagttgcgtgatgaagcctgtataaagagcatgcagtctgtgcttctctatcaaatcgacaataaagtggaaaacgagaaaagggcgcgcgccgacgaagataagcgcatacattgggtcaagtgcggatacatgcttctagctatggcagtgctgtgcactgtgctctccgtcatcgattacgattcagccgctaactggattcagcaagcactttgattagcttccatacagagaagtacatgtcactgtgcgtcaaagcgataacgagaccacattttgatatgaactgattcttgttccgcatttcccctaacttgatgggagatgatggaaccatggcaaagggcacgagatatacgccggagttcaaggcgaaggccgtcaggctgctgacggagtccaggccgtcgtattcgtcggagacgaaggcgatcgaacaggtctccaaggatctggggatagagccggaatcgctcaggcggtggcgcaaccagtcggacgcgacggccgccgcggagacggaacgggccgcgcgggatgcgatggcggagctcaaacagctgcgggcggagaacgcggagctgcgccgggcgaacgagattctgacgacggcttcggcttttttcgcagcacggctcgacccgacacggcgttgaaggccgcgtacatcgacgaacacaaagggcgtttcggggtcgggccgatctgcagggtcctgggcaaatcgctggattgcgggttcctcacgccgcgcggctaccgcatgttcaggaaccggccgccaagccggatgtcgcccgccacgaggctttggcgcgcgacatcctcgagatccattcggatttcctcatggccgtgtacgggtacaggaaggtccacgcccagttgttggcgcagggctgggatccggccgaggtcggccgcgaccaggtgatgaacatcatgcgcgggctcggcatacggggcgtcaggcgtggaaagacgcccgtcgccaccaagcccgcgaagggcacggacggcaggcccgacctgatggaccgcaagttcgaggccggggcgccgaaccggccgcacgtggccacatcacctacgtgcgcatggccgacgggcgcttcgcgtataccgcattcgtcaccgacgtgttcgtcaggcggatcgtgggctgggcgtgcgtcaccaccatgaacacggaggagctgcccctgcaggcgttggagcaggcgatcgcctgggccgcgtcgcatggcgggaccgacggtctcgtccgccacggcgattaagccgggtttgttgttaagccggggaacggttcggggtcttggtggctggccgtgtcccatgtggtttcccggcttaacgttccgggttatttgagggtgtgtagttgtcggagtcgttgctcgctgagccatgtctccttggaggggtcggggccggggttggccgcatcgacggctttgcgcatcatgtcgagggtcgcgaacgcgtagaacgcgctggttgtgctcatgctttcgtggccgagcagttgcatgatgagcggtagcggcacgccctgttggtagaggtccatggcgcgggtccggcggatcaggtggcagtggacgcgttcgggcatggacgggcacgtcccgcggcgtgctctggccgccgcggttttgaggatctcgtcgatccggtccacggagagcggctggatggcgccgttcctcgtcgagtggaacaacggcctgtcgccgtcgcgcatggacggtccgggatggaattcctcgaggtaggcggccaggtgggttcgtgtcctttctcccaggggcacgacccggctcttgccgcgtttgccggtgagcgtgaccctggccggcttatccatacccacgtccgcgatggtcagtgcggcgagttcgccgatcctggcggcggtgtcgtacatgaggatcaggagcatgcggttcctgcgcgatttggcgtcgccggtgccccatgcggtcagcaacgctttggtgtgctcctccccgaggtggtcgacgggtttgcgcgcgggtggtttgacacgtatgccggccgcgtcgttgcccagcgcggtcaatgccgggtgttcgaggcccgcgtggtcgaggaacacgcgcatcgtcgtcatcctcagcatgatggtgcggtccgagtacccgcgctcggtccgcatccattcgacccaccggcccaggcgcgcccggtcgaaatgcccgaaaccgatgtggctgcgctgcgtgccttccgtggtttcgagccatcggacgtaggattccaggccgatgcggtacgcctcgacggtcttcggcgagctgccccgcaccttgggcagccagtggtgcagccagtcgcgcgcgactcgccagaagtccggttcaccggagctggcggccgttttccttgccttgctcatggttcctccgtttccgggaccacgcgttcggcgtcggcgacgaggtccgcgtatccgtccatgaaatcggggctggcgtgcacgtagtagagggtgctgtcgatgccggcgtgtcccatgtaggccgccagatagggcagcatcgccatcacgtccacgccgtcgcgagtccaccgctcgatgttcgcgaacgcgaaccggtgccggaaatcatagggcctgggccgtttgccggcttgtggccactcgagcccggcccgcgtccagacgcggcggaacaccacgccgggcatgcccggggagaccggattgccggtggaggtgacgaagaacgcgggacggtcgtctccgaagcgttcgcgggaccgttggtcgcattccagcagttcggcggcgacctcgtcgcccacgggcagcctgcggctgcgaccggccttggaatcgaccacgtcgatggaacgggccttgtggtcgacgtgcccgacggcgagtctcctgacctctcgggtgcgcagcccgcagcaggccatgagcatgaagaacgcgcgagactgccacgcccacggcgacggagactccaacgttcccgcggcccgcaggaacagggcggcctcgcggtccgtcagcaggtacggcgtcggacgcggggatccggccttccactggtcggagagcacgtacgcgtcgggatcgtgggccagtcgcatccacctgccgaagtccctgatgtacgagaaccacgagcggcaacccccgggattcgcgtcgatcctatgggcgatccatcgctccacgacgccccgctccagacgcacggccccgtgttcgaggcaatgccggtcgaacgagcgcaggacccggacgcgggtggcgccatgcctgcccatggacgccttgaagcggatgtactcctccaattcgccggcgagcgggccgacgaatccgtgttccgtgggtctcatgacgatccgccttccggcacgggcagcacgcacgcgagcattcccccgcggtgcgtggccatgtagacgcgtgtggaatcggggtcggcgtggccaagcaccgcgctgatcgtcggcaacggcgtggccgcctccagcatcctcgtcgccgcgttgcgccgcaacagcctggaaccgccccggcgtccgagcccggcgtgccgcatgacacggctgatcgcctcgtacaccgatgaatgaccccgaagcgcgacatggggcgccttgtaccgcacgaacacacggtcgtcgtcggtggcgggcctttcgtccaacagccaggacgccagcctcgcggccagcggtcccgtcatcggcacggtcaacggattgcccgtctttcgctgcaccagacctatgctcatggaatcccaatccacgtcggcgatcctcagaccgatcacatcgcatgccctcagcccgcacgtcagcgacagcagggtgatcgccgcgtccctcgacggcaccgaccgcgaggcgcacgcctccagcaagcggcggtgctcgtcgtcgggcaacgttcccgcgatcgcgtgggtcctgcgtatgccggtcaggccgatcgcgtccgccaggtcatcccgcccgagccatctgaacaacgggcgcaggtccgacgcggcgtgccgcatcgacgactccgaccagcgtgaacgcagcccggccaggaaccccagcacatgcgagccatccgaaccatccaacgacacgaccccatgagattccagccacgtgaggaacaagcccgccatccgacggtaatgccccaccgtcgccgaagccagtcccgaaccggcgagatacgcctcccaacgctccatgaccacggccaaacccggaaccaccggctccgcaagcctgctcctgcgccacttgcccaggtccaccgaaccggaccgcagatacgagtcgcacaaacgcgccagcctgccgtaatcgaaccaccgctgcctgctgaaaccgcccgtccgctcactgaaggtcgacgcggcgaaccccgcgcccaacccacgcgtgtacaccgcatccgggcctccggcgtaccgttccaacgccctgatggacttgcggtactggcctatggtggattccatataaccggccccgtaaagcgcgcggaccacctcgcccgcgacatggccaaccgtcgtctcacccatggcaaactccttcgttcgaatcaaatgggacaagacgaacataacccggaacgttaagccgggaaaccacatgggacacggccagccaccaagaccccgaaccgttccccggcttaacaacaaacccggcttaatccgagtggatgatcggcgtctcgccgggcctgggcgtggcgcacgcgtcgcgaagcatgccgttggccagggcggcgttggggctcgtgccgatcgtccaggcgacgggcatgccgtcgtggcagtcgatgaccggcgacaggtacaccttgcccgccgggatcgagaactcggtgatgtccgtgacccacagccggttcggcgcggtggcgtggaagtcgcggttcacgagattcgcgggcgcgccgccgatctcgcccttgtacgaactgtagcgcttcgcgctcttgagcacggggaccatgccgtggctggtcatcaggcgcatgatgcgcttggccgacacgatgatgcccgcgcttttgagctcgaggtggatgcgcttgtacccgtaacgcctcctgctgctcccgaacgcctcgcgcaccagggacaggaggttcgcgttcttgtccggccggcgcatggccttcaactggtagtagtacgtgctgcgcgcgatgccgacctccttcagcaggctctccgcgttcacgcccaacgtctcactgatgtccttgatcagggtcgtcttctctcggcttgtcaggttgtccgggtctgcgcccggctcttttcccaccagttccgccgcacccttcatgatcgccaaccggatctccatggcccgctgttcggcgcgcagacgctcgaggtcggcgcgcaacgtggcgatctcgccgcgcagcgcgtccggattgtcctgctgcgaggaatccccgcgttccggttccctcttcgtcaccatgagtcctttcgcgtctccgagcagttgacgcttccagtttcgcacgaccgacgaatccacacccaccgcctccgcggcctcgcgcgaactcaattcgccggacgcgaccttcaggaccgcatcccgtttcaattccccgggaaccgggccacggcgaatccggcgttcgcccggcgcgagctcgtcgatccacgaggcaagcacctctttgctcggataccccatctgacgcatcgtgcggctcgcacgccgcccatgcgtcagataatggtccacggccgcacgcttctgctcctccgtgtagcgcgcataccgttcaccacgctgcgaggacacgcccgtcccctgttcgtcgagccagtcccggtgccacatgcgcaacgcctcccggctgggataccccagctcgcggatcacatccgccgcgcagccctcgtatttcacatacaactcgaccgcgcgttgccgctgttccctcgtgtacttcgccatggccgtctcctcctcggatcacagtccaagaaaacggcaccacccccaacacgaaacaccgacttgactaaatacacgaacggaacgtccggttccgcatcgcgccgatcacggccatggtcgcgtgccacaccgtgttctccacgctggccttgtccctgggccttttcaccctgccgggcagcaccgccgccgagtaatgatccgccaacgcccggtatcgttcgtccggcacgatctcgccctcacgcggatgggcggtcacgccggtcttgaggttgtcgggcaccagccgcggcgtggagccgcccagccactcgtacatcgccacatggcagcgcagccacgtcgtctcccccatatccagcgcaggctccacgaatgcgtaccggccgaacggcaggcacgccacgaacaggtaggcggtcgcgctctccccggtcaccggatccacgatctccaatgtcggcccggcccagtccacctcgatcgtcgaaccggccttgcgctccaccctcgacgtgacgccgttggccaccacatacgactgatacagcttgcagaaacggtcgcagcccatcgacggcgacccgtcggacaggcaggaatcccggtactcggcatgcagcagcctcaacgtgacgccggtcttcgccagctcgcggtgcacggcctcccaatccggctgccggcacgcgcttgcgtgctcgttgcgtcccgggaacagcagcgcgcacacctcgtcgtcgctcttcgacgcgatgtccgcatacgagacgccggcatcggccgccgccccgagcgtctccgctacgctcgaacgcgatatgccgagcgaacccgctatggctctgcccgacacggattgcgaatgccgcttcagtatctgcttcgccttgattttccgtaccatgataggcaactcctttcaccacacgtccctcgcatggtgaaaggagcctaaccaccaacggcctccgacggcaatatcctcggccccgaaccgcaataaccgaccaactccagcaatggccctgaaccccaataacaccggccctcaaaaaatcaaatattcacttgccgataacgtaccagacgttattgcggaggtgggtgaagattgggatgtgtgaggacctgtatattatgccaatagcttaacggtcatattagcggttgcaccgatttctccctctaggaggcctctggcttcaggattgccaacaatttcaggcgaatggcatcgcgacgtgcctcgatgaaaggtttgaaattcgctaagtcgagattggtatttgctggaacataaaaacttacagcggattttcctgttcgttttgcccattctgccagtggcgtatctcccttgctttcgttttgacttccttccaacagttggaggttggggagcgtattccaattctttctgtcttcagcgaatgctcgatcctctggatttgggaatgccgattgcatggtttcttcgaacctcagcaatttatcgcttccttcttgaggccggatgaatatattttttggatataaatgatccttatggtattgaaccgctgggttgtgtactccttgcagcagggagagcacgtaccaaacgtttgcatcctcatattccagtccgagaaaatcttcaatgttctcttcagtgatagtgatgtccttacgggtattcttgaatttggttcgtatctcctcataggggaaatgttcggtggtgctgttttccttgatgatggtccggagagagtttagcaacggattggtctgtcctccgaaaacgccgcataagaagctggcatttagccagagaatgatgtcatcggcaaccttatgctcggtactgtgaacatcttctgcaaatagtgtgctgccgcatcgtttgtacaaaccagtttgcaagaaatattgaattagcgggatagctgcattttttgctcggaatgtgacatcatcaaaaccttgattatgaaggaatcggaatgtctccccgatcgcattggatagcttatcccagtgattttgcagcagtttgaccttgtctgaatcgaagttgttgattctgaatcttacatccgatgcatagctagcgaggaacgagcgcagaatgatgtcattcccgatacgaaaacccgtgtccttgaacacatcgtccgagagtatttttgttttctggcgcatgtcgggccacatggaggttgttattgccatgattagatcagctttggtcagaggtattccgccgctgtttgtcctagtaaagatgtcgaggactttgttctgatcttgttccacctgaagatagtacgtgatgagtttcttctctatgaactgactgcgcaggtctgtaagtcgttggaaagcccttttgtagccagataaattatgttgttcccagtagttgaatatgtcgtcagtactgataagagtgaggatatcacccgccggcatccaatactctgtcttgttttcgttgaatccgtccttattgtcggaaaccttaaagaacctgaatgggtatttgagattgtcgtcattctcgggtctatcgtttagcaaatctatatacagttgttgcttaggcgtggatgtctcattatctgcccatcgcttgcttttaacatgtgcgccatatgttccaaagaatccgatgtataggcttgtaagcctctgctggccatcgatgactgcatatttatcctcgagtaatgggcgtgtcatcggaggattttccgtactgaatcgttctttatagtttcggaggaattcgaagaaaggataattacgctttatatcagggtctgtaattttccaaagcatgagagtattgattggatagccttgcataatgctatcgaataatgcttcgatgcgagggatatcccacgtaaatttacgctgaattccgggtagtacatattcggcattttgaatgtgaatcattgcttcgcgaatactgatgggtttttgataatcgttgtcctgttgtatttcattagccatggacatcgcctcctgatttcatttcatcataccctaaattgtgggtagtgtttcttgatgttgtgtggaagatgaattccgctacggagcggaattcattcgggacgtgggtcgttgctcggtggctctttcttcacacacgaatgttgcttataacgtctagcttttgccaatcgcaggaactgcgacgagaatccgtgactccggagcgagaatttgacggcggccgtgtgctggtccccattgcaatacgtccggtggtacttcaacataacgagtagtttctctgcgattcagtatgaatcgtcggttgctttcatctcttctcgcaaaatctttgtagcattttgtcattcgggctactgagtctcgattcacttcgagaatcatgttattaccttcgtaaaaacagactgaccggattgcgttctgttcataccatgtatcgataattcgctgcaacattgatttgcctaatgggatcagcgcgtgtttccagtcgggtaagggaattgtttcgtctgtgcgcaagtggatgactcccgacgtagtggcaggcgctttgtatgttagcgtcaaaggccagcacgcagatgaattgctaaaagtgatgccgatggtgcgtgaagaatcgtggcatttcgttctgctggaccagccgtatcgttccgctaattcataagaccataaggattgcgcacactccataaatctgcgttgcgcggtttgttcgatattgttgccttctgtcttttcgacgcttgtgaagcgtatcctaaatctatcggactcgatttgttcagaatcgatatgcaccttattgcgcactggtttgcacttttcgctgcggacgcaagcgacccagtctccattgcgcagcagcatgtccgctatcgactccacggcatcgagtcgtgcggctgattgagatgcggaatcaaccaccacagataagggtttcgtgtgagtttgtcgattatctggtttcctgactttcatggctaccagcatcatcgaagaacaggatagacggtagatatcttcctgttcttcggcatggagttgttctcgtacacatggtaaaaatcaaaaattggcagtatgcgcagcggctcttccgtagcgttcaatggtcatcatgcatggaaccaagcgagacatactattattgccgtggtctttccatcttggcatatcgcaaacgagtagcttcacccgtgataccgagcttgcgaccaattgtttcccatgattggccacgctcatgcatgagcagtaccatctgcgcaatgcgggcatcaatgtgttccagttcggctttgcgtcgattgattagacggctgagctccagttcgggagagaagtttgggctgtcctcgggaatgccttctgctggtgattcctgagactccacggcatctgccgcagcgttgccgatttccatgagtttggcttgcacttcgggggagtagtcttcaaatttcatcgttatcaccatcctggtattgcatcgtcaaccatttcatttcataggtcagtcgggctcgcatggcgtgcacgatgacatgctcatatgttcccggaatccattcgcgttcaatgacgccgatttcatacaaaatggcaccagacgctccagtcccgacaagcacatgagtgggaggaaaacgaagaacgttgatgtcggcttcgatgccatatcggtagacatggagaatgtccgagtcggcgatgggctgttcgccatgtttccgttccctgtgtgctgagggaagaatcaaaggatcctccccgcttatgggtgcaagtatacttggcaagtccatttgtatcaactcctctgttgaacgtaaaacgtgaatcaagtgtcttgagcgtaaagaaggtagaaagcccttgtccagctgaaacggggtatgtggttctagcttgctgagttatccacaatgttgtgaaagcacggcgatactgcataaaaaatagtgaaaagagaccatgcggagtggctgcatctaattaactggccaaccacgataatcgccggtaaatatttaccgccgcccagaccacacggtatggtggagcgcatggctgattacgggaacaactttgtgcaactgcataaccacacgcactattcgctgctcgatggtgcgtcgaagattcctgatttggccaagcgtgcggccgaacttggcatgcctgcggtcggcatcaccgaccatggcaacatgcatggcgcctacgagatgtacaccaactgcgtggccaatggcgtcaagcccatcatcggcatcgaagcttatgtgaccccggaaaccgcacgtcaagacaagtcccgcgtgcattggggtaccgaagcccagcgccgcgacgacgtctccggtggtggtcttatcacccacttgaccatgtgggccgaaaacgacgaaggcctggtcaacctcatcaaagcctcgtccgtggccaacctcgaaggtcgcgtcatgcgttatccgcgtatggataaggaggtgctcgccacctattccaaaggcgtgatcgcatcctccggctgcccctcgggcatcatccagacccgtctgcgcctcggtcaattcgatgaggccctgcgcgccgccggcgaattccaggacatcttcggcaaagacaacttcttcatcgaactcatggatcacggtctgacaatcgagacccaggtcaccaacgacctgctgaccattgccaagaagctggacgccccgctgctggccaccaacgattcccactacgtacacgccgaagatgcacaggcgcaggacgccatgctctgcatcaactccggttcccgtcttgacgatccggaccgattcaagttcgacggcaccggctactacatcaaaaccgccgaagagatgcgcgaactgttcaaggaccacccggacgcctgcgacaatacgctcgttatcgccgaacgctgcaacgtgatgttcgacgaccacgaagacggcgcgttcatgccgaaattcccttgccccgaaggctgggatgagacctccctgttcctcaaaaaagtcgaggaaggtctggagaagcgttacgacggcaacccgccgctcgacgtattgaagcaggccgactacgaatgtggtgtgatctgccagatgcagttctgcggatacttcctcgtggtcgccgactacattcagtgggccaaggaccacggcattatggtggggccgggccgtggttcggccgcaggcgccatggtcgcctattccatgggcattaccgagctcgatccgctcaagcatggcctgattttcgagaggttcctgaaccctgagcgagtgagccttcctgatatcgatgtcgacttcgaccctgaaggtcgtgcgcgagtcatcgaatactgcggcgaaaaatacggcaccgataaggtcgcccagtgcgtgatctatggcaccatcaaaaccaagcaggccctgaaagactccgcccgcatcatgggttatgaattctcagtcggtgaaaaaatcaccaaggcgctgcctccggcggccaccggcggcaaagacatcagtctgcatgacatcttcgaccctgccgccaaacgttatgccgaggccagggaattccgagaactctacgattccgacccggacaccaagcgcatcaccgaagaagccaagggtatcgaaggcctgatccgacagaccggtgtacatgcctgcgccaccatcatgggtagcgcacccatcaccgacacatcgccgttgctggaacgcaccgatggcaccatcaccaccaccttcgaataccacacgtgcgaaacgttggggctggtcaagatggacttccttggcctgtccaacttgacgatcatccacgacaccctgaagaacatcgaggccaacggcaaacccgccatcgactacaccaagattccgctcgatgacgccgaaacctacaaactcatgtcccgaggagacacgctcggcgtgttccagctcgattccgacggcatgcgttcactgctgaaaaccctgaagcccgataacttcaacgatatttccgcacttatcgccctgtaccgaccgggcccgatgagtatggattcgcacaccaactatgccaagcgcaaaaacggcctgcagaagatcacgccaattcaccctgagcttgaggagcctctgaagcaggtgcttgacgagacctatggtctgatcatctaccaggagcaggtgcagtccgccgcccgaatcctcgccggctattcgctgggcaaggcagacgtgctgcgtcgagccatgggtaagaagaagcccgaagtgctggccaaggagaaggtgccgttcttcgccggtatgaaggagcatggatattccgaagaggcctcccaggccgtgtgggatattctggtgccgttctccggctacgccttcaacaaggcgcactccgccgcatacggtctgatctcctactggaccgcatatctgaagacgcactacccggtcgaattcatggccgccctgttgcaaggtgccgccaccaacaaagacaagaccgcactgtacttgggcgaggcccgccgcatgggcatccaggtgctctcgccggacgtcaacgaatcggtgtacgagtactcggcagtcggcgacgtcgtccgattcggtcttggtgccatccgtaacgtgggtgacaaggccgtggccgatatcatcgccgaacgcgaaggcccgcgcggcaagttcgtgaacttcatggacttcatccgccgcgtgcccctgaccgcgctgaaccggcgattggtcgaatcgttgatcaaggccggtgccttcgactcgattgacccgaaccgtcgcgcgctgctcaccgtgcacgaggccgccatcgattcggtggtgagtctgaagcgcaaacaggcggagggccagttcgatttgttctccgatgccgaggatgggggagcggaggccatgggcgacgcttccgtgaccgtacccgatcttgaggaatgggacaagaagaccaaacttaacttcgaacgcgaaatgttgggcctgtatgtgtctgaccatccgctctccggtatgcagtcgattctcgcgtccttgcgtgaaatgtccatcgcgcatctggttgatcgagccaaaacgatgggtgaaggacagcaggtcacgttggctggtttggtcaccaatgtggaccggcgcgtatccaagaagggcaacccctgggccatcgtgaccatcgaagacatggaaagctccatccaatgcatgttcttcggcaaggtctatgaagcggccgccgctgaacttgccgtggacgccatcgtacagattcgtggccaagtggagttgcgcgacgaaaccgtttctctgagagccacggaaatgcagattccgaccttggaagccgaggatgaacgtccgttggtcatcacgctgccgtcggtggcgttggagcgccaacgcatgatgcaactcggtcaggtgctcgctaatcatcctggttactgcgaagtacatcttgcggtgctggatgagaagggtaacgctcaggtgctcacgtttggcgatcgtttccgcgtcaagcgagatacttcgttgtttgctgagatcaagattctgtttggccccagctgcttgcctgccgcctgattggcgggtttcgcccctggcctctccctcacctggctttgctggggctccttcatcagagggagctaaggcgtgtgccaccatacgatgtgcgcgactactgtggaacgtatgggcatggagatagcggatactggtaacaacgatgacgagcaacaatggattgccacgatgctggaacggctgtctcattcgcagttccgcgccaaattcgctttgaccgacaaagaccgagcctatgcccgcaccaaaggcaaggcgaccatcgatcgtcatgcgcgagaaatgttgcgagaccgcataggcgcagccgaaccgaagaacgacggcagacagacgccatggcgcggccatccggtattcaccgctcagcatgctaccgccacatgctgccgcggatgcatcgaaaaatggcatcatctgcccaaaggccgtgaactcgccgaagcggaggtaaaccgacttgccgatttggtcatggcgtggattgaacgggaccttatcaatcatccggttcggtgaagcaccccgcatcctcagtatgcctgtatgccttcaatagttatgggccaacagccaacataggcctcgaaaaccgtagatgcaaggtattggcgaatgcggcagaacgccgaacgttgcctatagcgcgttcgtcaataatgcgacatgatgtctattcaagaagagttgatgaagtgtcaactctgccccaaggaggcggaatatgtactacagcagcggcaattatgaggctttcgcacgtccgaagaagccggccgacgtggacaacaagcatgcatacatcatcggtaccggactggcggcattgtctgcagcctgttatctggtgcgtgatggtcagatgcctggcgagaacatccacatccttgagaaggacccggtacccggcggcgcctgtgacggtcttgatattcccggccttggctatgtgatgcgtggcggccgcgaaatggacaatcatttcgaggtcatgtgggatctgttccgctcgattccctccatcgaaaccgaaggcgtcagcgtactcgacgagtactactggctcaacaaggaggacccgaactactcgctgtgccgcgccaccaagaatctcggcaaggacgcggggctcaagggcaagttcgggctgtccgacaaggcttcgatggaaatcatgaagctgttcttcaccccggacgaagacctgtatgacaagccgatcaccgatttcttcgatgatgaggtgctgaactccaacttctggctgtactggcgcaccatgttcgccttcgaaaactggcactccgcgttggaaatgaagctgtacatcaagcgctacattcatcacatcggaggcctgccggacttttccgcgctgcgtttcacccgctacaaccagtacgagtcgatgattctgccgatggtcaagtatctggaatcgcacggcgtcgaattccgctacaacaccaaggtcgagaacgtggaattcgcgattggcgggggagccggccccaagcgcgagcacaccggcgtaggccaagacaccatccagaagattcaggccacctccggcttcttcaagcgcaaccctgccagcacgcccaccaagaagcttgccgtgcgcatcgacgtggaccacgagggtgataaatcctccatcgacctgaccgagaacgatctggtgttcatcaccaacggcggttgcgtggagaactccaccatgggttcccagaactcgcccgccgcatggaacccagacctgaagcccggtggcggctgggatatgtggaagcgtatcgctgaccaggacccgagctttggccatccggagaagttctgctccgatccgaatgccaccaagtggatgagcgccaccgtcaccaccctggacggcgagattccgccgtacatccagaagatctgcaagcgcgacccgttctccggcaaggtcgtcaccggcggcatcgtcaccgtgcaggactccaactggctcatgagttggaccctgaaccgccagcagcagttccgcgaccagcccaaggaccagctgtgcgtatgggtctacggcctgttcccggacaagcccggcaactatgtgaagaagccgatgaccgaatgcaccggtgaagagatttgcgaggagtggctttaccacatgggcgtgccgaccgacaagatcgaggcgctcgcaaagcaccacgccaacaccgtgccggtcatgatgccgtacatcaccgcgttcttcatgccgcgcgcggccggcgaccgcccggacgtggtgcccgatggtgccgtgaacttcgcattccttggccagttcgccgagaccccgcgcgacacgattttcaccaccgaatactcgatgcgcaccggtatggaagctgtctacacgttgctcggcgtggaccgcggcgtgcctgaagtgtggggtagcgtctatgacgtgcgcaacctgctcaacgccaccgtcaaattgcgtgacggtgcaccggtcaccgatatgaagctcaacttcattgaaaaggccgtggtcaagaaggtgctcaagaaactcgacggcaccgatattgccaccctgttacgcgaataccgcgtaatctgacatccatctggctcccctcgactggcacgcgaagcgtgactgggggggagttgctcacaacggagtgttaagagaaagacaaaaacatgactgattctgatccccagttaatccgccacgccaccatcgacgatctggacgcgctggccgccatggaatccgaatgcttcccggccgccgaggccgccgaccgctcgtccctgcgcgcccgaatcgagacctatccggaatgtttctggctattgattgatggcgagatcgtcatggcgttcatcaacggtttcgcgaccgatcggcgcgacttgaccgatgacatgtacgaggatgccgcgcagcacaaccctcaaggtgactggcaaatgattttcggcgtggatactgcgccgaagtatcagcatcgcggttgcgccagtacactcatgaggaaagtcattgaagacactcgtgcagctggacgtaaaggcctggtgctcacctgcaaagatcggctggtcggattctatgcgcaatttgggtatgaggacgagggcatttcggagtccactcacggtgacgtggtctggcatcagatgcgcctgaccttctaatccccctttggctcccctctttgatgctgaggcgtctaaaaaacagtccggtggactgttttttagacgaaggcgagacgatagtcgagccataagggtgcgagctttgctcgtccgtaattgcgggtgagccgtccgcgtgatcggactgaggggagttgaacgtggaataaaatgttgcgacacgccggtgaacatctgatttcgttacgtgagcccataaagagccggcgtatcctgatggtaacggcgtgattcaagctgatttcgacacgccgatggaacgacgtcgtttcaacgattccttgggtttttgcgtgccttgatttgcgtgaatccggacatgcgtgtaagttattcacctgttgccgctcagcgcggcgggttccttcctctggttggtttcccgtctggctggtgtggtggtggtttgagaactcaagagcgtgtttgtactacttctttatagtcaatgattgccagttcattcctcgcctgattgcctgtcgtggtggtcgggtacccgggagggtttgatgaggggtgaggttttttgagggcgtccttccttaaggacgtgctcgtcaatttttgttttgagagtcatctattcggatgcttttcatgaagtttttttgtggagggttcgattctggctcaggatgaacgctggcggcgtgcttaacacatgcaagtcgaacgggatccatcaggctttgcttggtggtgagagtggcgaacgggtgagtaatgcgtgaccgacctgccccatacaccggaatagctcctggaaacgggtggtaatgccggatgctccagttgatcgcatggtcttctgggaaagctttcgcggtatgggatggggtcgcgtcctatcagcttgacggcggggtaacggcccaccgtggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttatcggggagcaagcgagagtgagtttacccgttgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacggtcgtagagatacggcttcccttcggggcgggttcacaggtggtgcatggtcgtcgtcagctcgtgtcgtgagatgttgggttaagtcccgcaacgagcgcaaccctcgcctcgtgttgccagcggattgtgccgggaactcacgggggaccgccggggttaactcggaggaaggtggggatgacgtcagatcatcatgccccttacgtccagggcttcacgcatgctacaatggccggtacaacgggatgcgacgcggcgacgcggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggcagcacccgaagccggtggcctaaccccttgtgggatggagccgtctaaggtgaggctcgtgattgggactaagtcgtaacaaggtagccgtaccggaaggtgcggctggatcacctcctttctacggagaattcagtcggatgttcgtccgacggtgtgcgccccgcgcgtcgcatggtgcgatggcggcggggttgctggtgtggaagacgtcgttggctttgccctgccggtcgtgcggtgggtgccggggtggtatggatgcgcttttgggctcccggatcgccaccccaggctttttgcctggcgcgattcgatgcccgtcgtgcctgggggccggccgtgtgccggcgcgatggcgtggcggtgcgtggtggcttgagaactggatagtggacgcgagcaaaacaagggtttttgaatctttgttttgctgttgatttcgaatcgaactctattgttcgtttcgatcgttttgtgatcatttttagtgtgatgatttgtcgtctgggaatttgctagaggaatcttgcggccatgcactttcgtggtgtgtgttgcttgcaagggcgtatggtggatgccttggcagacaggaccgatgaaggacgtttgaggctgcgatatgcctcggggagccgccaacagggctttgatccgaggatttccgaatgggggaacccaccgaccgtcatgggtcggtaccggcttcggccggggggtacgcagggaagtgaaacatctcagtacctgcaggaaaggatattccgtgagtagtggcgagcgaaagcggatgatggccaaaccttgcgcgtgtgatacccgtcgggggttgcgcgcggggtgttgcgggatcgcgtgcgccggctccgacgggccggccggcagttgcagaaaaccatgtgtcaggggaaccgggttgaataccgggccgcagagggtgagggccccgtacctgaacgcgcatggtctgccgatcgcgtctcccaagtagcacgggtcccgtggaaccccgtgcgaatccgcccagaccgttgggtaagcctgaatattcctgtctgaccgatagcgaacgagtaccgtgagggaaaggtgaaaagtaccccgggaggggagtgaaacagtctctgaaaccgtgcgcctacaatccgtcggagcccttttgtggggtgacggcgtgcctatcgaaaaatgagtctgcgagtcagtggcatgtggcgagcataacccgtgtggggtatgcgtagcgaaggcgagtcttaaaaggcgtttgagtcgcgtgtcctggacccgaagcgggatgatctagccctgagcaggttgaagcgcgggtaagaccgcgtggaggaccgaacccacctgggttgaaaaccggggggatgacttggggctaggggtgaaaggccaatcaaattccgtgatagctggttctctccgaaatgcatttgggtgcagcgtcgggtcattacgtcccgggggtagagctactggatgcttgcgggcccgtatcgggtaccaacagcaaccaaactccgaataccggtgacgcgtatcccggcagtgagtcggcgggggataagcttcgtcgtcgaaagggaaacagcccagaccgtcgtctaaggtcccgaagcgtgtgctaagtgggaaaggatgtggagtcgcatagacagccaggaggttggctcagaagcagccacccttgaaagagtgcgtaacagctcactggtctagtggttccgcgccgacaatgtagcggggctcaagcacaccaccgaagacgcggcagtattttgtactgggtaggagagcgtcccatgaggggcgaagcggccgtgtgaacgcgccgtggacttcatgggagtgagaatgcagacatgagtagcgagagacgggtgaagatcccgtccgctggatgaccaagggttccagggccacgttcatcgtccctgggtgagtcgggtcctaaggcgaggccgacaggcgtagtcgaatggatgaacgggtcgatattcccgtaccggctttcagccgccaaaaccgaggcttggagtactaacctccgggtccgggcttactgctccttcgggggcgggatgccctggcctgttgggaccgatccttgtagtaggtcagcgcaggagtgacgcagaagggtagccggccgcggaggtggtcttccgtggtcaagcacgcagggcgtgggacaggcaaatccgtcccgcatgggtccgaggtgcgatgatgggggccttatggcccgatatccggtgatcccggctgccgagaaaagcttcggcgtcaggctcaaagccgcccgtaccccaaaccgacactggtggtcaggtagagaataccaaagcgatcgagcgaatcctggtcaaggaactcggcaaatcactcccgttccttcggtttaagggagacccccgatggtgaacacacttgctgtgggagcttttgggggtggcacagaccagggggtagcgactgtttaccaaaaacacaggtgcatgcgaaggcgcaagccgctgtatatgcactgacgcctgcccggtgccggaaggttaagaggatccgtcagccttcgggtgaagcggtgaattcaagccccggtaaacggcggtggtaactataaccatcctaaggtagcgaaattccttgtcgggtaagttccgacctgcacgaatggcgtaacgacttccccactgtctcgaccaggagctcggcgaaattgcagtacgagtaaagatgctcgttaagcgcagaaggacgaaaagaccccgggacctttactataccttggtattggcattcggtgtggattgtgtagcataggcgggaggccgagaggcgcggtcgccagatcgcgcggagccgtaaggtgaaataccgctctgttcgcattggatgtctaacctcgaacagtcatcctgttcagggacagtgcctggcgggtagtttaactggggcggttgcctcccaaagagtaacggaggcgcccaaaggtccgctcagcccggttggcaatcgggtggcgagtgcaagtgcacaagcgggcttgactgcgaggacgacggtccgagcagggacgaaagtcgggactagtgatccggtgccggtgtacggacgcggcatcgctcaacggataaaaggtaccccggggataacaggctgatcattcccaagagtccatatcgacgggatggtttggcacctcgatgtcggctcgtcgcatcctgggggctggagcaggtcccaagggttcggctgttcgccgattaaagcggcacgcgagctgggttcagaacgtcgtgagacagtttggtctctatcctctgcgctcgttggaatgctgaggaggcctgcccatagtacgagaggacctgggtggacgaacctctggtatgccggttgtcacgccagtggcacggccggttggctacgttcggaagggataaccgctgaaagcatctaagcgggaagcctgctccaagataagcattccgtggaaccttcgagttcctgtagtccccatgcagaacacgtggtcgataggccggacgtggaagccccgcgaggggtggagccgaccggtactaacggacgaaaggcaacactaacattccaacccctggcggttggaccgcatcttcctcctgcaaacgacaccagacggcaatgagcattgtctggccacaagacgaaacatcgacatatccgcgtccgctgtccggttcccaggccgccacaggccggcagaccccagcgtctgaccgtacaagagaagatttgcggcggccatggctcaggtgagacgcccggtcccattccgaacccggaagctaaggcctggcacggcgatggtactgcacccgacagggtgtgggagagtagcacgccgccgcaccacacgtacaggaagcccctcggagcacacgccccaaggggctttcgcatacccgaaaccaacaagataagacaccgacaagacataggctctcgcacctagggcgtggccgaatcgaaagcatatagaagagagaaccctccaatgacggagagtccccactttgcgtatctggaccgataaaggtctagaaattgaaattgtccggatcagcaccgttgcgcttgccggtgttgatggcggagatggcggtcatatcatcgaccgataggttgaagtcgaagacctcgaagttctgcttgatgcgctcggcatgagtggacttgggcagcacgatgataccgcgctggatgtgccaacgaatcactacctgtgcagcagacttgccgtacttggcaccgatttcggccagtactgggttgctgagtaggttaccgccggtgccgccgagcggactccacgcctcggttgcgatgcccttggcacgaagctggccaataagctcttgattggtgaattgtggggaagactcaacctggtctacagcaggcaccacatcgctatgggtcagtagctcatcgatatgatgcttttggaagttgctgacgccaatggccttggcacggccagaggcataaatctcctgcaagtcgtcccatgcctgctgccagccgtctgctggccagtgaatcagatacagatccacataatccacgcccaagcggtcgaggctttcttggaatgcatccttgccgcggcgtgcgcgaatatcgtcattccacagcttggtggtcaagaagaaatcgctgcgcggcacaccagcacggcgaataccttcacccactgaagcctcgttgtggtaaatcattgcggtatcgatatggcggtagccattctccagagccgtctgcaccgcgttcactgtagtatcaccatccggtgtctggaatacgcccaagcccacctgcgggatgacagtgccgttgttcagcatgattgtcgattgaattgccataatgcctcactagtcgtagtattcgttcaatttcccattctagaaacaagacgatgcaataagccgcgttttgctggcaaagaatgattcttttttcagcgctacgatgaacgatatgactacggaatatgtggctgcatttgatgcggggaccacggcgttgaagggtgccttagttaatgggcagggttgcattgtagctagtgcgagtagcgaacttgaccttattatcaacggcgactatcgggagcagagccccgatcaatggtggcaagctttctgctcggcctccaggcacatgattgagcaggcgcggcaatccgagtcagaattcaatgtgactcgcattcgtggcatcattttcagcggtcagatgcaggatgttattgttttgaacggcgagctcaatcccgtccgcaatgccattctgtattcggatggccgagccgaggaacaggccaagcaactcgccgagacatatcagggcggtgcagaacgtttcctgaacaccgttggtaaccggctcgaaggctgcttgccgttgcccaagttgatgtggctgcgtgaacacgagccggaaacgtacgcgcgcattcgtcatgtattgatcagttccaaggactacttgatcgcccaattaactggcgaatgcgtgggcgatgtggcggcgtgttccacagctggggccatgaatatccgtaatggccagtgggatgccgaattatgcgaggtcgcagaaatcgacatgaccatattgccacacctgcacaatccgcaagacaacattggcacagtgacggaatccgctgcacaacgcaccggtttttccgccggaactgcggtatacgcgggcattggagacgcgggtgccaccacacttgccagcggtgtcagccaccctggtcaatacaacatcaatatcggcacctcaggctggatcgccaccgtttcgcccgagccgttcaccgacaagccaggtgctgcgaatctggcatttggcgtggaagaaggcttcgtgaatgccgtgccattcctcaacgccggcgacgtgcataaatgggttaccggcgtattctccgatggcgattacgcagaggcgcatcagcttatcgaaacatccaaacccggctccaacggtgtgctatgcctgccatatctggtgggggagcgattccctgttatgaatccgaatattcgcggtgcctatgtgggcctcgatccagacaccaccaaggcagacatgatgcgtgccgcgcttgagggtgtggccttctccattcgtcaaggtatggaaagttttgacgccaaacccaccgagatttccctgattggcggcggagccagagaaaatgcgtggtgccagattctggccgatgtgttggagcatcccatcgaagtgttcgccaatgccgatattctgccagcagtggcaatggcctcgttggtattcaatgtaccagacctgctgcaatcagtatgcgaatgcactgtataccagccgaatcctgacaccgcacgcacatatgccgacgcataccggcgattcctgagcctctacccaatgctgcgaacgatggattaggaactgagcatcatgaggcaatcggcgaatttggtccgcaaacatatagtggtcaacggactggtgcaaggcgtgggattccgttattttacggtgactcaggcacgtcggcttggtgtacggggttgggtgcgtaattgtcgcgatggctcggttgagctggaagcacaaggcagcagcgacgcagtgcaagccttggttgagcaattagccattggcccgcgatggtccgaagtgagtcacgtcgccgtgcatgacatgccgattatcgatgagaccgctcgggcatttggcgtgcgtcaataacctgtatcacgaacccacatcacgcacgataatctcacgatacgggtgaacatgggcgttcctcgccgcttaggcctcgcacattgctacgatggggcgttatgagtgagaacatcatgcgaatcattgacctgcgtggtcagaacctgtcccgtgccgaactgcttgccgcgatgccgcgtgctgcaatgggtacttccgaagccaccgatttggtgcgtccgattctggacgatgtcaaagaacgcggcgccgctgccctgcgcgacttcgaggagaagttcgatcacgtgcgtcccaagaacctgcgcgtgccggtcgaggcgatcaaggacgccctgaccacgctcgaccccgaagtgcgcgccgccatcgaggaatcggtgcgccgcgcccgcgccgtggccgccaaccaggtgccgaaggacttctacaccgacctcgccgaaggcgcccgcgtggccgaacgctggattccgattcagcgcgtcggcctgtatgtgcccggcggcaaggccgtctacccgagctccgtcatcatgaacgctgtgccggcccaggccgccggcgtcgaatcgctggccatcgccaccccgcccgcccgcgacaatgaggaaggcctgccgaacaagaccatcctcgccacctgcgccatcctcggtgttgacgaggtatacgcggtcggcggcgctcaggccattgccatgttcgcatacggcgtcaagggcagcgagccgcaggacggcgacatcctgtgcgatccggttgacaagatcaccggcccgggcaacatcttcgttgccaccgccaagtcgctggtctccgcattcgtgggcattgacgcggttgccggccccaccgaaatcggcatcatcgccgacgaaaccgccaacccgagcctgctggccgccgacctcatcggccaggccgagcacgatgagctcgccggttccgtgctgttcaccgactccaccgagattgccgacaaggtgcaggagagcctcaagtaccgcgtgccgcgtaccgagcacgccgagcgtgtccacacgtcgctgtccggcacccagtctgccatcgtgctgaccgacggtctcgaccagtccatcgacgcggccaacgcctacgccgccgaacaccttgagattcagaccaaggatgccgatgcggtcgtcaagcgcatcaagaacgccggtgccatcttccgcggcccgtactccccggtgccgctgggcgactacatgtccggctccaaccacgtgctgcccaccggcggcaccgcccgcttcgccgcaggcctcggcgtgcacaccttcatgaagccggtcgaagtcatcgaatacgacgaggaaggcctcaaggccctcgccgcccgcatcaacgccttcgcggtatccgaggacctgcccgcccacggcgagtgcgtgctctcccgcttcgtcaaggatccgtatgacaaggccaccctgcgcgagcaggagaaggaagccggtctgcgatgagctcgattcctgcaaacctgccgctgcgcaacgacctgatcggtgaggagccgtacggcgctccccagctggacgtgccggtgtgcctgaacgtcaacgagaacccgtatgcgccggacccggccgtatgcgacaccatcgccaagcgtgtgcgtgaaatcgcccccacactcaaccgatacccggaccgtgagcacatcgaattgcgtcaggcattctccgattacctggcccgcgaatccggtacccgtctggacgtggacgagctgtggggtgccaacggctccaacgagatcatgctccagctgttccaggctttcggtggcccgggccgcaccgcactcggtgccgacccgacgtactccatgtacccggagtacgcccgcgacaccttcaccggttggaagctcgcccaccgcaacgccgacttcacgctgaacgtcgacaaggtgcttgaggccatcgccgaggtcaagccctcgatggtgctgctcactagcccaaacaacccgaccggcaccccgttgccgatggaggatatcgaacgtattctcgccgcctgcgaaaccgctgaagtggtcggcgcgggcgagggcgtgcacccgattctcgtcatcgacgaagcgtacgtggaattccgcaagcccggcaccccgagcgccgtgagcctgatcaaggaccacccgaacttggccgtcagccgcaccatgagcaaggccttcgccttcgccggtgcgcgagtcggctacctggccgcgtccaagggcatcatcgactgcgtgcgtatcgtacgtatgccgtaccacctgtccgccgtgactcaggccgccgcactggccgccttcgaacacaccgacgagcagctgagccgtgtcgagcacctgcgcgaaacccgcgaggccaccgccgcatggctcaaggaacagacctacaaggaccagccgcttgaagtggccgaatccggctcgaacttcctgctgttcggcgggcacttcgacaagcgtgaagccatcttcgacgagctcctgaagcgcggcgtactcatccgcgtggtcggaccggacggttggctgcgcgtgtgcatgggcaccgacgaggagatggaaaccttccgtaacgcccttgttgaagtgcttcgtatagtggaagcagcataagggacgtttctttccgattgcggcgagacccgaagcgattcgagtcccgccgcaatccaatatgacgaatcacacaggagacatgatggcaagaaccgcgcacatcgtccgcgaaaccagcgaatcacacatcgacctcgaactgaacctcgacggcacaggcaaaaccgatatcgatacatccgtgccgttctacaaccatatgatgaccgcgctcggcaagcattcgctgatcgacctgaccatccacgcccacggcgacaccgacatcgacgtgcaccacactgtggaagatacggccatcgtgttcggcgaagctctgaagcaggctctcggcgacaagaaaggcatccgccgctttgccgacgccaccgtgccgctcgacgaggcgctggccaaggccgtggtcgacatttccggccgcccgtactgcgtgtgcagcggcgagcccgaaggctacgaattctgcatgatcggcggccattttaccggctcgctggtccgccacgtcatggaatccatcgccttccacgccggcatctgtctgcacatgcaggtgctcgccggccgcgacccgcaccacatcgctgaagccgaattcaaggcgctggcccgtgcgctgcgcttcgccgtggaaatcgacccgcgtgtagacggcgtgcccagcaccaagggagccctgtgatgaccgacgacaagttcgatccggacgaatcgcacttctccgacgaggagcttgaggctgcgctcgccggattcgagaaagaattcgcggacgattcggtatccggcgatgccagtgataccagtgatgccgataaaacagcggacgctgcttcagcgaagtccgattccgacgcgaatgatgatacggctgataaggcttccgctgattccggccggcctatgaccgacgacgtcaccgggtccgttgcggatgcggtgaacgaggccatggccgatgtggtcgacccctcgctcggcttcgacaacgaactcgctggactgttgggtaacaaggcgaaggtggcgctgatcgttacccgtcttgcctccgccgaactgttggccgcgttctgccagctgtcggacatctccgccgcatgcatcggtgccaatcagggggccgtcgcggtgctgaagaatctggacggcgacggcccggaagccgcagccaaggacctgaccaccgtggtatccggcatggccgtgattcttgcagtcaatcgtgccgacaagctcgaagtggccatgtacgtgcagggagaggccggccagagtttcgcgccgcccgtgctgttcacctccacaccgcgcttcgtcgaggacctgatgctcggcatcgtaaccctgaaccaactcaagacccaagggttcgaagtggtggattccgctggactcgaccatgatcaggcgatgcagattctcgccaaccacactaggcgcggacgtggcgggcgcggctcccgcatcgaatagacgccaaccaaaccagtaggggataggagagcagatgaccacagcggttgttttcgattacggtttcggcaatgtacgttccatggtgcgtgcgctcgccaatcttggcgtcgacaccaccctcacctccgactaccggcagtcgttggaggccgacggcctagtcgtgccgggcgtgggtgcgttcgccgcatgtatggaaggactgaagaaggtcgacggcgaccgtgtgatctatgatcgcatccgcgctggccgcccggtgctcggcgtgtgcgtgggcgagcagatcatgttcgaacacggtctggagcacggtgcccatgccgcaggcatcggactgatcggcggttcggtgaacctgctggacgccgacgtggtgcctcacatgggatgggacacgatcgaggccgcccccgattcggtgctgctcaacggcgtggagaacgaacggttctacttcgtgcactcctacgccgcgatggaagtgaagccggcggatacgtcccgcttcgacatcgatctgagcgattcgcccgaacgcgtgagctggtgctcgtacggccgatcgcgctttgtggccgcctacgaacacggcccgctgtccgccacgcaattccacccggaaaagtccggggacgctggctcccagctcctcaagaactggatcgccacgctgtaaaaaagcatgaagctccctctgacgagggagctcaaattgtgtataagtaactgaagaaaggctcttcttatgtcgttgactctgctgcccgccgtcgatgtacgcgatggcaaggccgtgcgcctgcgccaaggcgaatccggttccgaaaccgattacggttcgccgttcgaggccgcccgtacttgggttgaggccggtgccgaatggattcacctggtcgaccttgatgccgctttcggtacgggcaacaatcgcgatcagctgcgagaaatcgttcatgagctcggcgaccgcgtgaacatcgaactgtccggcggcgtgcgcgatgacacttcgttggacgcggcccttgaggccggtgccgcccgagtgaacatcggcaccgccgctttggagaatccggattggaccgcctcggtcatcaagaagtacggcgaccgcgtggctgttggtctggatgtgcgcggtcacacactggcggcgcgcggctggacgcgcgaaggcggcgacctgtttgagaccatgaagttccttgactccgtgggctgctcgcgttacgtggtaaccgacgtggctaaggacggcatgatgtccggcccgaacattcaattgctgagtgaagtcgctgaacgcaccgacgccaaggtcacggcttccggtggtatctccaagctggacgatttgcgcgccatcaaggaactggctgaaattggtgttgattctgccatcctcggcaagtccctctatgcacgtgcgttcacgctccaggaagcgcttgaagtagcgaagtaggcaaaggactcgccttagcgagactgttaatctaccttcgctcagctatcgcttcactcagacccctcccacggacagcccaatgggctgtccgcttaacggctcagcaagggaggtcgccggatttgaggagctttttgaagacggcgtagtcttcatcattctgttcggcgtagctgacggcgaatgaggcgatggcctgatcgaattcgtcggtgccacccatgtaattggcgatcgcaatcgaatcgccggtgcgggcgtggggcgtgcgccaacgaccatgcgcacatgcgtgacagatcgctcaatcccgaagcgttgagattgtcgatatcaatcgaccccttgccattccacaactggcgcacgtaatagtcgcgcggtcggccatcctcggccataaagctcgaccaacccaacagcacatcggccgtattctgaatcagcttctgcccctgaaccacgcgctcaccgtgcgtggcgtacggcgacgcgccgcagtaatgctcgagcacggaatacgtggcctccttcatctgaatcatcatcggatcgtcgatatcacgcgcgatccacaccgacgtccacgcgcgctggcccaccgagcccacgcccaccaccttgcgggccgcatcctgatagcgcaaatgatcgaacacccaacggcgatcgtcgtacagggaatgccggtagctctcgaacagcgtgtctatacgtgcctgcaacgcatccaagtcggcgtaatcatccagctgattgatcggcaccagctcgggcggattggatttgaacctgagcttgccgctctcataacggcacagtttggccgccgccgcgtcgttatccttcagcagcgccttcatggccgcctcacgcagcacacggctgcgtttggaaccggtggtctcgaagcggtcgagcgtctcctccacgtccaggtgctcataccacgcgtcaaggtaatccatttcggagaaccacttcatgcgtgtgcggtacgtgtgtacgcactggaccacggcggcgcgacggtccttctccttgattttgttggcgcgtccgcagatctccaccgaggcggcgagacgtttcagatcccattcccacgggccgatagcggtttcgtcgaaatcattgatatcgaacaccagacgggcggaaggggagcggaaaatgccgaaattgccgatatgcgcgtcgcccacgcactgcaccggaatgccagtgactggcgtggaagccaggtcattggtcatgatgagcacggtgccccggtagaaggtgaaggggctggcgctcatacgcttgtaacgcagcggaatcagatccggtacgcgaatcgcggactgctcctccaaaaggctgatcgcctcacgccggccctccttgaccttccatatggcatgtgcgtccagcggcgccttggtacgagtggcgatgccggcgcgcgaacggtcgcgcgggtcggtggcctgcgtccagctggtcacgtcgacgggcggattggcggatggggtgagatgatcttcgctcatagtcactaccatagtgccgtgccggcatgggcctgaaccatgcctgacatgcggaccggggcatgttgatgaaatctcgcgactcgcaggtgacgaacagtgagatgttaacgcccttcgtaacacggttatggaacgataggcgactatggataaacagcaggagtttgcgctgcgcacggtcgaagaacgcgacgtgcgctttattcgtctgtggttcacggacgtgttgggaacactgaagtccgtggcgattgctccggccgaactggaagccgcgtttgaggagggtctcggcttcgacggttccgccatcgagggcatgacccgcgtgtccgaagacgatatgatcgttcaacccgatccctcgacgttccagatcctgccgtggcgcggtggcccgcaaggtaccgcccgcatgttctgcgacattctgaccccggacggcgagccttcgctcggcgatccacgtcacgtgttgaagcgcacgctcgccaaagccaaggacaagggcttcacgttctacgtgcatccggaaatcgagttctacctgttcgaaagccaggacgactggtccaaggccccgaccccgatcgacgagggcggctacttcgaccacgtgccgcgcagcccaggcatggacttccgccgtgccaccgtgaacatgctcgagcaaatgggcatctcggtggaatactcgcaccatgaggcggggccaggccagaacgagatcgatctgcgatacgcggacgcgctcaccatggccgacaacatcatgacattccgtacggtggtcaaggagatttccttggagcgtggcattcacgccagcttcatgcccaagcccctggccgacgcgcccggttccggcatgcacacgcacctgagcctgttcgaaggcgattccaacgccttctacgaggccggtcaggagttcaacatgtccctgaccgcccgccagttcgccgccggcatcctgtaccatgcggccgaaatctgcgcggtcaccgaccagtacgtcaactcgtacaagcgcctgtggggcggtaacgaggcaccaagctacatctgctggggccacaacaaccgttccgcgctgctgcgtatcccgcagtacaagccgggcaagggcaactccgcgcgcatggagttccgcgcgctcgacccggtggccaacccataccttgcctactcggtgctgctggccgccggtctcgacggtatcgataagcagatgcagttgggcgagcctaccagtgatgacgtgtgggagctcaccgacggcgaacgtcaggctatgggcattcagccgctgccgcgctcgctggacgaggcgctgaagatcatggagaaatccgacttcgtggccgacgtgctcggcgaacacgccttcggctacttcctggacaacaagcaccaggaatgggaggagtacaaccagcaggtcacgccttacgagctgaagaagtatctgccgaagctgtaatcgcaagcgttgcacatgtgccaaaccccgtcgatgattggtcatcggcggggttttctatggcgtgtcgtggtggtgggtagcgggcagaggcgggaaaagtgttatcgctgagttgatacgaaaaaacgattgacataaccgacgaatcagcttgtagtacgagcgagagcactcaagagagcacccatgacgaacgcacctgcgaacaccgcgcgtaccggccggcacttgggtggccgatacctttggttggcgtgtcacctttgccttggtctcggtgctcaccgccgtgctgatggcatcgatggcagtgtctctgccacgcaactcgcatccggcgaagatcggtttcctgaggcaattccgcctgttcttcgaccgccgcatccagctcggcgtggcggatgtggtcttcggcgcagccgcctcctatgtcttctacacgtatctttcgccgatcatgcgcgacgaaatcggcgtgcccgaacgctatatcagcatcggcttggtgatttacggctgcgcctgcctgtggagcaacctgtacggcggcaagctggccgacaaaggtcatggcgtggaaccattgacccacattcgaccgatctactgcgtgcaggccgtctgcctgtgtctgctggctttcgcctcgctgctggcggttggcgccacgaccctgctgcgtccatacgtcgaacgctgacagtgttggccgagtccaatcggacaagaccggtcagctgccgttatcagcttcgcggcgaaccgaaccagctggtgtagataagcgcgaagttgcggttgccataactggagcaggaatcgccggtaccgttgccagcggccagtgcggcgatgttcggctggtagggcgtatagatgtagagcagggcggtcgccttgttctcgatatacacttgtgcgccgccgcatgccgcgttcggatgatattggatgtagttgagattgtgcgccgtatacccgtactgttcctcgtgctcgagatagtaacggtaccgcttggccgcgccatacacctgccgaaagaatccggcataggcgggatcgcagtcggcggtatccggacagttcaaccccatcgccgccataagctgatagtcgctgggatcgacggcagtgaccagatgctgctccttctgcatcacggtgagcagcactttctggctcaccttgcaggcgcgggccgactggtcgatgattgtcgccgccgactcgcctttggtgcctgtatagtccgcgcacaggccttcgcctgactcgttcgatgtgtcgaaggtcatcgcggccagcgagccaccttgtgtgtccaaaaacgattggacttcggcctgactcatcgccgaaccgttgaagaactgaccatccgaaataatattgcccggattgaaatcgtatgttcgcgtcagttccagctgtgccgcctcggctgcgcgaacctgtgcccgccagtttgtgaaacgaaccagcccggccaccagcgctacgacaacgaccaccgccaccgtgggaatcagcaccatcttgatacgggtcggccagttcgccttacgccaggaacgcttcagagcattgatcggaccgtgcctacgattgcgtttcctgttccgattgccgaggcgtccgcgcacttgcccacgctgtgatgacggcttgcgcgtgcgctggcgcgtggcctggcgacttgtttgccgtccggtcacgccagcgctttcttgatacggttgagcgaagccggccccttggtgccaagctcctgcgcccatagggacacgtagaactcttcaagcatccaacgggcctgttcggcctgcttcatcaatgcctcatgcttcgggccggccggctccgccttggcacgggccaacgccttatcaaccacctgacgggcctcgtcggcctgccaagcccacttgacatcacggttcttatcggttttcgccttattgagtcggctcagatcggctctcaaatatcggctcaacgacttcagcgcatccgggggagtgcgcccgatgaatccggggtagacgagcgtggcgatatggtcgcgaatcgactgcaacaccgaaagcatcggcagatcagccttgccgccagtggccttgtcgacctcggcataagccttgagcacggcgatcacgtcatgcgccacctgatagacggtgtcctcgtacacttcgcgcacatcgagcaccgcattggctaacgcctcatcgtccgagagcctgtcgacattcggcatcagccgtttgaccgtggccagctgcaggtcttcgaccagatccttggtggacttgtacggagcagaagccagcatcaacgcctcggtacccagccagcgcgacgaaatgcgttcggccggcaatcgcaacgcatccaatgcgccacgccagagcatcgtggcccgggactcggtggtggcacccgccttatgcaacaggttcgcctgactgaccagcttgccctgttctccagcctgatcggcctgcttcttgaccatttgacgggccgacgcctccgcctgcgcggcgaacttgcgttgcagcgccttcagatccttggacacacccagcaccttgatggggccgcgcgcatgccggcgtccacgagggtgcttgccggccggcagttgctgctccaccgagaacgtgactctgagatacggggaaagacgctcgaccagttccggccccaacacttcgggatgaatctgcgcacccttggtggcgatggccgccttggtgaacacatgtgccagatcgggccagccaacggtcgtgccatcctcatccaccggcggcagattcggcttctgctgcgagcccgagcccggcagatccgggtaatgctcgtcgatccagtcacgaatcgcacgcgcggcatccggggccggcacgaactggacgcgcagctgcttgggcagcgccttgatcatcgacaggatcagctcatccaacagacccggcacattccatgtgaactggtcgggcgtgatacgcgagagcgccttcaacggcacatgcacggtgacgccgtcggccgggtcggccggatcgtacacgtagctcagacgcaggtcgatgggttggccgtccgatccggtcgtatgccaatggtcggggtaatcgtccagactcaccgaatcgctggatgccagacgctccaccttggccgggtcgaaatcaagcagattcggctgacggtcatgctcggacttccaccatttcgccagatcggccacgctggtcacatcgttgggaatgaccgcgttgtagaagtcgaacagatcctcgtcggacacggtatccgccagctggcgggtgcggctcgcatcatcggcggcatcctcgagaatgtcgcggtttttgcccacgaagtcgtcgtaactgaaacgctgctgaatatcgccctcgaccagaccctggcgaatcaggaagtcgcgcgcctcaagtggattgatgcgtccccactgcacggcacggtcctgtacgatcggcagaccatacagcagcacgcgcgcggtggccacagccgagccacgcgaacccgaccagtgcggctccgcatacgtggtgcgggtcaattggccggccaacggttcggcccacgcggggtcgatggccgccgaatagcgggcccacaggcgagaggtttccaccagttcggtgctcatcacccatgacggggtcttcttggccacggcggaagcggggaacagggcgaaacgggtgccgcgtgcgccctgataatcgttcttcgactgcttctgggcgcgtttcatcgcacgggcgcgcgccgaaccggtcagccccgcgaaatcggaggccttgggctcgcgcaccacctgcatgcccatcatcgacagcaatccggcgagcatcgacttgtggatgccgtccgcatcccacgcgcagcacagcgaatgcgcggcctgctgattcaacggcagctggcggatctccaagcctgggcgggaggcgggcagcgggtcgccgaccttgaacttcagctccttgcacatctggcgtagctgggagacgagatctttccactggcgcatcctcagccagctgaaatactcggttttgcagatacggcgcagcgcgttgttgctcgggtcgccgtctgcttggaacacgcggtcccagatattcagggccgtcaggaagtcggaggtctcatccgcataccggttgtggatgcggtcggcatcctcacgcttgtcgtccgggcgttcacgtgggtcctgcaagctcaggaacgccacgaccacgagcacctgggccagaagattcggcgaaccggttttcgcggcctcgataaccatacgtcccagacgcacgtcgatggggatgcgcgccagctgacgaccggtatgggtgagcgtcacctcgccgcgcttgcggccgatggccttgagctcggtgagctcattgaaaccgtccgacacggccttcatatccggcggatcgatgaacccgaagttcgtgacgtcctcggccgtgcgggccacgcccaccgacagcatgtggagtaccacggcacccagcgaggtacgcaggatttccggctcggtgaagcgcggacgggtctcgtaatcctcacgcgaatacaggcggatcgcgatgccgtcggccacacggccgcatcggccggacctctggtcggcactggcctggctgatcggctcgatcggcagacgctgaacctttgcggtcttcgaataccgggagatacgggcggaaccggggtccaccacataccggataccgggcacggtcagcgaggtctcagccacattggtggcaatgacgatgcgctggtgaaggtgcgattcaaacaccttatgctggtcggcggcggacagtcgcgcgaacagcggcatgatctcgatggcatccggccggcgcatgtcgtcggcgcgcgggccgtaatgatgccgcagtgcggcctcgaactcgtggatgtcgcgctcgccggaggcgaagaccagaatatcgcggggaccgcgctcgtgggaggagtgaatcaccagctcggcgcaggctcgagccacggcggtaggcatatcggtgatgccgtcatcggcataggaggcaccggaccggccgcggggccggtcggaatcggattccgcgatggcgctggccagctcgtcgtaatcggcgtcgccggggcgggcgcccaccgcgaatcccggcacttcgcgcatcaacgcgggcgcggtgccaagcggctcgtagaccacctgcacggggaaggtgcggccggaaacctcgattaccggcaccttctcatgcaaggcgtgctcgaaatgctcctggaacttgaccgaatcgatggtcgcggaggtaatgatgagcttcagatcgcggcgctgaggcagcagtgccgtcagatagccgagcagaaagtcgatgttaagactgcgctcatgcgcctcgtcgatgatgatcgtatcgtatcgggtgagtttcggatcgcgctggatctgggcgagcagaataccgtcggtcacgaccctcaatcgtgtgccgggcgagctttcgtcggtgaaacgcacctgatagccgacctcgtcaccgagcttcacgcccatctccgaggcgatacgttcggccaccgtgcgtgcggcgatacggcgaggctgggtgtgcacgatctgcttgccgtgcgtgccacggccaagctcaagcaggattttcggcagctgtgtggttttgcccgaaccggtctggccggacacaataacgacttggaaacgtttgaccgcgctggctatctcatcacgcgcggcagatacgggaagttctgcgggatactcatatttcatgacgaacttcaatgatacggaagcccttggagctcgcgtatttgctcgcagtgaacccctcgccgagcgcatcgtccagccaggggatcagcgaatcggaaccgagattcttctgcactacgagataggcggcaccgcccaccttgagcttcggcagccaagccataagcaatgtatgcagcgcttccttgccgactcggatcggtgggttcgaccaaatcacatcaaacgtgaggtcgctcggcaccgtctcgcagaacgccggctggttctcggcaggcaggggagtgctggactcgtccacctgagccgtatgaatgttcgtgtggccgttcgcctgtgcgttggcatgggtcaggtccaccgcgcgctcgttgacatccaccgcccacacgttcgcttcgggcgactcaaacgccaatgtcagggcgatagggccccagccgcagcccaaatccagaaaatcgccggtaagcggcggctcgggcgcatgcttcagcaataccgacgtaccgaggtccacgcgcgagccggagaacacgccgttcgacacctgagcggtcgcctcatggccgcgcaacgttacgttcaatgtgcggcgcacatccttcgatgcgggttccgcagagaaatactgttctgccatggtcgctccatttctgcgggattcgccgctctcgtatgccgacctgtatcagccggcctatgccggtacgtgccgatctatgccagcatgtcacctcatgtgatgataataaaggaccatagaagaatcgtggaccattccaaccaaacgaggcgcacttgaccgacaacacccagtacaccgacatcaaccgcggcaacaacgacgttacccctgaaggtgtgctggccgagcagtccgaagtgttgctcgacgacagccagcgcgcgaccggctggcatgaggacgccaaccaggaatgggaggagcgcgaggcccgcaacgagctcaagcatgtcgccggtctcggcgagctgcaggacgtcaccgaagtcgaataccgcaaggtgcgtctggaacgtgtggtgctcgtcggcgtctggtcgtccgccgtcaccacgcaagccaaggccgaggaatcattgagagagttggcggcgctcgccgaaaccgccggtgcggtggtatgcgatggtttgctgcagcatcgctccaagccggatgcagccacgtacgttggttccggcaaagccaaggagattgccggcatcgtggcgcgtgaggaagccgatacgattatcgtggacgacgacctgccgccgtcacagcgccgtgcattggaggacgccgccaaagtcaaggtggtggatcgcaccgcggtgattctggacatcttcgcccagcacgccacctcgcgtgaaggtaaggcgcaggtggagttggcgcagctcgaatacatgctgccccgactgcgtggttggggtggttcgctgtcccgtcaggccggcggtcgcgcggccggcgcggatgcgggcatcggatcgcgaggcccgggcgagaccaaaatcgaaatggaccgtcgtgtaattcgcacgcgtatcgccagactgcgccgtcagattcgtgagatggccccggcacgtgaggtcaagcgcggttcacgccgtcgcttcggcctgcccacagtggccgtggtcggctacacgaacgccggcaaatcctcgttgaccaaccgtctgaccggttcggccgaactggtggaaaacgcgctgttcgccacattggacacggccgtgcgccgcgccaaaacccgcgacggacgcgcttacgcctacgtggacacggtcggcttcgtgcgccgcctgcccacccagctggtcgaggcgttcaaatccaccctggaagaggtggccgaggccgacgtgatcctgcatgtggtcgatggctcccaccctgacccgttctctcaggtcgacgcggtcaatgacgtgttggcggacatcgaaggcacggcctcgattccgcgtattctcgtattcaacaaggccgatcaggcggacgaggcgactcgtgaacgactcgccgcgctgcagccagatgcgttcatcgtctccgcctataccggtgagggattggacgagctgcgtaccgcggtcgaaagtctgctgccggtcccgcatgtgcatgtcaacgctctgctgccgtataccgctggctccctgatctctcgtgtacgcgaatacggcaaggtagacaaggtggagtaccgcgatgatggcatacagcttgaagcggacgttgatgcccatcttgccgctcaggtggtcgaacagtccattgactaacgtgataaacatcacagtatattcgtgagcactaacaaccgttgaaaacattaccatacggttgtcaaacagggtggtgtgccggtagcaaaacgtcttagcgggtttatagagtgaagacgttagttacaaggcctgccattcatcagcagaccgcctttgaagagaggttcatccatcatggcggaaactaccgttaagcccacgaagcttgctgttattggtgccggtgccgttggctccaccctcgccttcgccgctgcccagcgtggcatcgctcgcgagatcgtgcttgaagacatcgccaaggagcgcgtggaagccgaagtgctcgacatgcagcatggctccagcttctacccgaccgtgtccatcgacggttccgacgatcctgagatctgccgcgacgccgacatggtcgtcatcaccgctggtccgcgtcagaagccgggtcagtctcgtcttgagctcgttggcgctaccgtcaacatcctcaaggccatcatgccgaacctggtcaaggtggctccgaacgccatctacatgctcatcaccaacccggtcgacatcgctacccacgtggctcagaagctcaccggtctgcccgagaaccagatcttcggttccggcaccaacctggactccgctcgtctgcgcttcctgattgcccagcagaccggcgtcaacgtcaagaacgtgcacgcctacatcgccggcgagcacggcgactccgaagtcccgctgtgggagtccgccaccatcggtggcgtccccatgtgcgactggaccccgctgcccggccacgatccgctcgacgccgacaagcgcgaggagatccaccaggaagtcaagaacgccgcttacaagatcatcaacggtaagggtgccaccaactacgccatcggcatgtccggcgtcgacatcatcgaagccgtcctgcacgacaccaaccgcattctgcccgtgagctccatgctcaaggacttccacggcatctccgacatctgcatgtccgtgccgaccctcctcaaccgtcagggcgtcaacaacaccatcaacaccccggtctccgacaaggagctcgccgctctgaagcgctctgccgagacgctgaaggaaaccgccgcccagttcggcttctgataaaaaatcgctgtacggagcgcctttcgcaccgcgcaagactcgacctacctttgtaggccttcaccttgtgcggcacgaaaatcgcacacgtacagcgattttttataccctgctgaatgctcccgttgggagcattttttattcgtggagttcgttggaggagggggagctatagccctcgggctcgagctggaaggtggtgtgggggaccgagaccgggaagtgctcgcgcaggcaatcctgcagttgggtgaggattgtggcggcatcttccatggtgaggtctttgtcgactaccacgtgggccatcagaatcggcatgccggtggacaccgtgctggcgtggaggtcatgcacggcaagcacatgcggcacgtcttccagatgttcgcgtaccttatcgaggtcaagtccatccggtgtttcctccagcagcaccttgaccgcgttgtgcagcaacttgatggcgcgcggaatcatcatcagtgcgatgacggcaccggccacggcgtcgaagccattccatccggtggggatcattaccagggcagaggccaccacggccaccgagccaagtgcgtcattcatcacctcgaggaacgcggccttcatattcatgttgtcttcgcgctgcgaggcaaggatgaaaatcgagatgatatttgcggcaagacccagaatgcccgcgaacagcagcaagccgatatcgtcgatttccgctttggaaccgccgaacagacgcatgccggcctccaccaacgcatagatgccaacgatgagcagcaccacggcacctgcggcagcggtgagcacctcaagcctggcccagccccaagtacgagtgttgctgggcttgcggcgcatcagtatggcggtgattgtggatgccgccagcacggacatgtcggtgagcatatgaccggcatccaccagcagggccaatgagccggttaagacagccgacaccacttcgatgaggaagaccgaaccggttacggtcaacgtggcaatcagcctacgctggtgcgcggcagggtttacggatgtggatggtgcgggtgcatgggtatgagccatatgtactccttcgctctatcgagttgaaaccgcttctcatttccatttgcgatatggtctgaatacgacgaaaccccggcgcgaggccggggtttcgtaagctgtgcgtgactatagcacgaccagcgcgattcggtgcacgctgatcagctggtggcgaacaggctacaatttgcgcagcacggtgaccaccttgcccataatcgtggcatgtgtgccgtcgatgggcgagtatgcggggttgtgcggcatcagccagacatggccgttttccttgcggaaggtcttcaccgtggcctcgtcgtccagcagagcggcgacgatatctccgttgacggcggaattctgttcgcgcaccaccacatagtcgccatcgcagatagcggcatccaccatggaatcgccgtggacttccagcatgaacagggtgccggagccggtcagccgttccggcagacgcatgacgtcgtccacatgctgttcggcggtaattggcacgccggcggcaatacggccaacgagcggcacatcgtgtgattcggcaatggcttcggcggggaattggtatatctccgccacattactggtgctggttgcctcttcgctggcttgggagggcttttcggcattcggggcggatcctgccaccacctcgatggctcgacccttgttcgcgttcatgcggatgaagcccttgtcttccaaaacttgtagctgatgcttgaccgaagacggacttttgagcccggcggcatttccgatttcccggaaagagggggcgaagccttgttcgtcgatatgcgtgcgaatggcgtccaacactttgcgctggcggtcggtcagggtggactcgtccggcttctgcttgggggagaagggaatggtgctcacgtcagggctcctttcgttacgtcaccagcataacgtgttgttcgtgtgaaatcaaacatctgttcgagtttcgacttgaccgtgtcgaacgtttgtgccattataagaacagttgttcgatagaacatctgttcgagagaggtggtcgtgatgactggttcaatggtgatggccccggcccgtagcgcacgtgtagctatgcagcatgctggaacgttccaccggaatgtgcgtgggaagattatcgcagtgatggtcgccttggcgctggcctggtgtggtttcggcgcgcttaccgctcagcgggcccaatcggatacgggggccacgcaggtgaccagttatatcgtgcggccgggggatacgctctggtcatatgcttcggctatcacgcctgctggtcatgatgtatcggaaacggtggatgagctgattgcgttgaacaatcttgagtccggatcattgcaggccgggcagcgcattattgttccggttgagtaaatgaaacccgagcggcatggtttttccgcccgtacacgttattctggggagcatgcattgtcctttttgccagaaccccgacaccaaagtcattgatacgcgcattagcgatgacggtcattccatccgtcggcgtcgcgtatgcccgaaatgcagcaagcgttttaccacggtggaaaccagtatgctgctggtcactaaacgttcgggtggcgtggagccattcagtagagacaaagtgatttccggcgtacgcaaagcttgtcaggggcggccggtcagagaagaggatctgaagctgctgggacagaaagtcgaagaggatcttcgctcccgaggccttgccgaagtcacctcagatgaagtgggcaaagccatcctgaaaccgttgcgtgacttggatgtggtggcgtaccttcgattcgcgagtgtgtaccagaactttgcaggtctggaggatttccaaagcgccattgatggtttgcgtgaataatatgcgaatgccatgcaccgtgatatgcgagtgattcgcaaaccatggtgcgagccaatcatgaagcccagcacttatgaaagagacccgtcatgatgacgggtctctttcatatcaatcgaggatgagctgcgtcagctgatgacacgcatgcgaatggtgccttcgatgttgcgcagtgcttcaagcgtggcggcgctgggcttctgagccacgtcggtgaccacatagccaagttcgccttcggttgccagcgactggaaggaaacgttgatgttctcctcgccgagcacatgattgacatgagccagcacaccaggaagattgtcgtgcagatgggcgatacggcacacacccttgcactcaccgaggttgatctgtggtaggttcacggacaaggaggtagaacccttgaaccagtaatcctcaagacgctgagagacgaaatggccgatggattcctgagcttccaaggtggagccgccaatatgaggagtcagaatcatattgtcttcattggccagtgaggtctcgaacggatctccgctcttcttcggttcaacggggaacacgtcgaccgccgcgccagacagatggccggaatcgaggtgctgcttcagagctcccagatcggcgacgaaaccgcgcgaaaggttaatgaaaatcgcgtcctgcttcatgtgggcgaattggtcttcgccgaagaatccggtgttcgacttgcggccatccacgtgcagggtcacggcatcggactgttccagcagttcgttgagggtgtcgcaacggtgggcattgcccagtgccagtttctcctcaatgtcgtagaacaccacgcgcatgccgagggcctcggccagtaccgacagctgggagccgatgttgccgtagccgatgatgccgagggtcttgcctcgcacttcatgcgagccggaagcggacttgtcccacaggccatgcttgatgtgatgcgtgtgtgcgggaatgcggcgcatcaagcagatgatgtcgcagatcaccaattccaccacggaacgggtgttggagtagggagcgttgaacacggcgatgccacgcttgccggcatgtgccagatcgacctgattggtgccgatgcagaagcagccgatggcgcttagcgtaggacgcgcatccagcacgcgggctgtgacgttggtcttggagcgtacgcccaccaagtccacgccatccagcgcatcgatgagttcgtcctcgctcagggctcccttcatggtctcgacttcgaaaccgtgatcacgcagcgatttggccgcatcggggtgaatgttttccaataacagtgctttgggcatgcttcataccttatatgttcagggacttttcgtccgcttttgtccgaactataaccagtttctgggtcggcctggtcattgccacgtacaggtccgaggcggcgaccaggcggctcggcgcgtcatcctcgatgagaccgggctcgaccaccacgacggcatcgaactccagacccttgaccgtttcagtgccgcagacgctgatttgctcatcccattcgggctgctcgatgagccttgcgtattcggccgggtcaagaatgacagccagtttgcggcgcacggcatcgcgcaccggggcgatgagattatccggacagatgacggcgatgcggccggtgccgtctgccgaaacgaattgttcggcaagctgcgccgcctgctcggccgtcgtttccagcaaggacgacatgtcgggcaccacattgcgggacaccgaatcggggatggtgcgcaccgcattgaccgtggagatgtagaggccttcctcctcggcaaatcgtgaggcaagttcggaaacttcctgcggattacggtagttgatggtcaactcgttcaaatcccagtggctttcgccgaacaggcggttcatcgatttgctccagcgtcgggtgccacccagcgccgaagtctgcgccacatcgcccacgatggtgaacgagcgggaggggcaacggcggatcaacatacgccagtccatggcggtcaattcctgcgcttcatcgaccacgatgtgcccgtaggtccattcacggtcggccgcggcccgctgcgcggtcagctcagcgtcgtccccgttcatctggtcgagcagcatctgactggagacgatgcctccacccagaccggtcgcggccagagtgtctttggcatactgctcttcggcggcacgacgtgcgtcggcggcggactggcgggccaccgccttgggatcggggcccagcatatccattgcttcgtcgagcagcggaatatcggagcgggtcaacggggagcctttggggcgggcaagtgccgcgatgtcgttgtcggtcagccaaccagccagagacttcagacgttcgggatgggcgaacagctgatcgatgagccatggggcggtcatcggcagccagcacaggttcagggtcttgcgaacctgctcgttcatacgtagcagcgacatcgcgcggttcagctccgcctgatccggcgtgtaatcaagctgttcggcataacggttctgcatgctggtcagcatcgaacggataaaggtctcgcgggccttgttatgaggttgtcgggtgcgcttcgcgtccgcctgcgcctgctcgatatcagtggccagcattggtacctgaatgccgctaatggttactgtcggcagagcagcgggaacacgcacgcgtgcggcgatggcattggccactacggaggtcatgcgtcgatcgcccttgagcttggctgcataaggggagtcgaccgccgtggcggtgatgccgggaatcagatcgctgatggtgcgtgagaccacgccggtctcgcccaaggagggtagcacctgatcgatgtagtgcaggaacgccgagctggggccaacaaccagcacgccggaacgttccagcgtgcgccggtgcgtgtacagcaggtaggcggcgcgatggagcgccacggccgtcttgccggtgccggggccgccctgcaccaccacggcgcgattcatgtcggagcggatgatgcggtcctgctcggcctgaatggtggccacgatatcggtcatcttgccggtgcggcgtgagctcaacgaagccagcagcgcaccctcgccggtcaatgtgccggcggaagacgcctggccgacctggtctgaatgcacgtcaagcacctcatcctcaacgcccacgacttcgcggaaactcaaggtgatatgcctgcgcatcacgatgtcgccgtgattggaaggggtcgcctcatagaaaggacgtgcggcttcggcacgccagtcggtcagaatcggctcatggtccgggctcgacaggccgatgcggccgatgtaatgacggtcgccgttcttggcatcgaggcggccaaacaccagccgatcctcaacgctgcgcaattgcgtgaggcggttttcgtacattgtggcaaaggagtctcgttcgctgcgttgcgtgggggatccgtgggagccggcggcgcgtacggtgtccaggcgttgccacatttcggctcgcagatcatccaatcgtccataggcgcgatcgacggcctgctgctcttcatgcagctgggaggcgtaactcgacatgctgttctcttcgttccatttccgtggggcagaaaaacttaaggcattcaaatttaccgcacaccccctacgtcagtgatgcggacaacccggaataggtgaattcagcgtgaattcaccatgctgctcggtcggtggggtgcgcgacgtggattgaatgtgcggagcgtccattcgtgcgacagtcgtggccgacacgcgcaatccatcggtaattgccctaaaagggtgagcaaatcgtgcatgagtggggagaaatggggaatcgtggggtagagtggtgagccagttggccgaagtgtatcccacgtaacgatgaaggaggtggagccatggttgccgatcagacgattcgcgacgctgatgccaacgcacaaggctccaccactatggccgatctcatggctggtctgccgccattgcttctcggaacatatacgccgaagatcgatgccaagggccgtatggcgcttccggccaaattccgctcccagctggggcagggcctggtcatggcccgaggccaggaacggtgcgtgtacctgctgccgttcgacgaatttcgacgtatcgcctcgcagattcagcgtgtgtcggtgggaaacaaagccgcccgcgaatacctgcgtgtgttcctttccggtgccgtcgaccagcagccggacaagcagggccgcgtgctggtgccgcagatgctgcgcgattacgccaatctgggttccgacgtcgtggtgatcggcgttggcacccgtgccgaactgtggaataaggacacgtgggagtcctacctcgccgagaaggaagagggatattccgatattgctgacgatgtgttgccggaggtggaattctgatggttgatgtggcgaatattcatctgccggtattgcttgacgattgcgtgaacctgatggcacctgccctggaacatgagaacgccatcgcagtggattgcaccctgggccttgccggccattccatcgccttcctcaaggccgcgcctcaggctcggctcatcggcattgaccgtgacagtgaagcgctggggctggccaccgaacgtatggaacgggaggggctcgccgatcgattcattccggtgcatgccgccttcgatcagctcgatcaggtgttggcggaccaagacatcgaacgcgtggacgccgtattcatggatctgggattatccagcctgcagatcgacgaaaccgatcgtggcttctcctattcgcatgatgcgccgctggatatgcgcatggacgtcagccagccgttgacggccgaacggattcttgccacctatgatgcggcggaactggtccgcatattcaaggaatacggtgaagagcgtttctcgcgtcagatcgcccgcgccatcgtggcgcgtcgagacaaggaaccgtttaccaccaccgcacagctcaaccgtctggtcgatgaagtggtgccgcaagcccaccgcccggcgggcaatcccgccaaacgcgtcttccaggcgttgcgcattgaagtcaacggcgaattggacaagctcgcctccacattgccgcaggccgcgaaccgactgcatgtcgggggacgactggtggtggagtcctatcattcgctcgaagacaaaaccgtcaaatcgttcatggcacaagggctgcgagtggatgttccggctggcctgcctgtcataccgccggatgcccaaccgtttttcacggatctcacgcgaggtgccatcaaggccgacgaacatgaaatcgcagccaacccgagatcggcttcggtgcggttgcgggcggtggaagtcagccgtgagattccgtcacgatggaggaaacgctttacgcaaaccgcgcagggcctgaatgacgtcaagatacaaggctccgcgtctccgggcagagccaaaaacacggcacgaattcgtacaaggaggggataacagcatatggcaactgcacgtagcattcgatcgaacgcggctccagcctcgaaccgaccgcacaccaagcatcagtcctcctcccgacctgagctgcgggtggtctccaacccgcgtggaaacgagcagggcaatgtcgtcggacgggtcatcgaatggaccagaacaagaagcgcaccgctggtgcacgtggccatcgcagtgatcttcctcgtcggcaccttgttcggcgcgctgatgctgcgtacccagatggtgcagaactcgtttgaggcggcacagatcgaaaccaacatcaacagacttacccaagatatcgaagacgatcaggccaaactcgatcaattggtcgcgaacctgcccgacaaggccagcgacatgggcatggtcccgcagcagggatcagtgtccatcgacttaagcggataccagtccaacaaaggcggaacccagtgaacaccattcgtcgcatcgtagagttcgccaaggtcaagaccttcgcgttcaaatgcatcgccatcggcgccgcattggcgttggtggcgtcggcatgcgtgattcagctggcctccacccagctcatcggcggccgtcaaaccgcacaagcggccacggctaaccgcaccctgaccgtgacgttgagcgccaagcgtgggcgtatcctcgacgccaacggctccgtgctcgctcaaagcgtggagcgttatactatcgtcgccaatccggaggctgcacaggagttcgagccgattacttgcaatgacaacacccgtgattactgccacgaaattgacggcaaacccgtgggcgctaccggagcggcggccgtgggccgactgctggccaaagtcctggatatgaacgccatggaactgggcgctgatctgtccggtaccgggcagtatgtgattctgaagaaagatgtgactccgcaggtcaagcgcagcatcgagtcgttgcacctgggcggtattgtctggggtgagctgagcagtgaacgactgtatgcggatggcgatctcatgggcgcgctgcttggcggcgtgaacgacaacggcgatggcgtcgccggcatcgagcaggtcgagaacaagacgcttaccggaaccgatggccatgaaacctaccagcgtggtaatggcggcgaagagattcccggcaccatgaccgaatcggtggcggccaaaaatggcgacgatgtcaccctgaccattgaccgtgatgtgcaatggtatgtcaaaaaggtcttgaaggaggccgaatccaagtatggtgcagcgtgggcgatcgccgtggtgcaggatgtccagagcggggagattctcgcactggccgatagcgatgaagtacaggctggtaccgatgcggcgaagatgagcccgtctcgggccgtgtccgaaaccttcgagcctggttcggtgggcaaggttatctccatgtccggctatctgcagatgggactgcataagatgagcgatcaattgtcggtcccggaccacatcacacaggagggccagacctacaaggactcattcgaccatggcactgagcgctggacgctcgccggcattctgcagaactcatcgaacgtcggcatgattatggccggggagaactatccggatgagcaacgctacgagtacctgaccaaattcggcatcggacaaccgaccggactgaacctgcccggtgaatcgagcggtctgctcaccaacccttcggcgtgggatctgcgtacgcgcaacaccatcctgtttggtcagggctacaccgtcaacgccctgcagctcaacaacgtggtggccaccatcgcgaacaagggtgtcaagcagcagcagtcgatcatcaaatcaaccaccgatgccaatggcaagaccactgagaccaagaagggcgaagccacccgcgtggtggatgaaaaggtcgcatcggacatgatgaatgcgatggaatcagtggcggaaggctacaacaagttcgtcaaggtcgatggttaccgcatggccgccaagtccggtaccgcagaggtgcagggctcggatggtacgctctcgtccattatctccgattattccgtggtgattcccgcggacaacccgcgctatgcggtcaccgtggtgatgaaggatccgaatggtgtgttcggcggtctgacggccggccctgtttccgcacagatttgtgagttccttatgcagaaatacgaggtgcctgtctccagtccacgcaaaaatgctattccagtcacgtggtaaggatcaggggagaaaggcgatagcccatgagtgcagtgagcgaatccatcgcccagcgggtgaccctgggaatgctggtcgaacggtacggttttgaagtcgatccacccttcgccaccaatgtcaccattacctcactcagcgatgccgtggacaccgtgattcccggctcgctgttcatctgcacgcatgagcaggaacccgatgtactgcatgccgcacaggccggtgcctatgcggcgttgctgccacgcgcgtccaaagggcagatcgccaatgccgatataccgttgctctacggcgatttcgacgatcgcgtactcggcgatctggccagcggtctggccggcggaccgtccaatgccatggcggtgttcgcggtgaccggtgcggatgagcaggccgtcgacgcaggcgtgtcccagctctccgaattcctgcacatgctgggcaatccggtggcggtaatcaccgcatccgggtccacgtcgatgacacgtaccatgaacctgaactatcctctgggcatcctcgatatgcagcgcgcgctgtccgtgtgcgccgaagacggtgtggcggccgtgatcatcgccatggatgaccgcacgttggccgagcatgcgttggaatcggtgaacgtggatgtactgggcacggaggatgtcaacgcaagcgcaagcttgaacgaattgaagacacgctacgcattcgttgcggaacatgacatgtccatgacctcgtcgacacccgaatcggatgaaatggctgcggattcaccggcaatgtatgaccgcgtccgactcgggcacatgtccttggccatcgccatggtgctggccgccggcgtgaggaaaaacaacatacgcagtgccctgcatgtggccaataatctcaattaagtccgtggatacgggacgaagcgtaatcgtaaaggagtttgaaacaccatggttccgatgagcgtggaggagatcgccaaggccgtcgatggtcgattgatcggagacgccggttccgagtctcgagccaccaatacggtcagcgactcgcggcaggccggccccggatcggtgtttgtggccatccgaggcgagcgtgtcgatgggcatgactttgtggcgaaaaccgctggacagggagccacggtggccatcgtcgaccatgaggtgaagtccgatggccttccgcagatcgtagtgaaagacacggtcgacgcccttggcgaactcgcccgatacaacatcgttcgccgccgcgagctggacggcgacttcgacatcatcggattgaccggttcggtgggcaagaccaccaccaaggatctgctctcctccctgcttgccaccgtaggtccgaccgtggctccggtgggatcgttcaacaatgagatcggcctgccgctcactgcgttgcgggtcgatgagcacacccggttcttcgtggctgagatgggtgccagccatatcggcgaaatcgcgcgactgacccgtatcgcaccgccgaacacggcaatcgtattgaaggtcggcgtcgctcaccttggagaattcggctcccgcgaacgcatcgcacaggcgaaaagcgaaatcgtgcagggattgcttcccggaggcaccgcggtactgaacgccgatgacgaacacgtggttcccatggccggcctggccaacggcgacgtgctgtggttcggcttgggatcgtcgcaggagcccgaggtgcgggccattgatgtcactgccgaccggtccgatcatgctgaattcacgttggtcgatgcggacggcaaccatacgccggtgcatctgggcattcctggacgtcacaatgtgatgaacgcgttggccgccgcaaccgtggcgatgcgttacggtatggcacccgaaacggtggcacggattctggcctcgcagcacaccatcagccctcatcgcatggcattgtccacggtgaatcgcgaggggacttccttcacgctgatcgatgattccttcaacgccaatcccgactccatgaaagccggcctgaacgggttgaaggcttggaactcaaatgacggcaaggaaccgttccgtgtggcgctgctgggtgccatgctggaactcggcgtcgatgaaacggcattgcacacctcgatcggcacgtatgcggccgaattgggcatcgacgcgatcatcgcggtcggttccgcccaagaccaacatctcgatgcactggcacaggctctggcggacggtgcccgtcagagccaattcgcgtcggtggattgcgtacacgacatcgatgcggccgaacagctggttatcgacttggctcgcaaccatcccgacgctgtggtactgctcaagggatcgcacgcgtcaggcctgagcgctttggctgaacgctgggcaaagaactgacctgataaccaccccaagaaaccgacaagaaagagaagctgcacgtgattgctctgatcattggaatgctggtgtcgctcatcgtcaccttagtcggcaccccgctgctgattcggctggtccacaagctgcactatggccagtacatccgccaggatgggccgcagtcgcatctggtcaagcgcggcacccccacgttgggcggcgtggtcatcaacttcgcgattctgctcggttgggcatcctccgcactgtaccgatacctgcgttcgggcgacgtgccctcctggtccgcggcgctcgtactgttcgccatgctgtcgatgggtctgttgggctttatcgacgacttcgccaaggtgcgtaagaagcagaacgaaggcctatcggtgggcggcaagttcatcggccagttcatcttcgccaccatctacgcggtacttgcgctgctgattcccaccaaatcgggattccccagtgcgcaggcaggcatcagcttcatcgaacagccgttcttcaacttcgacttcgccggccgtgccgtagccatcatcctgttcgtcatctgggtgaacttcctgatgaccgcatggaccaacgcagtgaatttgacggatggacttgacggtctggcggcaggttcgtcgatgatcgccttcactggttttggcatcatcgcattctgggaaagctaccacatcaagggcggcagccatggcggatattcctatgccgtgtccgatcctctcgatctgaccgtcatcgccgtatgcgcggccgtcgcctgcttcggcttcctgtggtacaactcgaaccccgcatcgattttcatgggtgataccggttccctggccttgggtggtctgttcgcagccctgtccatcgccacgcacaccgaattcctgacggtggttctgggcggactgtacgtcatggaagccatgagcgacgtcatccaggtcgggtacttcaagatgacccacaaacgtgtattcaaaatggcgccgattcaccatcatttcgaactggagggttggaccgaaaccaaggtggtggtgcggttctggatgatcgaactcatcttcgtgctgctcgccctgacgattttctacggcgactgggtcacccgctccggcctgctgttcagctagcggaaatctgggtggattatgctcacccacggaattcctatatcaggaggaacaatgcaagtagcggataagacagtggtgatcgccggactgggggtgtccggcacctcgttggcggaggtattgagggaacgcggcacccacgtgattggcgtcgacgagaggaagcccgagaccgatctccactcctttgatgacgtggactgggaccacgtggactacgtcatgtcgtccccggtgttcaacccccgcaccccgttcgtgctggaagcccaacgccgtggcatccccgtgatgagcgaggtggaattcgcatggcagctgcgtgtgaataacgagcgcaccggtactccggctccatggatcggcatcaccggcaccaacggcaaaacctccaccaccgagatgacctcggaaatgctcaccgcctgcggactcgacgcgccgaccgccggcaatatcgcctccggagacatgagcatgagcctgtctcgttgcgccaccaatccgcagcacgacgtactgtgcgtggaactgagctccttccaattgcacttcaccgattcgctggcacttgactgcgcggcgatcaccaatatcgccgacgatcacctcgactggcatggcgggcgcgagaattacgccgccgacaaatccaaggtgttccacaacgccaaacgcgccatcgtctacaatgcgcaggacgccaaagtcagcgaactggcggccgaggctcagactgccgaaggatgccgcaaggtgggattcacgctcgaggcccctcaagccggccagatcggcattgaagatggctggatcgtggacaggagcggcgtggccggcggcgcagtaggagagtcggtcagactggccgccatcaccgatttcacgcatctggcagagccggacggctcactgtacccgcatctggtggccgatgcattgacggcattggcgttggtgctgggacttggcgctgatcgcgataccgcgttgaaggcgcttacctcgttcaagccgggcggccatcgcatcgaaaccgtggctgaggccgcagtcgagggcggctctgttcgttttgtggacgattccaaagccaccaacggccatgcggcacgcgcctcgctgtccagcttcccggccaagtctgtgatctggattgccggaggtctggccaagggcagtcgattcgaggacctggtcaaggaccaggcacacaccatcaaagcggccgtcatcatcggcaaagaccagcagccgatgatcgaagcgtttgccagccaagctccggacatcccggtgaccatcatcaatcccgaagacaacgataccgtcatggatcgtgccgtcgaagcctgcggtacgtataccgccgccggcgacatcgtgcttatggctccggcctgcgcctccatggaccagttcaagtcctacgcggatcgaggcaatcgattcgccgccgcagccaagacgtggagcgaggtgcatggcctccactgatacccataagcgtaaggcatacagggtccctgacaagcccgcactcgaaatcactgactacacgggttggcgaagcttgctcaacccgctatggtgctaccacggcttccgcatggccgtggtggggctgacatgcttcggcctgatcatggtgttctccagctccacggtcaccatggccgcactgggcaagtcgccgttccttcagcttctgaaccagggcgcgttttgcctgatcggcttggtgctgggcttcgtggcattgatgatgccggtgacgttctggaaacggaccggcgtgctctttgtggtgggtgcctgcctgttgcaggcgctgacctttactcctttgggtatcgacgtctatggcaacaaaggttggctgaacctcggcttcaccactatccagccggctgaattcatgaagttcgcgatgtgcatatggctgccctcgtcgttgcatgcctgcagcaagatgtaccacaagaagggaatcaaagcatatgccgcgccgttggtgttgtatgcgataggcgtggcgctggtgatgggcggcagggacctcggcacggccatgattctggtcttcatcggaggcgtggcctttctgatcgtcgggttccccggcaaatggatgggagtcggcgtattgggcgcggtggttatggtcggtgcattggcggtttccagcccgaaccgcttgcgtcgtattctggccacatatggcgattgctcggccgctgacgcgcagagcgtatgctaccagtccattcacgccaagtacgccatcgcctccggaggttttctgggattgggcatcggcaattcgcgggagaaatggaactacctgccggccgcccataacgatttcattttcgcgatcatcggcgaggagaccggattcgtcggttgcgccatcgtattgctgttcttcgcgattctcgcctggtgcatgatcgtcatcgcattgcaggtcaccgatcgttatgttgccatggtgctgatgtgcgtcgccatttggatcgtgggccaggccatggtcaacatcggcgtggtcgtgggtgtgttcccggtattgggcgtgcctatgccgttcgtctccgcaggtggctcatccatgattatgtgcttgacggcggccggactggttgtgggacttatgcgctctcaaccgcagataaaacagtcgcgtcagagcgcgtaagtagactcggtaatcatgaatcaaggcacaccacatatcgttcttgctggcggcggtaccgccggacatgtcaatccgctgctcgcggtcgccggggcgattcgcgacatcgaacccacggcacaggtcaccgtcatcggcactgcggtgggtttggagaaggatttggtgccggaggccggctacgagctcgacaccatcgaaaaagtgccgttcccgcgtcgccctaacctgtacatgctgcgcttcccggcaaaatggaagcgagaaaccgccaaggtgcgctccattcttgaaacgcggcatgcggatgtcgtggccggattcggcgggtatgcttccgcccccgtctacgccaccgcacacaagatgggcattccgattgccatccatgagcagaatgcgcgtgccggcatggccaataaactgggcgctcgttgggccgatttcatcggtaccgtgtacgagggcaccggtctcaaaccgcgtgccggagccgacgtcgagcgcgtcggtctgccgttgcgcccggccatcgcctccctgaccaaacgcatcggtgacgaccgtgccgccgtacgccgtgaatcggccgcgcagcttggcgtcgatccgaaccgtccgctggtgctggtcactggcggatcgctgggagcgcaaagcctgaaccgcgccatcgcctcctccgccgcagacctgttggcccacgcacaaatcatccacttgaccgggcgaggcaaaatcagcgaagtacgcgaactggtcacggcctcggccggcgcggacgtgcttaccggcatcggccccgaatcggccggacaaggtgactaccataccgccgaatatctggaacgaatcgatctggcctttgcctgtgccgacttggtgatttgccgtgccggagccggatcggtatccgagctggctgcactgggcctgccggccatttacgtgccgctgcccatcggcaacggcgagcagcgtttcaacgccgagccagtggtgaacgccggcggcggccttctggtcgcagacaaggacctgaccccgcagtgggtgcatgagcatgtgcccgatctgctcgccaatcacgaacgacttgccgaattcggccgcaaggcatgggaatacggcatcagaaacgctgccgaaatcatggcccggcacgttctgcaattagccgaaccatccaagtagtattcagatatcattccgtgcgcgatactgaccaattccgttccgcagcacgagatacggtcataatatagggtgctggaatccctaaaggagttttgaattgtctcaagatcagcccatagtgcttgaccctacgtatgcctcattcgatgctgcggcccgccctgcggatctcggcgccacccatttcatcggtatcggcggtgccggtatgagcgttctggccgaaatgctgcacgccgaaggagtcgcggtggacggctccgatcgcgcacacagcgccaaaaccgaccgacttgaaacgctgggcatcaccgttgaattcgggcagcgagccgaaaatgtcgcccaggccgagaccgtggtctactccagcgccatcaaaccggacaatccggaaatcgtcgcagcacacgcggcgggcaagcgcattgtgcatcgcagtgacatcctcgccctgctcatgaacggcaaacgagccgtcaccgtggccggagcgcacggcaaaaccaccaccagctccatgctgtcccacattctggtgaacgccggtgccgatccaagctacgccatcggcggctttatccaaggcccggacggcaccacgctggacggcggacacgcgggcaaaggcgacatcctggtggccgaagctgacgaatcggacggcagcttcgccaaataccatccgaccatcgccattatcaccaactgtgaagccgatcatctcgaccattacggcgacgaagcccactaccgtgccgcgttcgttgcccacgccggccgggccaccggtcacgtgatcatcagtatcgacgaccccgacggacttgccgtgctggaggccctgcccgccgacgtgaaatcccataccgttgcctacggcactaccgcgcgtgagtccctgcccgatttgggcggtgccgcgtatgtctggatcgcttcggaaagcgagaccgctggcagcggcgtcgaacagctcaccctgcatctgccggccgcggtgacggcgggggagccggtgtctcagagcgttgccctgaaggttcctggcgtgcacaatgcgcgcaatgcggccgccgccatcagcgctgccgtgctgctgggcgtgagccccgcagacgcggccaaggcggccggcacattcctcggtgcggcacgccgcttccaggtgcgcggcacggtcaagcaggtcactgtagtggacgattacgcccatcatcccaccgaaatcgcggccctgctggatgcggcccgacgccggtaccccgattcgaccattcgtgtgatcttccagccacacctgttctcccgcaccaagttcttcgcgcaccagttcgccaaatccttagccaaagccgatgacgtcattatcaccggcatcttcccggcccgtgaaaagcaggccgatttcccggacatcagcccctccaccatcgtggacgcggctgcgggactcaaggatgcttccgtaggcacgtggattcagccggttgaggatatgtgcctggccgccaagatgatggccatgcgcgcccaccacggcgacgtgatcttcaccgtgggcgcgggcgacatcaccgacatggatcaggtgctgctcaccgcacttgaggcccatcgggaaagctgcgagtgatgtccgggcgcacggtcagatccgggggcaatgacaacggctcacgtcgttcgtctgggagctcccgcaagccgcgcaccatcggttcacgcggaaacacgggtcgctcgtcgaagtctcgcgctccccggtccgtgtcttccggtcatgagatcgacgagccggagatcatcgacgatgtgacggtagccaagggccaggccggtgccttcgtcgatgcacggcggttgcacagcgaggattacgttgccgaaacgctgcatcagaccaccggctccctaggagtcgcatcacgcccgaaagtggtgaatttcaccgaacgcgccaaagaacgcaagcgtgcaaacgtgcgcgtcgttgcgttacgcgtgttgattgcggtcgtcagtgtggctgtagtggcggggctggcatggctgctgcttttctcgtcggtgtttcgtctggaaaccagcgagatcggcgtatccggtgccaacgaatgggtgagtgcgcagaccatccatgtcatcgccgataagcaggctggaaagtcgttgttcctggtctccgcccatgaggtcacagagcaactcaagtccattcccggcgtcagcgaggccaaggtctccaaacagttccccaagtcgatgagcgtggaagtcaaggcgcaacggcccgcggccatgctgaaaagaggcgataccctgaccgcggtggattcccaggcgcgtgtgttgaactcggtgaagaacgccaacgtggatggcatcccggtgatcgaggtcaaggatatagacgccagtctcaagaaccgttcggtgaaggagacgctgacgattctgggcgcgttgccggaatcgatgcgtaagtccattaccaaggtcaccgctgagacgcaggattcggtgactaccacgcttaacgacggtgaccgcgtaatcatttggggcgactcttcgcaactgaagctgaagttggcggaagtcgaggaaatcgacaagaacatcaccgctggcacggctggctttgccgggaaacatcagattgatgtttcctcatcccagaagcccatcatcaagtgacggcgatttcgttggcttcgttggttccggggcgatgttcgctgctggcgatttgcgcgagtagcgccatagggtgtatgctgaaaagtccggccgaaaagccggaagcttgataactcaagattgggggcgatcggtttcgacggtgacctgttcgctgcagggaagcgtgccgagaacgccgggtccgctcgtggatgaccccggcaaaagaataagtgctaaatctaaccgcactgagttcgctctcgctgcctgatttttagtcaggattaaccagtgagcagccgctccgttcactcctccttgtctttgggaggatgttgagcgtcgtttagaagacttgctgatgcagttgagcctcagggctgcatcgggactttaactgcggatatgctcgccatcagttgtctgcgacatcgatgggggcagaaaaatcgccaacttggccagcagactacgcacgtagaagactgtgggctcggtcatcggaccggggttcaattccccgcgcctccaccaatccgcttcggcggaaacaagccgcttggctttacgaaagtaaggctgagcggctttctgttattgctccgttgattccttgttttcccgctattctctcgtgtcggatatgtcagttggacgaacttgcggggaagaaacgatttagacttagttcagggctgccgattgcacgatgtgtagaggctattatgctacgccgtaatcagggaggatatatgccgctggaattggtccgacaggatattacgaagatgaaggtggacgccatagtcaatgcggcaaacacgcagctcgccatgggtgggggagtgtgcggcgcgatattccgcgctgcgggagtctcgcgcatggctgctgcctgcgatcggtttgctcccattcataccggtgaggcggttatcactccgggattcaatttgccatcacgctatgtgattcataccgcaggcccgatatggcgagacggcaagcatgatgaagaacgtctgctgcgttcgtgctatcgcaattcgatggaactcgcggcacggcaggggtgtgccagcatcgccttccccttgatttccagcggtatctatggatatccgaaagccgaggcccttcatgtggccctcgatgagattcgccgattcctgggcgacgcagccgactccggacacgatctcgacgtatacctatgcgtattcgacaaaaccgctttcgaaataagcagcagtattgacaaacgtcttcgcgcatatattgatgattattatgtagcggagcatgaagatacgctaggaagcagaacgtatgagctgcttgctctccaacggttttcggataataagccgaaggcggatagggccgtaccttccggcgtcttggacatgccggatttcctgggcgatatgggtgaaacgcctgtctactcggcgccgtcggcagctccatcgccgaaatccgccgggcatgtggataatgcggtgctctccaatctggatgaaccttttaacatcattctcttgaggcttatcgacgccaaaggatattccgacgtggaggtatataaacgagcgaatatcaatcgtaaactgttctctaaaattcgctgtggcgatggctatatgcccagcaagaaaacggttttggcactggccattgccttacggctgaatattgacgagacgcaagatatattggcgtgcgccgggtatgcgctgtcgcacagcgtgaaattcgatgtgatcgtggaattcttcatcgtccatgagatgtttgatgtattcactattaacgagatgttgttccgatacgatcagccgttgcttgggcaatgatgcggagcggtacgctcgtctcctgacctgctgccgatacgcggcatattgtcgcttgccaagcgacctaggactggtcccatgatgcgaagctcattgatatcgccgacaatccggctggcgaatgagcgaaaggattcatcatgggcaagaacgacaatggcaataacggccgtacggaactggtgttcgtcgtcgacagaagcggatcgatgggaggtctggaatcagacaccatcggtggcttcaacagcatgctgtccaagcagcgaacaattgccggcgagtgcagggtaacgaccctactgttcgatcatcgaatcgaaaccttgcataatcacctcgacatccgcgaagtgaacgatttgacgagccgggattactgggtgcgcggtagcactgcgttgttggatgcgattgggctggccattgaccgcatgatcgtgacgcaacgacatactgcggcagcgtaccgtgctcaacatgtgctgtttgtcatcattactgacgggtatgagaacgcgagtcgtcgatattcgttgcatcagatcaagcagatgattacctatgagcgtgaacgctatcattgggagtttgtgtttctgggcgcgaacatcgacgccgaacagacggctggtgattttggtatctcaccgcgatgcgccactgattttcatgccgatggacagggaatcaaagcctcgtttgaggccgttgcctgtgccgcgaccgccgtgcgcggaggtgctgaccttgatgacctcagcgcgccggactttcttggtggtgttcgtgatgactatcggtctcgtcgtcgaatgaagcggtaaacgatgaactgcagtgcagatattaccggtcaccagtcggtcgtgtacgttaccggctggtgactgcacacgttgtactgtagggaaccatgaaagtcgtattgcaacgagtatccgaagcgtccgtggacgtggtcaatgaattgggcacgctggatcccacgttcgagccgcagcagattggcccgggattcatgattctggtgggcgtcaccgatgaggacggcgacaagcagatcgcctggttggcccataagattctgaatctcagggtgttcgaggatgcgcagggcaagatgaaccgttcgattcaggacatcggcggtgagattctctccatctcgcagttcacgttgttcgccgacgtgcacaagggcaatcgcccgagcttcatcaaggccggcaagcccgagcatgccgatctcatgtggatcaagttcaacgaggcgttgcgctccgggggagtgccggtgaaggaaggtcgtttcggcgcgcatatacggatcggactggtcaatgacgggccggtgaccatcgtcatcgacaccgaaactgatatgcctgacgggtcccgctgagccaagcgacaagtacatatacgaaaagccctgtgcggatcattcgcacagggcttttcgtatatcggcttcaggaagccgcagccaggccgatcgtcaggccttgacggctgccttcttgccttcaatgatggccttgtatccaacgccgatgaccagcacgtagatgcagccgacggacatcacgatgatggcgccgagctgggcactcatggcgtcggccagggcacccatgatgggcgggaagatggcgccgccgatcaggcccatgagcatcaggccggagatttcgttctggcgctccggacggtacatcagcgcgtgggagaggaagagcgagaacacgttggagttgccgaagccgaccagggccacggccacccagaacagggcgaccggcgggttggaggtgatcgagcagaagatggcgaagcagacggtggaggcggtcatgatggtgccgcacaccagaatgccgacgcggttggaaatcttcgagagcacgatgccgccggtgaagcagccgatcatacgggccacgaagtagaccatggtggcggtggcggcgatttcggtgaaggtgtcgccggtgtgctcggtgaggatacgcggcgcctgggcgttgatgccgacgtccacgcccacgtgggccacgatgccgaggaagcagagcagcacgatgcggtcggagaacaggagcttgaagcagcggccgatggtggtggtgccggcgtcgggggcgggttcgtcgatcttgtcgatggcgagcagcacgtagccgacgatgccgacgaccagatagatcacgaacagtatccaccacatgccgagctgggtggcgccccagatggcgatgtacggggcgaacagggaggcgaaggacttgacgaactggccgagcgtcagggtggaggcgagcttgtcgcccttgacgaacacggtgagcagcgggttcagagacacctgcatcaaggtgttgccgataccgaggaaggcgaaggagatgacgatgagcaccagacgtgcggtgccggatagggccacgtaggcgatgatgggcagtgccatggcgaccagcgtcacgagaatggaccacagcacggtcttgcggcggccaatcttgttcatcagcatgccggtgggcacggcgaagatcaggaaccagaagaacaccatggtggtgaacaggttcgcggtgccgttggccagattgaactcagccttgacgtagttcgtggcggtgccgaccaggtcgacgaagcccatgacgaagaacgcgaacatcacaggcgcgatttttacgagaccggcgttgccggtcttggtggtttcgctactcattttgaattccctttttctctatgaatggacgtacgacagatctatcggtcaatggatgatgactagtgaatagtgatggttccgttatcggatgtcatcatggcgttacatgatttggcagaattcgatgacctcgtggttcggcccaagcacgttgaagtaacggatgccgttgctccagaaggtgtcgatgtgctggatggagccttccacgaagttcaggccgagcttctgggcttcggcgaaggacgcttcgatatccgtcgaatccagcgcgaagtggttgatggcgccgttttccataggcgtggggttcatggtccacacctcgagggtcaggttgttcaggcgcaggaaggtgcagcggtcctcaccgttgggatagatgccgaggcattcgaagccgagacgctcgtagtaggcgatggtgccttcgaggtccgtggtcggaatgccgacatgctggacgccggtgacggtgtcgcgaatggacatggtgactcctctgaacaagatggctttgccggtatagagcggcaaagccatcgggaaaatggggtgggagtggattacttgccgatttcagccagatagtcgggcatctcggccgggtactcgggccaggcaccggcctgggtgcagacgaaggcggcggtgttgacggccttgcggtgggcttcggcgagcgtgtcacccagcaggatgcgtgcggtgaaggtgccggagaaggagtcgcctgcgccgacggtgtcgttcacctcgacgcgcggggtgtccagcgtggagacctcgcccttgcgggagatgatggtggagtaggcggagccggcggtcagaatcacgtagtcgaggtcgaattcctcgaggaaccagcgggaggcgtcttcaccggaggtgccgcgaatgtcgaacatgtcgcgcagcagcaggagttcctcgtcgttgatcttgaagacggtggccaccttgaggagttcctcgataagctccttggagtagtggtcgccgcgcaggttgatgtcgaagaacttcatcgcgcccggcttggtgtgcttgagcagctccgtgatggtggcgtgcgattcgggagagcgcagggccaaggtgccgaagcagacggcgtcggccttggagaccacgtcgatgagctggcgggtgtacaggatgtgatcccaagccacgcccttgacgatggtgtactccgggataccgttcttcagcgcgacttcgacggtggaggtcggccaggcgttgcgctgaagaacggtgttgatgccggcctcgtcggccttggcaatcagttcgtcgccgagttcatcctcgccgaccgcgctgatggcccagccttcggtgccgttcttcatcgcgtggtaggcgaagttgacgggggcgccgccggctcgcttgccgctcggcagcatatcccacagcagttcaccgaggctcagaacgatcggggtagtcatggttggtttcctttcctttgtttcctttatcgggtgtttcgtatggaaaatcttgtgatgtcggcgcttggtttaggagacgtcgaagaacaccgaggggtgttcgaggaattgggtcactgccactgctgcggcaccggagaccgccgcgtcggcggacaaggtggataggctgatggaagtggaggcattgatttcggggatggcccgttcggccaccgtggcgcgcacctcatcgagcagtatcgggccggcttcggacacgatgtcgccgatgatgatgtgctcgggattgtatccattgaagatggtgacgcatccgtagccgacgtatcgggcgacttcgcggacaatggcgattgccgcttcgtcgccgtcgccggctttggcgaacagggcgcgggcggcttcggtgtgggtcatatcggccgcgccgggaaccacggtgccatcggcgatgagcgtatcgtgaatggcgggggtggagcagtagcgttcaaggcagccgacgttgccgcaatcgcaggggcggccgttgacgtcaatggagatgtgtccgatttcggtggcggcaccgaggaagccgttgatgaggcgaccgttgtcgatgacgccgaggcccacgccttcgccgaccagataataggcgaggttgtcgtcggcgtgcaccgacgggtcgaagagataatgtgcgagggcgccggcgcgggcgtcctgttcgatgaacactggcacgcggaaagcggtggcgaattcgtcgatgaagttgattttgcgccagccctgcatgttggacaccacggcggtgcggcctacgttacgcagataggggccgggcactgccatgccgatggccacgatggatgggtcgttgtcgagcagttgttcgacgcgctggtggatggtgacgatggagtcgttgatggtgttgtcgcacaccgtgggcaggttttcaaagctcagggtgttgccgcacaggtcgaacacgccgatctgcaccagcgagcgggcgaatttgatgccgatgatgcggaagtgcgtggtgttgagcttgagtccgatggaacggcggttcttggagccttccagatcgccggtctcttcaatcatgccggcctcgataaggcgtgcggtgattttggtgatggccgcgggggtgagttccagtgccttggcgatttgcgcgcgggaactgatgccgttgtgatacaggtgcttgacgatgcgggagcggttggattcggagacactggcctgggaagtggcgtgggtggtgtttgttgccatcggtcttaagtcctccttgtctgcaccgctgcgagttgttccgctcgtctttgaatctgaacttgattaagatattaacgctgttaattgattgacgcaatcaatatgtcattcggcgtgtcgtgcatgtgagtgtcgtcttgggtgaatttgttaagatagttgtcaatagtcagatgtacactgatatcaagcgaaacgttcgatgaagaacaggggaggactgatgtccgaaaacactatgaacaatctcaaaatcggtgttgacgtgggcggaacaaaaatcgaagctgtgctggttgacgcaatgggcacggtattgggttccgcccgtattcccgccagacatggcaacgatgccgtgatcgaagacatcgtcgctgtagcgcatcaggcggcgggtgagcgttttgacgaggtgagggccatcggtgtcggtaccccgggcacggtggattcggccagcgggcatgtgggcaatatcgtgaatctcgacgtggtctcgctggatatggggccgttgatctcgcagcgttcgggcgtgccggcccatgtggaaaacgacgtcaacgccgccgccgtcggcgcggccaccgtgttgggcggtgcagatggcatggccggtaccattgcgttcctgaacttcggcaccggactggctgcgggcattgtcgaaaacggcgtgctgatgcatggctatagcggtgcggccggcgaaatcggccatatcccagtcgaacctcatcgcctcaagtgcccttgcgggcaatacggatgcttggaaaccgtctgctcgggcgcatccgtgggacgtctgtggcccaacgccgacccgccgatgcccgacctgattcgtcgcgcgaaaaagcgggaggccgaggccgtcgatgtgctggacatggtagtgcgcgccatcggcgacactatccagattttggcccaatccgttgacccgcgactgattgtcttgggtggtggcatggccaaaaccggcgaaccattggtcgaggtgatcacggctgagctgcgccggcgcgaatcgcaatgccgattcctcgaaacgctggacctgccggcccggctgcgtctggcacctgtcggccaaccggtcggagccatcggtgccgccatggcggcgtagcctggcatagtgccggggcatggaagatgaggcgtcggatttgtctccgagaccgcatcttccatgcggtcctatatcgctttatgtcgtgctgtgccgcgctgtgccgcgctgtgccgcgcttggccttgcgcgtttcgttgccggggtgaccggcttttatttggccaagtgttggaagaccacggcgatggcctcgccctgtacggtgatgtcaggtccgcattcgcagcgccgaatcaccgtgtgtttgtggaaggacgaggatgtggcggcatccagatattgctgggccgcgccgatgaacgtcgcgttgatgatgttcggctggccatagacgcatacgtctgccatatccaaaaggcccacaggcatggccagggcttggccaagatagcggcccgcccgagcaaggatattctgatgctgctccacgtctgctgcgctgagttgcttcttcaatgcggttccggaaatcatcgtctccaagcaaccgtgcttgccgcaagggcacggcggcccgtcaagatcgatggaaatatggccgagctcgccagccgcgtgcagttcgccgattaccggcgtgtccgagagcagaatcgccgaaccgatgcctctttcgatgcgcacgaaaagcatattcggcccgccttggccaaagaaacgttcggtgagcatggctgcggtggcgtcgttgctgacgtttacttcaagtccgaaatgttcggcgattggcgtggacaggtcgagattgttccagccgcgcatcgtggaggagcggaccacgccgttgtctaccacgccgggggaggcgactccgatgccgatgacctcgccatcggacatgcccagcatcttctcaatgagctcgatgatcacatccacggaaacgaatgagccggtgttcagggtgacttcggcgtgacgcagcggctggccgagcagattggtgactgcgccgtgcagcaggtgctcctgcgtcaggtcgatgctgatgatgcgcagtcgatcgatatcgatgctcagcagtgtgcctcgtttgcctttgccgccgctgggtgcctgaccggtctcgcgcagcaatccttcctccagcatccgaccgaccacatcggaaacggccacgcggctcaatccggtgcgtcggccgagctcggcgcgcgaatactggttggtggggaacaacaacctgaagataagttggcggttcttgcggcgcacatcggcgggggaagccttggccgcatggtcgtcggtcgttgtgttgagaccgagatatgacatgtttcctcctgcctgatggtgagcgagtggacggcgattgttgttccatacacagcttagacggtgaagcgcaatttcgtcgttgaaactgttatgaaacttcactaataaattccagtgtacctgtgtgaagcgtcaggaaacaccgtgagtgttcataaggtccaaaattgttagtatcattaacaaatagcgaatcaccaatcggcgctacgccgaacggtggttggaacgccgcgcggcacccggacgtgacaaggatgttgccattatccgcaagacgggcggcggtacagcgactcgcatcgggcgggccgcacggaactggaggaaaccgatgccggaaatcatcattgtcaagaacgaagccgaggccggcgagatctacggccgttgcgtggcggacctgatcaaagcaaagccggacgccgtgctgggcctggccactggctccagcccgctggccgcctatcaggcgctcgccaagatcgtcaaggacgaggccattgacgtttcgggcgtgcgtggtttcgcgcttgatgaatacatcggactgccgctgacccatcccgagtcctatcatgcgaccatccatcgcactgtggtcgaaccgctcggcctggacccggccaaggtccatgtgcccggcgacgtacttaacggcactccgcttgaagacggcgacaagatcgcgctggccggcccggcctatgatcgtgccatcgaagccgctggcggcatcgacgtgcagatcctcggcatcggcactgacggccacgtcggcttcaacgagcccggttcctcgctggcctccggcactcgcgtcaagaccttggccgaacagacccgcatcgacaacgcgcgcttcttcgacaacgacatcaaccaagtgcccacccactgcatcacgcagggtattggcacgatcatgaaggcccgtcacctcgtgctgctggcgttcggtgccggcaaggccgaagccatcgaggagacggtggaaggcggcttgtccgcgttctgcccggcttccgcgctgcagatgcacccgcacgccacgattatcgtggatgaggaggccgcctctcgtctgcgccacaaggactactatcgctacgcctacacccacaagccggcctggcagggcatctgagttatcgtgtgctggctcccgccagcgggagcgcatgagcggtaaggagaacaacatgtctgataggaatgagatagtctcgcgcgtgaccgcggcactggagggcaagccggctccggtggcgattcgcaacgcgcgcaaggtggatgcgtgcggcgaacggcgcggatattgggtcgtctccgatgccgccggcgtcatcgtggcggccggcacgggggaggaggccttcgagcactactgccgtacggtggggctcgacccggccgatcgcaacgcggtcatcgacgccgaaggccgtattctgacccccggctacgtggacatccacgcgcacggcgcatgggagaagagcttcgacgacgggtcggatggcatcgatgtggcgcgggccggccacgccgtgcacggcaccacgcgccaggtgctctcgctgatcaccaatcccgtggacgtgatctgccggaacatccgcaccgtccgcgccaagatggagtccggccgccccgacatcctaggctgtcatctggaaggtccgttcctggctctggcccgcaagggcgcacatgacccggaatgtctcaaggatccggtacccgacatcgtcgacgacatgcttgaggcttcaggcgcggcgaacggcaagattggctgcatccgccagatcaccatcgcccccgaactaccccacggcatctccgccatccgccagttcgccgctgccggcgtggtgccggccgtgggccactgcgacgccgactacgagaccgccaaagccggcttcgacgcgggcgcgggcatcatgacccacatgttcaacgcgatgaacggcctgcaccaccgcgagcccggtccgattccggccgcggtggaggatccgcgcgtcaccatcgagctcatcaacgacggatttcacgtgcaggatccgatggtgagcctctccttccggttcgcgcctcatcgtacggccttcgtaaccgatgcaatggccgcgaccgactgcccggacggtgcctacaagttgggtgcgctggacgtgaacgtggtcgacggccatgcgcgtctggtctccaacggcgccatcgccggctccaccctgctgctggaggtcgccgtgcgccgtgcggtgtgcgaactgggcttcagcccggtggacgcggtcgaggcggccactctgacgccggccaaggcgttcggcttcgaccggccgaacccggtcaccggggcgccgatcggcctcatcgcccccggcttcgccgccgatttcaaccttgcggacccggccgactggacggtcgaacaggtgtggtgcgcgggccgcaagctcaagtagcagtaggccgaccggttgacgaatggaaggcattcgtctacgaacatggtcacatggtgagatgatagtatatttgtctcaccatgtgaccgttattcacgtcgtaatacaagaatccgtaatactgctcgataccgcataaaaccggccttggtcgccacaagcgaaacataagtcgatgactatggaaacgcagaggtaacacatccgcaccatagtcaggcggtaatccacgcccgcagtgatgacgtggaaacaagttatgagagaggattcctgttgaattccaagaagattctggccgccgccgtctccgtggccgccatcgcatccctgaccgcctgcggcggtgtgaaggatgacaccaccgcaggcgccgattccggcaacgccatcaccatcggcaccaccgataagatcaccagcctggaccccgccggctcctacgacaacggttcatacgccgtgcagatccaggtgttcccgttcctgtacgcccaggactacaacacctccgaactgagcccggacatcgccgccgatgacggtacctggaacgatgacggcaccgaattcaccgtcaagctcaaggacggcctgaagtttgccaacggcaacgacctgaccgcttccgacgtcaagttctcctacgatcgcatcaagaagatcaacgacccgaacggcccgagctccctgctcgccaacgtcgaatccgtgaccgccaaggacgacaccaccgtggtgttcaaggattccgtgccttttgacgtgactctgaagcaggtcatgtccagccccgccggcccgatcgtcgatgaggataccttcgacgccgacaagctcaccgacgccgacaccatcgtctccaagaaggcctttgccggcccgtacacgctgaccgccttcaagatcaacgagtccgccgcctacgccaagaacgactcctacaagggcctgaccccggccaagaactccgccgtgcaggtcaagtacttcgccgacgcctccaacctgaagatggccgtccagcagggccagatcgacgtggccaaccgctccctgagcccgaccgacatcgaggacctctccaaggactccaaggtcaaggtcgtcaagggcccgggcggtgaggagcgcttcatcgccttcaacttcaagattcagccctacggcgaatcccagcccgatgccgacgccaacaaggccaaggccgtgcgccaggccgtcgccaacctcatcgaccgcgaagagctctccaccaaggtctacaagggcacctacaccccgatgtactccttcatcccggacggcctggccggtcacgatgacacgctgaagtccgcctacggcgacggcaacggcaagccgagcaccgagaaggccaagaaggtcctcgccgacgccggcgtcaccaccccggtcgacctcaagctccagtacaacaacgaccactacggctccgtctccgccgacgagtacgctgccctgaagtcccagcttgaggcaggcggcctgttcaaggtcgacatgcagtccaccgaatggacccagtacaacaaggatcgtgtggttaccgacgattccgacggtgtgtacccggtctaccagcttggatggttcccggactactccgacccggacaactacctgtccccgttcttccgcgatggtaacttcgtgaacaacggctactccaacaaggaagtcaacgacctgatcgtcaagcaggccggcgagaaggacgagtccgctcgtggagacatcctcaagcagattcagaagctcgagaccgaagacctctccaccatcccgctgctgcagggtgcccaggtcgccgtcaccggcacctccgtgaagggtgtcaccctcgacgcttccttccgcttccgctatgcctccgtcaccaagggctgatccagcatgagctcccctctttgagggggggggggagctgtctgccgacggcagactgaggggagtccaactcgtatgactcccttcagtctgcttcgccgccagctcccctcggagaggggagcctttattgctttatataccgattaccaacaccaaggagcatcgcgtgtcagacagcgccgcagcgacctccagcaccactccggcgaaagccaagacgaagaagaaccgactgtcaggtagtttcttccgcttcgtgctgacgaggttccttctcattattcccaccgttttcattctggtcaccatcgtgttcttcgtgatgcgcgccaccggcgacccgatttccgccgccttgggcggccgcctgacacccgccgaactccagcagcgcatccacgcggccggctatgaccgcccgctgattgtgcaatacgtcgactatcttggcggcctgctgcacggcgacctcggcacgacgctgaccgataaccagccggtgatcagcattcttacgcactacggcgccgccacattcgaactggccttcctcgccctgattgtggcgctgattgtcggcatcggcctgggccgactcgccgcccgcaagcgcgaccgtgccgccgatgccggcatccgcaccttcgccatcctgtgctacgccaccccggtgttcttcctcggcctggtcctgaagctcatcttcgctgtctggctcaacatccttccagcctccggccgctccgacctgaactccgaaatgcagttcacccgtctggtatcgccgactggcttctacatcatcgacgccatccagctcggcgacatgaacgtgctcgtcgacgtgctgcgccacgccgtgctgccggccgtcgccctaggcctcctgaccgccggcgtgttcatccgtctggtacgcaccaacgtcatctccacctacaattccggctacgtcgaggctgcccgctcgcgcggcgtctccgaaaagcgcctgctcaacaagcacgcctggcgaccggccctgatcccgatcatcaccgtcatgggcatgcagatcgccctgatgctcgccggtgcggtcctgaccgaaaccaccttcgaatggaagggcctgggcttcatgctgtcccagtacctgaaggcccgtgacttcgtggccgtgcagggcatcgtgatccttatcgccatcatcgtggccgtcgtcaacttcctcgtcgacgtcatcgccgcgcttatcgacccgagagtgaggtactgagatgaccaccgcatcccaagacaagatcaccgtccccggtgacgaccgccttaccaagctcaacgtcagcaccaagacgccgttctggaccaagatcccgatcatcaaggaactgcgcgtggcggtcggctggcagaagggcatgctgatcaccggtctcgcgatcaccgcgttcttcctgctcgtggccctcttcgccccgctgatcgccccctacggccacgcccagatcaaggccgccgacggcacgtccttcccggcgcaggccgcaccctccgccgaacacatctggggcaccaccgccgccggattcgacgtgttctcccgtgtggtgtggggcgcacgcaccgccgtcatcgccatcgtcgtggccgtgctgctctccatcttcgccggcgtgctgctcggcctggtctccggctactacggtggctgggtggaccgcattctggtgatgatcgccgacgccgtctactccttcccctcgctgctgctcgccattctgatggccatcatgatctcccacggccagtccggcctgtggagcggcattctggcttccggcatctccatcaccgtggtgtacatcccgcagtatttccgcacaattcgcgccgaagtgatccgcatcaaggaatccgcgtatgtcgagtccgcgcgcgtggtcggcgcctccacctggcgcatcatgaccaagcacctgttcaagaactccacccgcacgttgccggtgatcctgacgctgaactcgtccgaagccatcctgaccctcgccggcctgggcttcctcggcttcggcatcgagccgaccgccgccgccgaatggggctacgacctgaaccgctcggtttccgacgtgaccgccggcatctggtggactgccgtgttcccgggcatcgccatcgtgctcatcgtgctcggcatcacgctcgtgggcgaatcgctcaacgatctggccgacccgcgtctgcgcgcccgcaagtccgccggcgaagtggtcggatcgatcgaagacacgtccgtcgacccaaacgagaagccgaccgcacgcaacgaggtgattgccgaactcgacgcgaacgtcgacccgccggccaccgtcaccgaccatgacccgaccatcgtcgcctccgaatggaccggcgagggcaagccggaaggcaaggagtgagagatgagcgaaaacaacaagaatctcgccgatatcaaggacctgtccgtctccttcatgaccgacgccggctccatcaaggccgttgaggacgtgaacttcaccattccgcgcaagaccgtggtcggcgtggtcggcgaatccggttccggcaagtccgtgaccgcgcgctccatcatcaagctgctgccggagacggccaccacctccggtgccgtctacctgtccaagcgcgatggttccgattcgctggacgtgctctccctgagcggcgaacagctgcgcgaagtgcgtggttccgaggccgcgatggtgttccaggagcccaattcggtgctgaacccggtgtacaccatcggctggcagattgaagagggcctgcgcgcccacggcatgaaggacaagaaggaactgcgcgccaaggccatcaacatcctgaagaaggtcggcatcccggatgccgaaacccgcgtggactactacccgcaccagttctccggcggccagaagcagcgcatcgtcatcgccatggcgttggtgctgaaccccggcctgattctggccgacgagcccaccactgccctcgacgtgaccgtgcaagccgaaattctcgacctgctgcgcctcgcccgtgacgagttcgacgcctccgtgctcatcatcacccacaacatgggcgtgatcgcggacatcgccgaccaggtggtcgtcatgtaccgcggccacgtggtcgagcagggcgacgtggagcagatcttctaccatccgaaggacgactacaccaagcgactgctgggtgccgtgccgcgcatcggtcagaagctggtcgtgcgcgaccgcgagggcaaaccgatcgagcgcaaggccgattggcgcgaacagccgatcgccgtcgaggccaagaacctgaccatcacgtacccgggccatctcatgcagcccgacttcaaggccgtggacggcgcgaacttcaccatccaccgctccgaagtgctgggcctggtgggcgagtccggttccggcaagtccaccaccggccgtgccatcgccggcctgcagaaggtgtccggcggctccctgaacgtgctcggcatcgagatgaacggcgtcaaggagcgtgacttcaagcccaagcgcgcggacattggtttcgtgttccaggatccgggctcctcgttcaacccgctgatgaccatcgcggagaatgtggccgagccgctgctcgtgcaccacaagtacggttccgtggccgatgccaagaactatgtgggcgatctgctggagatggtccagctgccgcgcgcctacatgaaccgtttcccgcatgagctgtccggcggccagcgccagagggcgtctttggcgcgtggtttggcgttgaagccgtcgctgctgatcgccgatgagccgacttctgcattggacgtgtcggtgcaggccaaggtgttggagctgttcaagcgactgcaggcggaaatcggcttcgcgtgcctgttcatcacccatgatttggcggtggtcgatatgcttgccgaccgcatcatggtgatgcataagggccagatcgtggagcacggcgatgccgaccagattatgcagcacccggagaacccgtacaccaagaagctgctggcctccctgcccgtgcccgacccgcgcgaacagcagcaacaccgcgcccacctccacgagctcctagcccaagaggcgtaatcgcatagcattggagctccctcgtcagagggagctaactttatatccgctagtactgctgcccatcgaactggaacagggcgtgggcgtcgccgtgttttttgttctcgatgtaagtatggaacagctccagccgctcgctcgtgctggccgccaggggagtgggcaggtcatccagatcgaaccagccgacgctcaggctttcctcgtcgcctacgaacggctcggcattgccgccgggcttcagggcgcacaggaacgaatgatccatgtacatggtgttgtcgccattggcgtaggtcagtaccttgtttgacgaggtgacggccaccaaatcggtgacgatggcatcgatgcccgtctcctccttgatttcgcgcaccaccgtgtccgccggctgttcgcccggctcgttgatgccgtagaccatcgcccattcgcccgtgtccgaacgacggcccaacagcagttggccatgttcgttcagtacacaaccggtcacgccattgagccacaacagatcatggccgatcttcttacgcaattccaacacaaattccggagtggacacattgcctccttagtagaaaagaagctccctcatcagagggagcttaggttacttcgcttgggcagcctgctcggccatccaggcttcgacgtcgtcgatctgcttcgggatgccggcggaaatccattcggggccgttctcggtcatgagcacgtcgtcctcgatgcggatgccgatgccgcggtattccggtggaatcagcagatcatcctcgcggaagtacaggccgggctcgatcgtgaagatcatgcccgggcgaatcggcgcgccctgataggactcgaaacgggcctgcgcgcaatcatgcacatcaagacccaagtggtgggccacgccgcaggcgagccaacggcggtgctgctggccttgcggggacagcgactcctcgacgctcaccggcagcagaccccaatcgtgcagacgctcggcgatcacacgcatgcaggcgtggtggatgtcggagtaggtggcacccggcttggcggcttcgaaaccggcctgctgcgagtcgagcacggcctggtacagacgcttctggaagtcggtgaacttgccgttggtcgggaaggtgcgggtgatgtcggccgtgtacagggaatcgacctcaacgccggcatccaccagcagcatgtcgccggtcttcaccacaccggtgttgcgcatccagtgcagaatcggggcgtgggggccggaagccacgatggagtcgtaaccgacggcgttgcccagttcacgggacacggcgttgaacgcgccttcgaggatacgctcggagcgcggcttgtcgagcgcggccggcagtgcggagagcagacggtcgaagccatgcttggtggcgtccacggccttgcgcatttcgttgatttcgtagccgtccttgaccatgcgtgcctcggcggcgaactcgtgcagcttgtcgtcggatgcggagttcttgtccggatcggcgaaaccgttggcctcgcggatggattcaaccatcgaagtgatttgcgggtcggtttcgctgaccacgcgcacgcgtacggcgccggcttcggcacccacgtccttggacagggcgtcggccagctgggcgatgtcgtgggtttcgatgccggtcatcgcctgcatctccttgaggccagcacgcgggccaacccagtattcgccgtagtgggcggacatgaagaagtcctcggtggaattgtcggcgcgcggcgccacgaacagttccggagtgtgcgtcttgccggcggcggcttcgggggagtcggggtcgaccgggttcaggaccagcacggcgccggcctcgtaatcggaacccagaccggtgtagtaggcgaacgtggtgtccgggcggaacatgtaatcgcaatcattgttgcgcaccttcggctggccggccggaatgaccagacgttcgcccgggaaggccttgcccagcgcctcaaggcgggctggcgtgaacttggaggattcgagaggattggtctccggatcatcgtcggcccagccggacttcatgaactccttgaatgcggccgactgcgggcgcagcgagcggttgttcacgcggtcgctcatcgactggttcgcgcccggtgccgtagcgcgctcttcggcctcatattccttgtccttggcggtgatcacttcacccattgccactctcctgtatgtagttgttgtcgaatcatcgattcccacctcatattagtcggctttatgcgatgtgccacgattgacggctgacggtaaaaccaagtacggaatttggacggtcttccggacatgcccatatggcgagtgcggcgggctggaatgcgggcccgtttattgttctcggtagggaaggagaggggcatgggcttgggctggagcttgccgattgatattgacatattctgtgggctgaatccatgtgaacccatgcgatgaaggtttatcgcgtcgcgggactcactgctatgcggaggtctccacctgaggcaccccggctttgatcagttttacccgcagcggagtacgttcgatgacgtcggcgtatgtgaaatggacgatttcggtggcaccggctcgtttcagtccctcgtcgcgtgcgcgttccttggccaccacctcctgaatgctgcggttatcggtcatggctgggtccacgtatttttgtgtgccgtcgtattcggccactatcacgcgcccgtcatcgagcttccatacgaaatcaacgcggtactcggtattcgtctgtgggtcggtcaccgttacctgaatacgcggcgtgaggaagcgatcttcgatgatggtgcctcgcgcgagggattctccaccattctcgctcctttcgtttgcatagcgcagcaggcggaatactcgggcataatcgattctccattgaacgcagtcggcggctatctcttccttggttattcccttggcaagggccgagtcaaagatcggtaacgcaaaccgaaaatcaaggtctatagcggcctcgaccaaggttctagccggtgatatcagggataggccggaggcctcgtaatgtgtcttcggattgttcatatcgggcatatagacatgtcgtaagcgctgatggcattgacgagatccatgatcggaagtcacgatggttatgcagtcatcatgcaaatgccattgatgttcgaatccataggcacttactgccaccaagccgccaaaaacccactgaggatgctcttgcgcaagagcgcgggccatatgcaacgttcgctccggcggcgtcaaaccatcccagtatgcagtatttgcataaagactgggaatgccgtcatacactttcaacaactcaccactctgggcacggcggcgtagagcggtctgttccgcttcatttcttgaatagacgcatctcagctcattctgcgcggctgatatgagcgaggccactgctttgtgtgtcttcatgacgtcgagcgtagccggaacgaagcagcgtaagtatgaatttcagccattgtggttctagcctcggagcttggctgtcttggagcgagatactcccgataatttcaaggtattaggccgctaattcggaatagtggataacacacaaaacttatccaccatcagtaatgttattcgaacaacgtgctttgtggattcgaacaagatatcatcggcgaaggcggatgtagctggtagagggcggcgaattgacggttaacggtgcttatgctttgtacgccgtcggtgctggttcagatattggctggcttctgtctgagtgtggaatctagcgtcggcgtgagtccaatggttgtatcgtggccgacgatttgctgcgatttattggcggcatagatccagggcttggacggctgccgacggtgagagcagtcataacagtgaatgagcctctgcgagttcaaaagatgatgtagaggacgtttgtgagagtcgtttccggggcaaggcatggtcgattgacgacgttgaaatttctcaacgacggcagaatggcatgccttggcgaggagacgacactgagaggcgatggagtcgggattaatccaggttttggccagccaccgactcgcaagagcatcatagcgtcggtgtaccgccagaagctggcactgtaccgacgctgaatagcatcagcgtcgccggacatacaagttttggattgcagccgactaagaatgagatgccgacggcaagagccgcattgcaactatatgagacggcttcactgtgcgtggctgcaggtagagactgcccgcgcggcggcgacatatgagacggtttcactgtgcgcgcacgataaaccaccccggcggctaggatagagggaattgagggagtgcggctccacgcgtgaaggcaagaatcccgaaccatgcggggcaaacctgtgcaaggggagcttcctgcgcatgcggaagcggaatatatgcgggcatgcgtagacatgacgagaatggcgcgaacacgtaagtggcatacgcactccgaacggcgcaacagcaacacgagcagaggttagaagaggatatgtcattcgagcatccgaatcggaacaatgagagcatgcgggacgtcgaactggacatcatgagccgcccgccggagcataacaccaccaatctggatctcgaccggatgaacctgatgctcgacatcctgggccacccggagcagtcgttccgcgtgattcatatcaccggcaccaacggcaaaggctccaccgcacgcatggccgaggccatctgccgtgcctacggtatgcgcaccggcctgtacacgtcgccgcatctggagaagatcaacgagcgtatcgccatcgacggccagcagctgtccgatgacgatttcatcgacatctgggaccagaccaaggatctcgtggccctggtggacgccaagatggaggagcaaggcaagccgaagatgagcttcttcgaggtgctcaccgccatggccatctggaagttcgccgacacgcccgtggacgtggccatcgtcgaggtcggcatgggaggcctgtgggacgccaccaacgtgctcaacgcggatgcggccatcatcggcccggtggacatggaccacatgcagtggctgggcgacaccgtcgaacagatcgccaccgagaaggccggcatcatcaagccgaactgcaccgccatcatcgggcctcagccgcatgaggaagccgtcatgccgattctcgccgaagccgccgaacgcaaccacgccatgctcgtgcgcgacggctacgaaatgaccgtgtccgaccgtatggccgcagtcggcggccaggtcgccaccctgaccacgcccaacggcacttacgagggcgtgccgatcgccaagttcggcgagcatcaggcccacaacgcgcttgccgcgcttgccgcctctgaagtggtgattccggtcaacggtccgctggacggcgacttggtggccgaggcgttgagctcggtcaagattcccggacgcatcgaacagatccgcacctcaccgaccatcattctggatggcggacacaacgtgaatgccgccgaagccctgcgcaaggccatcgaggaaagctacgacttcaagcagctggtcggtgtggtcgccatgatgcgcgacaagcaggtcgaggaatatctgggtgttctggagccgatcctgagctccgtggtggtcaccgagaattcgtggcgcgagcgtgtgatgccggccgacgagcttgagaagattgccgtggacgtgttcggtcgtgaccgtgtgatcaaggaagcgaacctgcctgacgcgattcagaccgccgtcaatatggtcgatgccgaggacgagctgggcgtgggctacggccacggcgtgcttatctgcggcagcttcgtcaccgccggcgacgcacgcctgatgcttgaggagcatgccagccccacgatgaggcaggctatggccgttcatcagccggcagttgacccggacgattcggatcagccggcagacaaggccgaggatgaggccgccgacaacctcgaggattcggtgagcccggacgacttcgacgtgttcgacgtcctcggcctcggcaaggaacaggccagtgacgccggtaacgccggcaccggcacggccagcgccgacacaggcgccgtcaccgacgattccgccgacgtccggtaacccgcatccaaggcatatcggatacccggacacccggcatacggaaaacagtctcacgccatgtatctcaaggaactcaccctccgcggattcaaatccttcgcctccgtcaccacgctgcgcttcgagcccggcatcacggcggtggtcggccccaacggttcgggcaagtcgaacatcgtcgacgccctgatctgggtaatgggtgagcagggcgccaaaaacctgcgcggcacttcgatggaggacgtgattttcgcaggcacgtcctcccgcccgccattgggccgtgcacaggtgagcctgaccatcgataattccgatcacacgctcgatatcgattacacggaagtcaccatctcccgcaccatcttccgcaacggaggctccgaatacgcgatcaacggctcgcaatgccgcctgctcgacattcaggaactcctctccgataccggtcttggccagcagatgcacgtgatcgtaggccagggacgattggatgcgattctgaaggccgacccgtccggccaccgtgcgttcatcgaagaggccgccggcatcctgaagcaccgcaagcgcaaggaacgcgcgttgcgcaagctggccaataccgaaacgaacctgagccgactcgacgatttgctgggggaaattcaccgtcagctcggccccctcggacgccaggcacgcatctcccggcgcgccgacgcgattcagatatccgtacgcgacgcccaagcccgcctgtacgccgaagacgctcaacgctcgatgagccgtcgcgacacggtacgtcaagagcttggcgctgtgcgtaaccagctggccgtcgcccaacgtgaactcgcccaagtcaaagtacgcatcgaacaggtcgaggcgttgagctccgaatccagtccggccatcgccaaggccaaccaatactggcatgaattctcgcagacccgtgaacgactgaacgcgctcgcccagttggccgaagagcgcagccggtcactcgccggccagatcgtcaccaacttcggtgaggatcccggcatgcttgtcaaacgagccgaggaactggagtctcaggcagcggcacaaaccaaggccgtggccgatgcgcgcatcgcactcgacaaggccaccgaggaacgcgccgacgacgagaaaaagcttgcctcagtccgccagaccttgacggaactgcgcaaaaccgcacaggaacgcgatgcgcaaatcgcccgactgcgcgaactcatcgcccgcgaggaatccgccgtacaactggcgaccagccgcgccaaggattacgcctcccaacgcgactcgctgacttcccagcgcgacgatgcccagcaacagctggacgcattgcgcagcgaagcggactccattgccgacgatgacggtgccgcattggacgccgcacgtgcaacgctcgccgaatgccgcgaacgactgaatgaacgcgccgataagcagcgcgagatacagtccaagatcatctcgctcaaatccaaggccgatgcgcttgccgacacgctagacagccgcaatgcctccggatcgttggagcgcgatacggacgtggcctcgcttggccgactcaccgacttcatccatgtggccgaaggctgggaagaagccgtggcccacgcgctcgaccagtatgccagcgccatcgtggtacccgcggcaggcaacatgttgcacgccctcgaacgcgctcgggaagataagctcggcaaagccgtggtgctgaccgcgagcattgccggcgatcccgccacagagccgggcacggagtcggaggagagtagcgccgagaacgcgggggccgctccgcaatcgggcaacgcgctggcagcactcgtcaccgcgaacccggatgccgagaacccggcacagtccgaagcggtcgtgcgcaccgtgcgtctcctgctggctgatgtagccgcggccggcaccgccgacgaagcccaacagattgtggcattcggcgaagccatgcgggccgtcaccaagaacggcgagaccttcacacacggcgtggcggcggtcggcggctcttcaatctctcaatcggacctgtctctggccgcccgccgagacaaagcattggcacaggtcaaacagttgaccgcccaagacggcggaatggctgagcaagtggccgaggccaaaaccaagcgcgatgaagcggctcgactcgtcgaccaggaatccgccaaacgcaccgaagcccggctcaaagcccagcaggcggagaaatctctgaaatccgccacagatcgcgtcgcatcgttcacccgtcagctcgagcagctggataggaaaatcaccgagacccaagagaattgcaacgagcatcagctcaagcttgacgacctcaatcgcgctttggcatcggcccagcaatccacagcggaacatgccgatttcgacgaactcgatgaacgcgaacgcacgctggagcgcgaactgaacctgactcgcgagcatgaggtcgccgcaaaaatcgcgtggaccgaagcaagccgcaaaggggagtcactgagccgacaggccgggctgctgcgggacaacgccaaagaaaccgccgaacgccgcgcccgcatcgaggcgttgaacgatcgcagacgcgagcaggccgcacacctgcaaggcgtggccgatgacgcgcgagcagtggccgccatggtagagcatacgctgcatgacgtggccgccaaacgagacgagctgcaggccgccgcctccagccatgacgaggaactcaaggccctgcgcgcgcagcgcaaccagatcgagcccaaggtcaccgatctgaccgggcgcgaacatgccttggatgtaaaccgcgaacggttggccgccgaatccgggcagctcatgcaaaaagtgtccgacgaactcggtctcactttggaggaattggttagtgattacggccccgaacagccggtgcccgtgctggatgatgagggcaaccctgtgccgttggatgagacggaagctgaggctgagaccgaagagggagaaaccgggggagagaccggcaccaacggcgattccgaccgctttaagaccgtgccgtataaccgtcaggagcagaagaagcgtctcgataaggctcgccgcgatctggccgcactcggcaagatcaaccctttggccaccgaggaattcgaagcgcttgaggagcggaacaagtatctcaatgatcagcgcaacgatgtggtcaaatcacgtgacgatttgatgcagctcatcaaggatctcgattccacgatggtccaggtattcaaatccgcgttcgacgataccgccgaggcattcgagcagatgttcgccacgctgttcccaggcggcaccgggcgactgcgcctggaaaacccggaagacatgctcaccaccggcgtactggtcgaggccagcccggccggcaagcgtgtcaaacagctgagcctcctgtccggcggcgaacgttcgctgaccgcgctggcgctgctgttcgcgattttcaccgcccgccccagcccgttctatgtgatggacgaggtcgaggccgcgttggacgacgtgaacctgacccgtttgattaatgcgttcaatgagctacgcgcccatgcgcagctcatcatcattacgcaccagcaacgcaccatgtcgattgccgatgcgctttacggcgtaaccatgagagccgatggcgtaacagccgtggtgagtcaaaaactcgaacgataaatgaatggttcccgctgacaggaactggtgccacaggtgacagagggcggtccatatcgaaagaccgccctcagtttcgcttcgttcgacagctcccgccagcgggagcggggtggtattagcgcaatgccttgcgcacgccctgtacagtctgcagagtcttgtagaagaccttcttgatgggtacgtcgcgggcgggggccaccggggtgatttcctcggtgaacttgcacttgaactcgttaagccccttgagcgacggcgcgaaatcggagccgatgcccatcagatcgtattcagtaataccctgcgagcccaggatgcagcattcggaatacagcagcttgtcggtcacatgcagacgcataacctcgttgcgcatgccggcatagtagcgcaccgcatgtgtgccgttcacggtgacaatcgaccatgccaccacacggtcttcaatacgtgcggcgaacacacggcaatgatcggcacccaacgcgccgatcatatcggagtagtcgctcatcggagcaggcgtgaatccatcgcgctggccggtctcgaccatcacatcgtaatattcggagaaatcggccagcgccttatccgtctcatcggcaacctcggccgggcactcacgtagagacttgcgcacgtcacggcgtccacgacgcttcatccgagccagaatctcatcatcgccaccggtgacgtcgatgaccacggtctggtcgtacggcactgtggacagcaccttctccgtaccatcggcgaaccaggtgtcgatacgcaggaacgcgatgttcttgtcggccttcttgacggtgtccacgatggcgtcgacgacctcgcgctcctcagcctcggtgggcttggcgacccacgccggcccatgcatcgagcgcagataatgataaccgtgcgtctcaaaatcgataaaggagatcacggcgaccaattcaccatcacgcttgatcagataatcgccccatggtgtgcgtccgtcgatatccgcctgaaaaccagaccaaaccttggtctgttcgataggcaacgtgatgccggccttctcggcctcggcttccagtgtggctccgtcaactttctccaacgtgatcattacgattcagctatcctttttcgttcgtatccgtatgtcgtgtttctggtttggtcgtattgcgcgtgatctgatgtgggccaatcgggatccgatcaggatctgattggccggaatcccgtcacaagccaaacatgcgttcgaccacgtgatcgtcgccgtcgaacggcacatgcttgtgatggtccttgatccaacgctcgttgcccttgccgatgatcagcaggatgttgaatcggtcggcgtgcgcacgggcatcgtagatggcgttggtgatggccgtcggacggtcggaaatcaccgtggaggccacatccttgttcgtgatgtagccttgcatttccatgcagatgtcgatgaacggctcggtgtccgtatcttcggcggtgaaaatgaagttcgcgatgcggttctcggccgcctcgacgatttccttacggcgatcgtaggccttgttgccggccgatccggtcaccagcgtgatacgcgggttttcctcgccccaacgctcgtagacgaagtcaagcagcgcggtgacggatgcgtagttgtgcgcataatcgacgatggcgagcgtgttcgactgcgggtcgcggaactgttccatacggccggcgatacgtacggattcgatggcgtgcagtgcgtcggcgtcatcgagcgatacgccagccgcatgggcgatggcgatggccgccgccgcattgaggtagttgaagtcgccatcgatggacagatggtagtcgccaagggcctgatctccgtcggcgatgtggaaggaggcgtgctccgggtcggcgggccaggcgacgacgtccgcactggtgccggcattatccgcgtcatgcagggcgaaggtggttgcgccgatgccggctgccgccgcgtcctcccgcaacagatcggcgtgcagactgtccgcgccgagtaccagcgacttcgcgttggcgatgatctggcgcttgcaatacaggtaatcctcgaacgtggggtgttcgatcgggctgatgtggtcgggggagatgttcaggaacgcggccacatcgaaagtcaggccatagacgcggtccaccttgtacgcctgggaggagacctccatcaccagatactccatgccgttatcggccgcctcgcgcatcatgcggaaggcgtccatcgattcgggcgtggtcagatcggactcaacgtaggtgtggccgtcaaggcaattatcgaccgaggagaacaatgcggccttgccaccggagacggcgttgataagcgcctgcgtgaagtacgaggtggtcgtcttgcccttggtgccggtgacgccgatgaccgtgagttcgttctgcggatatccgtagaacgcggcggacagcaggctcatcgccttgcgtgcgtcgttgacgatcaggccgggggcggcggttgcggctgagtactcggtttcggccacgtatgcggccaggccggcttcatcgatgccgttcagatactcggccttgaatcggcccttgcagcacagcagggtgcccggcgtgaccttgcgggtgtcgtaggtgatgccggcgaacggttcatccgccgaagcgatacgggccgggtcgtcggtccagacatccccttggatgatttcacgcagcagatggtgttccttgagcaggtcagcggccgaagccaaagtcaaagccataattgtttctccctattatctagccgatacgccattctacaggtggggtgcagcgtgttgtggctcacacgtcatcgaccacgatatgggcacatgatttgattagaatggtgaaacgtgacgacaagcgaagcaactatgcaatccgggcagtcagccggatcgggcgagtccatggcagccaagcgcgccagatttgaacagctcgccatgcccgccgtcaatgcactgtaccggcaggcgatgaggctgaccaacgatcccgatgacgcgcaggatctggtccaggacaccttcgaacgcgggttcaaggccttcgactcattccagccgggctccaacttcgaggcgtggatgaccaccatcgagcgcaatgcctacttcaaccagtatgccaaggccaagcggcgcccgcagcgtgccaacgactccaccggtgaatacgacgactgggacatttacgatgccgccgaacatacgtcggacgggctcaagtccgctgaagaggaatatttggacgccttcgcgcccgaggaaatcatggccgcgctcgccaaactctcgccggaacgccggcaggtgttcatcgacgccgccatcgacggcaagtcctaccagcaggtggccgatgagcagggcgtgaaaatcggcacggtgatgagccgcctgaatcgcgcccgcacgcaactcaagcgtgagctcgcctcgtatgcgaaagagcgcgggtacgtgactggttcgtcggctggttcaccatccgcgaagttgggcgaaaacgttggtcgaatcgccgattccggccataatggaagtagtgaacaaactgttggtagcaatggcgacacgcaagccgcagtgagacatagtcatgcgactggcgcccgcacgccacaacagtcaagcaagctttcgggaaaggagatctgatgaacgatcagccggtagagcgtactcgccatatctccataacccgtacgggggccgatggcatggtcagccagaccgaagtgcatatcacggcggtgcatcatcgttcagtggataccggctcggcctctgcgtcggtccaggcggacgtgcatatcgttacggagggcgactgttttgacccccgtacctgctgcgacgagcgtgaacaggcgttgattgccgcgttgcgtgcctacttgcgcccggatgtggcacccgaatgtctgatagcccggctcaaggccacgcttgatcactgctgcggcgaagataagtaacgacatatacaacaaggcccgtctgatgtatcatcagacgggccttgagcgttccataagaaacgcgaagaatcaggcgttaggacgcttgccgtggttggcggccttcttacgacgattcttgcgcttacgtccgcgcatgcccatgatggactcctttgctgcagtaaaaaaaataagccttcggaattatgccacatgagcacgacgtgatgcaacacgggtgtccatgtggcgatgagcgtcaggcttggctattcggtttttcagatttgttcggcgtggaaggtgaccacggtggtgtagtcatcgcccggctcgagcacaaccagatccttgccggtgcggaaggcgtcggcgtaggcggtcatcggttcgacggccacgccggcctgacgagccttctcgccgatttcgttgccggtgcacacctgccaggagttgatggtcttgtcgccagtcagcgtgaccttgatgccgtcggggcgggtgaacacggcggaagtgctgccgtcttcaccgcggttggtgatatcggtccaggcatcgtcgaagccacgtccctccagcgtggggttatcgcgcaggtcgaagatgccggaaaccggctcttcaccggtgggcagcaagtgttcgtctacggtcacgtgggtgtcgcagtgcagctcaagacggcagggctcgttgtcggcggtaatggcctgaccggtggcgtgcttgccgttggccagccacgggtggatgccaaatgcccacggtgccttcacgctgtcgttgttgtgcacggtgaaggtttccgtgagaccgttctcgtcaagtgcataagtggcggtgatggtgatatcaaacgggtagccggcgatgtcgggggagcgccaggagagcgtcacgtgtgattcctgcaaatcaacgagctcccacatgtagcggtaggcatagccgtgcagggaggattggcggtcgaactcgtcgatcggcatctggtagtcttcgccatcgaaagaatactgaccattggtcactcggttcgggtacggtgccagcacccagccgttgcagcagggaatgaccttgttcgggtcgaaggggacgatgaggtcttcgccgcgccacttcagctcgcgcaggctggcacccagttcggtgacgacggcactccattcgccggacgagatgacatattggttaccagtgcgaggcttcaaagccatagtgcacactcctttgtggaacaaattgttatcgctcacaatcgtatcgcataagtcccaagacgcggcggcacataaggataaaaaattggctcccctctggaggggagccagcgtaacagaactacttctggactacttcgtagcggaccacagtggtgtagtcgccgttgggggcgagcgtcaccaagtggtcaccagtgcggaaggcattggccggggcggtcatcggctcgacggcgatgccatacggatgctcggcgaacggtgcgccagtggcggtgtagcactgccaagcattaatcgtctcatcgccaatgattttcacttcgataccgtccgggcgggtgaatgtggtggtggtcgtaccatcggcggcacgctccacgtcaacccaggcatcatcaaaggcgcggccttcgagcgtcgggccatcgttcaggtcgtagataccggtaaccggttcggtgccggtgggaatcagcgcctcgttcaccgtcacatgactggcggccttaatctgcaggtggcaggcggcggagtcggcatcgcgttcggcggcagttgcgccctgcttgccgttggccagccacggatgcaggccgagagcccacggtgccggttcgtcgccatcattgcgggcattgacggtcgcggtcatgccgttgtcgccgagttcgtaggtgacggtcacggtcacatcgaacgggtatccgtccaagttggggaagcgcagcgaaagcgtcacggcgctatcggtcaacgattcaagcttccacatgtagtggtaggcgtatccgtggttcgcattgttgcgcggtgcgggatgatattcgttaaccggcacgcagtaatgcttgccattgaaatcgtattcgccgttttcgatgcggtttggccacggggccagcacataaccgttacaggtgggggtcaggtcgttgacgccgaacgggcagaaaatttccttgccttgataatcgaatcggcgaatcttggcgccgagttcgcagatgacggcggaataatcgccatagtgaatcgaatactgatttccggtgcgtggtgttttactcgtcatggaatcactcccgtagtgaggttggtgggccggtagctcctgctatcgctggccccagtctagcgcgtctcctctatcgaggcggggattggcgatatgcggcatataataaacaattcgtataaacacggtagcaatacgtggagtgacgagtctcacaccatcatgcgagaagcacgtggattccttggaaaccggtgatttgtgggagacgcggaaaagttgtgacggcagattcctgtaatccctgccttacactggaaaacactattgacgttcaggaggttccgatgaccaaaagcgttgtgctcgctgatccgcgaggcttctgcgcgggtgtggaccgtgcgattcttaccgtacagaccattctcaaagccgcggaggcttccggaaagcggacgcgcgaggatgggctgcccccggtatatgtgcgccggcagatcgtgcacaacaagcatgtggtcgaggacttggccgggcaaggcgcggtgttcgtccaggaattggcggagattccggatgctgctgcccaagcgggtattccggtggtgttttccgcccatggcgtatctccggtagtgaaggcggaagccgaacgtcgtggcatgcatgtggtggatgccacctgccctctggtgggtaaggtgcaccgtgaggtgctgcgtttcgtgcgcgaggggtatgaaatcgtctatatcgggcataaaggtcacgatgaagcggtcggtgtagtgggggagagccccgaacacgtgcacttgatcgagcatgaatcggatgtcgattcgctggattttgcgcccgacaccaagctggtgctgctctcgcagaccacgttgagcgtggacgagaccgccgataccattgccgcgctgaaggccaaattcccttggattcaagagccgccgagttcggatatctgctatgccacgtcgaatcgtcaggctgcggtcaaactggtggcccagcagtccgattgcgtggtgattgtcggatcggccaactcctcgaattccgtgcgactgatggaggtggcgcaggagggcttgggggagcgcggcaaagcgtatcgcgtggatgatgccagcgagcttgacccggcatggttcgagggtctggaatccgtaggtatctcctcgggtgcctccgtaccggacgaactggtgtccggtgtgattgacgctctgcaaaacttgggtttcaccggtatgaagtccgtcgaaaccatcaaagaaaacatgcactttgtgctgccggcggagttgcgcaggaagaagtagtcattcttggctcccctccgtgaggggagccaagaacggtcaccacgtgccgattggtgcggcaacggcgttcaagaccttgagcaggtcctgtggattcacgcccacagacaggcctcgcttgccgccggagaccagaatttggtcgaattgcagggcgctttcatccaacacagtcttatgacgtgtcttctggcctaacggcgagatgccgccaaccacataaccggattcacgcatcgccgccttgggatcggccatagaggccttcttggcacctacggctgcagccaaggctttcaaatccatatgaccgctcaccggtaccacgcccaccacgcgttcggcaccggtgtccgccatcaacgtcttgaacacctgatgctcgtcgaagccgagcttggtggccgcctccacgccgtagccgtcatccatatggtcgttggagtgctcgtattcgtatacgtggaattccacgcccgccttctccagttggactgtcgccggagtggaacccgcgcccttatcatgcttgcttttctttgccatgattaccgttctactacgaagaaacccccgcacaaggcgggggtctcacagcttagtcctcaaacgaaccgtagcggcctagaccgcaatggttcactcggagatctcagcgaagtacagcagggtacggatcatgttggaggtgaagccgtactcgttgtcgtagaaggacacggtgcgagccagggtcacgccatcaatggtgttgacgtcggtctgggtcgggtcgaacacgccaccgtgggtgtcgccgaggatgtcggaggagacgatgccctcatcgttgtagccgtagtaatcggtgtcggagaaggcggccttgaaggcggcgttgatctcgtcggcggtggtctcggtgttcagcacggtggtcagctcggtgacggagccgtccggaacctggacgcgctgggcgtggccctgcagcttgccgttcacggacggaacgaccttgccgatggccttggcagcgccggtggagtgggcgatggtgttgatggcggcggcgcgcaggttgcggccggtcttggtgccacgcgggccatcgagcagcatctgggtgccggtgtaggcgtggatggtggtcatgaagccggccttgatgccgaacttctcgtccagcagcttgaccatggcggccatggagttggtggtgcaggaaccggcggagacgatcacgtcggaagccttgaggatgtcgtggttcacgccgaacacaacggtcggggtggtgtcatccttggccggggcggagatcaggaccttcttggcgccagcgttgatgtgagcctgggacttctcggcggaggtgtagaagccggtgcactcgagcacgtactcaacaccgtcgttcttgacccacggaatgttgttggcgtccttctcggcgtagaccttgtattccttgccgtcgacgatgatggagtcttcggtggccttgacgtcaaccggagtgccatcgtcatgacggaaggtgccgtgggtgctgtcgtacttcagcaggtaagccaaggtagccggggtggtcagatcgttgatggcggcaacttcaatgtcaccagcctggccgccgcgagcctgcagctcgaagatgcgacggaaggcgagacgaccaatgcgaccgaagccgttgataccaatcttaactgtcatgtaattctcccttgtagggtggccttggcgcgctttggcacaccgggccattgtttaccaacagttgctactgtaatgccgactctgtacacatggcaacgtttcagcgtgcgttttgggcaaaaatgccgtattttctgtgagcgctcacaattcggattgcccgcaaccgacatgtgtttttcctctcctttggaggaatgtctcgaatcatcatgagcaagcgcgcggcatgcaagtcagcgaaccagcagcttggacactgcggtgtccagctcgccgatatcgccgccaaattcgtggaatcgactcacctgaggcaacgccacctcgatggggaaggtgacgatcagtgtgccgtgctccacgctgatggccgcgtccacgccgtcgcggaactcgttgctgcccccctgcaccaccgtattggtcagcgtgccgtctttaagctcgtatttcagccctggttcgttcacgccaagcgaaacatcggagtgggagaacgccgacaccatgcggccgtcctcgggcaccggatgcgcggggaacgaaagcctaccatcggtgatggccgtgacgatgagcccgtcaccatacagatacccgcttgccccatgccgggccaataatgccatcagttgaatgccggaaatcgtatggtcaatgcggccgcccaaaccgccatagacatggaattcgcggcaacccgccgaccaaccgaccttcagcgcggagagcatgtccggatcgtccttcagcgcgggcagcgcgatggtgcgcacatcggtgcggggcggccggccctccagcgaatcgaagtcgcccaccaccacattgggcacgatacccaactggcgcgtatggtcgagcccgccatcggccgcaatcacatacgcgccggccggcaccacgggcgtgcccgcatagtattcgcccgcaccaaaaatcacgcatacctgagtcatgatgcctactgtagccggtatccacccatcggccgggaaaatgctgataggctacgcatcagaacagtagtcgataggcgcacaggcaggggagcggagcgatggcacagatcaccgaggcaagcgaacggccgattctcaaatcaaagatattcctctacatcaccgaattcttctccggcatgtccgctgatctacttcatctcgatcaaggccaagcgcatcgcctgcgtggtcagcgccgtgatcttcgtggccacgtcctgcgtctcgcccctgaccggcttcgcgttctgggaaaccaacctggcctatgagggcgagtccatctacaactacctgcaggtcaagaacctctccgaccgcacgatcctgtccaccaacgtgctgttcggcgtgcagtccgtcacgatgaaagacaaaggactgacaggtatgtactacgacacggccctggctgcgccggcgctcgccgacaatgccaattccgcgctgatcctcggcatgggcaccggcacctacgcccgccagctgaagcagtattatccgaaaatgaacatcaccggcgtggagattgaccagaagatcaccgatctggccggcgaatacttcgatgagcccgccgacatccccgtgaccacgtatgacggccgagcctggctcgccgcctcgcatgacaagtacgacgtgatcatggtcgatgcgtatcaggacatcaccattcccttccagatgagctccaccgagttcttcaccatggtcagagagcacctgaaccccggcggcgtgatggtggtgaacatgaacatgatctcggacggccaaggttcgatcaacgaggcgttgagcgataccatcgccagcgtgttcggcaatgggaacatactgacggccgacgtgccgaacaccacgaaccgtgaactgttcgccaagaagccgggttccggctccgaagagaactccatgcagcaggcctccaaggcgctcaacctgcgtgagaccacctacgagcgcaccggcagcgaagatctcgaatggtatatggaagaggtcgcctctcgattccggaaggtgaacgaaccggactcagcgtcgactattctcaccgacgacaaggcgccggtcgaagtactcggcatgcatgccatcgatcaaatcatcgccgatgagaccggcccatatcggcagattctcaaagacgaaggcttcggcggtctgctgcgcgccgtgcagtaggttcgacacacggaccgcgaatgtccgggcgtatggtagactttctatttggcttgagaaatcaagaaagcggggcaaccccacctggaagcctttcaaggcctcgggttcaaggcaaacagcctagcgattgcgatatacaacgcgtaatcaggaatgacgcaaagaactgatatgcgtctgcagaagctgagcgcatattggcgcgggctttggcttgccatgaacccaaagcattgaacaggactccagcaaaggccctcgccacggaattgaagtagaggattggagtcatcatcagcgacgaaccacgtattaacgacgagattcgcgtcccgcaggtacgcctgatcggcccgaagggcgagcaggtgggcgtcatcgcgacttccgtcgcgctgaacctggccaaggaggcaaacctcgatctcgtcgaggtggccccgaacgcgaagcctccggtcgccaagctcattgattacggcaagttcaagtacaacgagaagatcaaggctcgtgaagctcgccgcaaccagagcaccgcggaaatcaaggagattcgtttccgcctgaagattgacgaccacgatttcgacgtgaagaagggccatgtgacccgcttccttaacggaggcgacaaggtcaaggtcaccatcatgttgcgcggtcgtgagatctcccgcccgattggtggcgtggaactgctgcagcgtctggccgacgatgtcgaggaatacggcaccgtcgagtccaagccgaagcaggagggccgcaacatcatcatgacccttgcgccgaagggcaagaaggtgcacacccagtccgagcagcgtcgtcgtggcgccgagtcccgcgccgagcgtcaggctcgccaggcggctcgtctcgcggccaagcaggagtctcaggctcaggccgcggccgacgcgcagtccgcgatttctcagaagacttccgacaagaagcaaaccagcaaggagggcagcaatgccgaagatgaaaactaattccgccgcttccaagcgcgccaagatcaccggcaccggcaaggtgaagcatgtcggttccgccatgcgccacaacctcgagcacaagtccgctcgcaagcgccgtgaactgtccgccgacgatgtgctgcgcggcggccaggccaagaagctgcaccagcttctgcagaagtgagcatagggcttacccggaaataacaagactttagaaagctgaggaatagattatggcacgtgtcaagcgcgcagtgaacgcccacaagaagcgtcgcgttgttctcgagagggcttccggctaccgtggccagcgctcccgcctgtaccgcaaggccaaggaacagctgctgcactcctttaactacaacttccgtgaccgcaaggctcgcaagggcgacttccgcaagctgtggatccagcgcatcaatgctgccgtccgcgctgagggcatcacctacaaccgcttcatccagggcctgcgtctcgccggcatcgagctggatcgtcgcgctctggctgagatcgccgtctccgacccggacaccttcaagaccatcgtggacgccgccaaggccgccctgcctgaggacgtcaacgctccggttgaggcctgattgcttgaagtcgtgacttcacactagaaaccccgcttccgagcggggtttctttgtaccatgggcactatgaccaacggattcaccagactcaccgagcagttcctcgtccacatcggcgtggagcgagggctcgccacggccaccgtcaccgcctacgaatccgacatcgccaaatacattgattggctcgaaacccgcggcatccacgaaccggacgccataaccaaacaagacgtcgaagactacatcgccgcccttgaccaggcgggggagtccgcccgctccaaagcccgaagactggcctcgatccacgaattccaccgtttcgcgctcggtcagcacgcggtgacggcggatgtttcggccgcagtcaaggcgcccaaaggcgccagcaccctgcccgacgtactcaccgtggacgaggtaacccgtctgctcgacgcggcggcagtcggcggctcaaccgatccggtggtattacgggacaaggccctgctcgaattcatgtacgccaccggctgccgcgtctcggaagccaccggtgcgaatctggacgacatcgacctggacgagcacatcgcgcgactcatgggcaagggctccaagcagcggcttgtgccattgggcagttacgcatgccgggccatcaccgcatacctcaatgcggggcgtggcgagttggaacagcgctccagcgccaagattcccgagaggcgcgcactgtttctcaacaaacgcggcaagcgcatctcgcggcaatcggtatgggaaatcgtcaaagcaaccggggagcgggccggcatcaccaaaccactccatccgcacaccttgcgccattcctttgccacgcacctgatccaaggcggcgcggacgtgcgcaccgtgcaggaactgctcgggcacgccagcgtgaccaccacgcagatctacacgcacgtaagccctgaaaccctgatcgaaacgtatctgacctcacatcccagagcgcggtgagacacaccattttgcgacgcgtccgcccatagcggaatcgcggcgggggagcaccaaagtcggccggaaattcaaggcgtgacaatacagtacataacagcgaaccgtcagccaggaagaggtattcatgctgcagatcaaatcgatctcgaagcgctataaaaccggtgatttcgttcagcaggcgcttgacaaagtcagcctgaacctacgcgacagcgaattcgtcgcgattctgggtccctcgggttccggcaagaccaccttgctcaacatcatcggcggcctcgaccggtatgacgacggcgatttggtgatcaacggcatctcgacgcgccaatacaaggatcgcgattgggattcgtaccgcaaccacaccatcggcttcgtgttccagagctacaatctgatccctcaccagacgattctgtcgaatgtcgaactcgcgctgacgatttccggcatcggcaaggccgaccgtcgcgaacgtgcgcgcaaggcgctggagaaggtcggactcggcgaacacatcaacaagaagccaaaccagctgtccggcggccagatgcagcgcgtggcgatcgcccgcgcactggtcaacgacccggacatcgtcctggccgacgagccgaccggcgcgctcgattcggacacgtccgtgcagatcatgaacctgctcaaggacgtggccaaggaccgcctcgtggtcatggtcacccacaaccccgaacttgcggaacaatatgccacgcgcatcgtcaacctgcgcgacggcgtgatccgctccgactccgacccgttcgtcgtggacgagacggccgaacagccggccgtgtacaagacgatgggccgcgcgtcgatgtcgttcgccacgtcgctggcgttgagcttcaacaatctgaaaaccaagaaggcgcgcaccctgctgacctcgttcgccggctcgatcggcatcatcggcatcgcgctgattctatcggtgtcgactggcgtgaacacatacatcagtgacatccagcgtgacacgatgaccgcctacccgatcaccgtcgactcccagaccttcgacctgagcagcatgatgggcggacagatgggcggcgatgacggatacggcggcaagacgcacaaaaccgacggcatctacccggacgaccgcagcgtcaagcaggcgtccagcctgaccagttcgattaccgaaaacaacctgacccgcttcaagaaatacctggataattccaagagcgagattcaccagtatgtgggttccaccggcatccagtacacatatgacgtgaaattctccgtgttcgaccacgaccccgacggcacgctggtcaatgcggacggcgtgacgatcggatccagcgactctgcctcgatggcctcgcagatggcgtccacaagctcgtccggcatgtccggcacctcgtcgatcacctcgcagcagatgtcgatgctgaccggcaaaaccgatgagaacgccgcgcccgactcgttcaacgagatcatgccgggagcggacgacagcaagctcgtaggcaaggttatcaccgacaactatcaggtggtcaacggttcatggccgaagtccaaggatgaagtggtgctggtgcttgacgacaacaacagcgtgccgctgaccacgctgtacgagctcggcctgctgcccgcctccgattaccacgagatgatgtccaagctcaacgccggcgacaaggtcagcactccacaagacaagatcgactatgctaaggccctcgatcagacgctgtacatgattccggcatccgaccagtacgtcaagggcgatgacggccactaccgtttcatcggcaacgacaaggacgaaatcgaacagcgcctcgaaacggccaccaaactcaaggtggtgggcgtcgtcaaggcgaagaaggatgcttcggccacgccgttggccgctggtgtggggtacgcgcgcgctctgaccaatgatttgatcgaccgtgcggcctccagcgccatcgttaccgatcagaaggccaatccgaacacgaacgtgctcaacggcatgacgttctcgccctcggacgatgccaccaaggtggccgacgcgcgcacctacgtggcttcgctgggcgtgacgcagaaggcgaacatggccaagtcgatgatgagcgccgggcagcagtccggcacgggcgcatcggacgccgctggtgctggtgctgcaggtgtcgctggcgcggcgggtgccggcgatcaggccgccgccatggccgcgatgagcgaacagcagctcgccgacagtttcgacgcgtatatcgccacggcttcgaacgacgtgcttgtcgcgatctacgaccagtacgtgtcgaccggcacctacgacgacaacctcgccgcattcggtgtggtgagtcgtgacgcgcccagctcgatcaacatctacgccgacagcttcgaagacaaggaccacatcgccgacgcgatcaccgactacaacaacaccgtctcgaagaaagacaagatcacctacacggattacgttgggctcatgatgagttcggtgaccaccatcgtcaacgtgatttcctacgtgcttatcgcgttcgtgtccgtctcgctgatcgtctcctcgatcatgatcggcatcatcacctacatttcggtgctggagcgcaccaaggaaatcggcatcctacgcgcaatgggtgcctcgaagcacaacgtatcccaggtgttcaatgcggagaccggcatcatcggcctatgctccggcctgttgggcgtgggcttgaccgtgctgctcaatattccgatcaacgccgtgctacaccacttcatcggcaatgcggacgtcaatgccgccctgccggtgaccggtggcgtggtgctggtgatcctaagcgtggtgctcacgctgatcggcggcctgattccctcgcgtaaggcagccaagcaagacccggccaccgcactgcgcaccgagtaagcgcatcgacatagtacgagacgagatccataaacctcggaacactggaataccagcggcaaaacggtgttccgaggcgagcccggcgagtacattaggatgggcgagcaggtattcccgacaaagggggcgagggcaacgatggacgactggcgagatacccgcgataaagacagcgcattccgtcaaggaacgctgcctatgacaggaacgtatgtcgttgcacccccagcgaacccggatgttgataaggtagacagtatgcctaccgatttgcttggacgtgaatacgaaaccttccccgcacccgaaccgctgcaacagcacggtccggcgcgtgtcattgccatgtgcaaccagaagggtggcgtaggtaagaccaccagctccatcaatattgccggtgcgttggcccagtatggccgccgcgtgcttatcgtcgatttcgatccgcagggtgccgccactgtgggactgggcgtcaacgcgaataccgtggagaacacgatttacaccgcgctgttcgatatttccgtggacccacatgatgtggtgcagcacaccgcattcgagaacatcgatgtgattccggcgaacatcgatttgtccgccgccgaggtccagctggtcaccgaagtgggccgagagcagatcctgaacagcgtgctgcgcaagctcaagtcggaatacgatctcatcatcgtcgactgccagccatcgctcggcctgctcaccgtgaacgcgcttgccgcagctgatggcgtgatcattcccgtggccgccgaattcttcgccttgcgcggtgtggccctgcttatgcagtccatcgaaaaagtgcagtcccgcatcaatcccgcattggaagtggatggcgtgctcatcaccatgtacaccaagacactgcactgcgaagaggtctgccagcgcgtttacgaggcgttcagcgaaaaggtgttccacacgttcatctcccgctccatcaaactgcccgattccacggttgccgccgcgcccgtggtggtctatgcccctgagcacaagacatcaaaggaataccgtgaggtggcacgtgagctcattgctcgcggcatcgtggcgtaacgattgtttcgataaacgatgaatgagacttccctttctcggctcccctctctgagggaagctggctcgcgtagcgaggctgaggggagctccgcggaagccgaaatcagcacggaggaatccgccacttccggcttccgggtcaacctcgaagtctattccggtccgtttgatgccttgctcggcatgatcgccaacaacagactcgagctgaccgaagtttccctctcctcgatcaccgaggaattcctgacatacgtgcgcgggctcgatttcacaaaaaacatggatgaggccagcgcctttctcgatatcgcctctattctggtcgaggccaaaagcgtggcgattctgcccggcggcgaagacagccagcacgacgagcagagcctcgaagtgctgcgcgaacgcgatttgctgttcgcccgactcctccaataccgcgcctacaagcaggccgcaggtgacttccgggcgcgtatcgccgccaactccggccgattcccgcacccggcggccatggacgagggcgttgccgccatgctgcctgagctggtatggacgctgactccgctcgaactcgcccgactgaccgcccaggtcatcgccaacgcgcccgcctccgaagtgtcgatccatcagctgcacgtgccgttggtcgatctgcgggcccaatcgctggtggtgcgcgaccggctgatcgcggcattggaatccaagggcgaccagtcgatatcgttcagcgaattgacccgggactgcacttctcgtattgaggtggtggctcggttcatggccgtgctcgtgttcttcaaacaaggtgtgctgcagtatcagcaagatggtccgtttgccgaactgcacctgaggtgggtacccggcgtagccgaaatgatgagcgacgtgaacatttccgaaggtgattttgcgtaaggacggcgattggtgactgaacagattgacgcaacgaatacaaccgaacacatggcggatgccgaatcgacggctgaatccgcaaaggccgcggtgaggggagtggaggagactcaccccgaatacgtggatttcgcggtagacgattttcccggcgggctgcccgcctgtctggaagcgattctgatggtcgccgaccagccgcagaccgccaccgagctggcccgtattttggcattggatcgcaacacagtcgaagaggcattgcgagccctgcacgattactatgagggcgatgaatcccgtgacatccgcccgcgcggcttcgaactgcgccgcaccgctcgtggctggcagttcgccagtcgcgccgcgttcgagccggtcgtctcatcattcgtcaccgacggccagactgcgagactcagtcaggccgcactggaggcgcttgccatcgtggcctatcgccaacccgtcacccgagcccaagtggccgcgatccgcggtgtcaactccgatggagtgattcgctcgctcacggtacgcggccttatcaaggaagacggcgtggaccccgaatcccgcgcggccctcttggtcacctccgaattcttcctcgaccaaatgggtctgaagagtctcgacgaactaccctccctagcgccattcctcccgtccgtcgccgaaatgacacagtcgaaatcggaagatacggacgtgatttcgtagcgattggggcccgctgcctgaccaatattcgtgcgctagaccatccgatatgtgatttatggtcattgtgactataagtagtgctatgctctcaatgcagggagaacaaccggtatggaaagaggcatggcatgggattcggcaatgtgtccgagcgccgcagcgcaccgccacaggtcggcgtgtcagtggtgattctggcactcggcccggaaggcgataccggcaacagtgccgccgattccggcaacgccgcgaactcggcccattcccgtctctggttgcccctggtcaagcgcgtccgtcagccgttcctgggctgctgggcgttgcccggcggtgacctgcgctccgaccggtcgttggaacagtctgcctacgcggccctcgaatcgaccacagacctgcacccgcgatacctcgaacagctgtacacctttggaggcccgacccggtcccatggcggattgcccatggtatccgtcgtgtactgggcgctcgtcggccagaccgaggccgcgggcttcgaggacggtgacaacgtacgatggttccccgaagacgaactgcccgagctggcgttcgaccatcgccagatcatcgactacgcgctgctccgcctgcgctccaaaatcgaatactccgacgtggccacccgactgctcggccccacgttcaccctgcgccaactgcacggcgtctatgaggcgattggcggcgaacccctcgacttggcgaacttccgccgcaaaatgcttgcctcgggcgaccttgaagacaccggggagaagatgcgcgaaggccgccaacgaccggccaccgtctaccgctacatccccaaacgacctgtcgagaacggtacgccccacgaatccgatggtgacgacatcgtggaactgtccagacaaggcgagcgtgaagacgctctcgacgcgctgatcccatccgcgcgcatctgatttttcccgccgacccgcttcgggccggtatcacagacgtatataggaaaggaaccactatgaccgcactattcactgcgccgtccgttgacgagatcatcgccaagctgggcgcgcaaagcacctgcgatgcaggactgacccaggacccatggcacttcgacaccaccacacccagctacggtcccggtgcctcgatgctcgaccgtctgcccgccaacgcgccgcgccagcaggtgttgccggacgaataccgcaaggcctccgacgaggaactgcagcagcgcatctccgacgccaagcagcgtctcggctccaaactgttgattctgggccacttctaccagcgtgacgagatcatcaagcacgccgatttcgtgggcgactccttccagctggccaagaacgccaccgaacgcccggacgccgaccacatcgtgttctgcggcgtgcacttcatggccgaaaccgccgacatcctctccacgcccgaacagagcgtgaccctgcccaacctgtccgccggctgctcgatggccgatatggccaacatcgaccaggtccaggaatgctgggaccagctcggcgagatctgcggcacccagccggactccgatggcttgcagcagatcattccggtcacctacatgaactcatccgccgcgctgaaggcgttctgcggacgcaacggcggcatcgtatgcacctcttccaatgcgcacgccgtgctggaatgggcgttcgcccgcggcaagcgcgtgctgttcttcccggaccagcatctgggccgcaataccgcccgcgcgatgggcattccgctgagcgagatgccgctgtggaatccgttcaaggcacagggcggcgccgccgatccggccgattacgcccgcgccaagatgattctgtggaagggcttctgctccgtgcaccagcgtttcaccgtcgaacaggtcgaacgtgcccgcaaggcatacccgggcgtcaaggtgatcgtgcaccccgagtgctcgatgcaggtggtcgatgccgccgacggtactggctccaccgcgtacatcgtcaaggagatcgccaacgcgcccgccggatccgccattgctgtgggcaccgaaatcaacctggtgaaccgtctggccgcgcagtacccggacaagaccgtgttctgcttggaccccgtggtctgcccctgctccacgatgtaccgcatccacccggcctacctggcttgggctttggagaacctcgaagccggcaacgtggtcaatcgcatcaccgtggacgaagacaccgcccgcgaagccaaggtggcactggagcgcatgctgcgcgttcacccgtgattcgtccctggcgctcctcgtacatgaggggagctgtccgcgtagcggactgaagggagcagatgacgcaaaaacagaggaaagcaacacaatgagcaacactgaaatcgtcgtcgtgggcgccggcgtcgccggactgtccgcggcactggccgtggccggcaccggacacgacgtgaccttggtaaccaaggccgaactggtggaatcaaacacctatcatgcgcagggcggcatcgctgcagccatcttctccgacgacgacccgaagctgcatgccgccgacaccatggccgcgggccacggcctgtgcgacccgaaggccgtggacatcctcacccgtgagggtgcggagcgcgtccgcgagttcgccgcggccggcgtccacttcgaccgcgacgcgcatggacacatgctgcgcggcctggaagcggctcattcgcgcgcccgcgtggtgcatgccgggggagacgccaccggcaaagtgtttgaactggacgtctccgccatggtgcgcaagaacccgcgcatccacatcatcgagaacgccttcctcaaagatctcatcgtgcggggcggccacatcgccggcgtccacctgctgatcgacgggcaggacaaggatctggccgccgaccgggtgatcttggccgccggtggagcaggccgtatgtacccgtacaccaccaatccgccggtcgccaccgcggacggcctcgccgtcgcatggcgtgccggtgcccaggtcgccgatctggagttctaccagttccatcccaccgccatggccgtgggcgagcacttcctcgtctccgaagccgtgcgcggcgaaggtgcggtgctgctggatgagcatggccacaggtatatgaaggacatcgatccgcgcgccgaactcgcgccgcgtgacgtcgtggcccgcgagaacttccgcgtgatgcaggcgcaaggcggcaagcccgtgatgctcgacgtctcgccgatggcccgcgagaaccccgacctggccagcttcttggcccaccgattcccgaccatcgacgcctatacgcgttcgcttggcttcgactggagcaaggagccgattccggtggcgcccgccgcgcactactacatgggaggcattcgcaccgatctgaacgcccggacctccattcccggcctgtatgcggccggcgaatgcgctcgtaccggtgtcatgggctccaaccgtcttgcctccaactcgctgctcgaggggctcgtctacggacgccgcgccggtctggccgccgtcgcggacggtgacgacgcggtctgggcacccgaaccgttcctgaactccgccaccggtgccgtgttcgaccatgcgccgatcgcgctggccgcccctgccgctacggctgctgctgacgataccgccgccgacaaggtgtggaatcgtacccgcatccagaacaccatgtggcatggcgtcggcgtgctgcgcgacgaggccggactgaaaaccgccatcgccgaactcggccaaggcctcgccgccgcaaacgcccaggctgatgtaaacgccgatggtgctgcaagcagcgttgaggctttggagaaccgcaacatgctcaccgtaggctatgtggccgccaccgccgcgctcgcccgcaccgagtcgagaggcgcccacgcccgcaccgaccacagcgagccagtcgacaactgggcccactccgtcgcctacatcaaggactgacccatgctcacatcacacatcatccgcgtcgccgtcgaagcggcgctcgccgaagacgcgccctacggcgacatcacctgcgagaccaccatccccgcggacgaaaccggctcggcccacctcaccgcgcgcgaaaacggcgtgatgagcggcatcgacgtgttcgccgcagccttcgccgcacagaacccggccgtcaccgtcaccgccgccatcaaggacggcgagcgattccagcgcggccagatactcgccaccgtgaaaggcccggtacgcgacctgctcaccgccgagcgcatcgccctcaacttcactcagcgcatgagcggcatcgccaccatgaccgccgccttcgtggacgcggtgaacgccatctacggcgatgattatgacggacccgtcacccggccgcgccgctacgagcgcacccgcatcgtcgatacgcgcaaaaccacgcccggcctgcgcccgttcgagaaatacgccgtggtctgcggcggcggccacaaccatcgttacggactgtccgacgcggtcatgatgaaggacaaccatctggcggcgctcgccgcgcgcggcatcgacctggccggcgcgatccgccacgtgcgcgaacaggtgggccacaccacgcatatcgaagtggaagtcgaccgccttgaccagattcccgccgtgctcgccggcggagcggacaccatcatgctggacaatttctcgctcgacgacacccgtcgcggcgtggagctcatcgacggtaaggccatcgtggaagccagcggcaacatgagcctggagcgagtgccagccgtggccgtcaccggcgtggacgtgatctccgtgggcgcgctcacccactctgtgcgcagcatcgacctcggattggattggaactagtcatggccgatacccccaacgcatccggtgaacccggcgaactgtacctggacgccgccgccaccgaatcagtgagcccggcagtcatcgaggccatgaccccgttcctgactgaggcctacgccaatccggccagcgtgcaccagcccggcaaaaccgcggcccgcgcgctggacgcggctcgcgcatcatttgccgcggcattgggcgcccggccggatgacgtgatcttcacctcaggcggcaccgaatcggacaatctggccatcaaaggcatcgccatggcgcgcatgcgcaaactgggcttgcggccggtctgcggattcgccgaagccgatggcaaacagccggcaaattgtcgcccgcgcattatcatttccgctatcgagcacccggccgtggcccaatcggcggcatggctgcacgaatggttcggtttcgaagtcgtgcgcattcccgtggatgcgcaagcacatctcgatctcgacgcacttgaacgcgagctcgacggcgaggccagtgaacgtaccacgatggtctccaccatgctggccaacaacgaggtcggcaccgtggaacccgtggaggaactggtccgcatcgcccacgcgcacggcgtgcccatccatgtagacgccgtacaggccgccgggcagattccgattcgttttcgtgactgggatgtggacgccctgtccgtatccggacacaaattcggcacccccaaaggtctgggagcgctgctggtacgcggccgcacacccatcgaaccggtgctgtccggaggcgggcaggaacgcggcctgcgctctggcacgcagaacgtggccggtgccgtggcgctcgccatcggactcaacgaatcgaatgcgcgcatgcaggcgcagtaccgtgagttggtcgcgtcccgagacatgctcatcgacgcggttcgccgggtcgcgcctcgcgccgacctgaccggcgaccccgaacgccgtctgcccggtcacgcctccttcatcttccccggcgtcaccggggaagcgctgctcgtcgacctggacgcgcgcggcatcgctgcctcatccggctcggcctgcgccatcgggcgccacgagattcctgccacgttgctggcgatgggcctcgaaccgtccatcgccaaatcggcattacgcatgaccttccgcaagccgctgacccgcgaacaagtcgaacgcatcagcttggccatcgaagagtcctacaccgacctgacccgccattaaatctgacgccacttaccagaaaggaaacgacgtgagcaccaccacttcagcgcaacccgcgcagctcacccgcaacgagcgcctcgaccggctgcccttcaacaaggcgcaccgcaaactcctcgtcgcctccggcatcggctgggcattcgacgccatggacgtcggcctcgtctccttcgtagtcgccgccatcgccgccgacccgcacttcaacctcaccccgaccgaaaagtcatgggtgctgtccatcggcttcgtcggcatggccatcggcgcggcagtgggcggcttcatcgccgaccgcgtgggccgcaaaaccgtgttcaccgccacactgattatcttcggcatcgccaacggtgccatggccctatcttggtcactcggcatgctgctcggcgcccgactgatcatcggactgggcttgggcgcggaactgccggtcgcctccacgctggtctccgagttttcgccgaccaaacagcgcggccgcatgactgtgctgctggaatcgttctgggccgtcggctggatcgtcgccgccatgatcggctacttcgtgatcccgaacaccggcgactggggctggcgctgggcgctggccatcggcgcgctgccactgctctacgcaatcgtcacccgcgtgcacatcccagaatccgtgcgattcctcgaagccaagggtcgcgaagacgaagccgaaaaggccgtgcgctacttcgaggaagccgggggagtagccccggtaacctctcccaagggcaagccgctgccgaagatcaagacgcgcgaactgttcggctccaagtacctggcccgcaccatcgccatctgggccacgtggttcttcgtgaacttctcctactacggcgcgttcacatggatgccgtcgctgctcgccgaccagttcggctccctgaccaagtcattcggctacacgctcgccatctccatcgcccagctgcccggttacttcctagccgcctggctggtggaggtctggggccgccgcaagacgctgagcatcttcctggccgtctccgccgtggccgccttcgcgttctcgcaggccggatctgtggccctcgtgctcgtgttcggcatgctgctgtccgcctccaacctcggtgcgtggggcgtgctgtacgccgtgaccccggaaatctacccgacccgcctgcgtggcgcggccgccggtgccgccgcagcggtgggccgcatcgccgccatcatcgcgccgctcctcatgccgtggttcctgaccctgtccggcggcaacaaggccgtggccttcatcatcttcgccgccgccttcatcatcgcctgcgtcgccgccctctgcctgcccgaacgcaaaggcctcgatctcgaagactgacggaagtcgatgacgggagaacagatatttgcctgattaccggcagaacccccgcgtcccggcgaaagggacgcgggggttctgccgtttgaaggccgtaaaaacggcagaaatcccgcgaggggttcgtcgagacgcgggagttctgccgttgtgaggtgcttttctatgttccgacatagtcaaggtgtgcgagtaccatcgtgacggtttgtgtgtaggtatgaataaacacctcagagtaagtacttaagtactcgagaacgcaagtaccgaacgattacgcaaaagaatcagtattaagagaggtttcgatggcggttcgtggagatatccgtaatgtggcgattgtggctcacgtcgatcacggcaagaccaccctggtcaatgccatgcttcagcagtcgcacgtgttttccgagcgtgaggaagtgccggatcgtgtaatggattccaacgatctggaacgcgagaagggcatcaccatcctcgccaagaacacggccgtggaatacaccggtccgctggccgccaagtacggccacccggagggcatcaccctcaacatcatcgacacccccggccacgccgatttcggcggcgaggtcgagcgcggcatctccatggttgacggcgtcgtgctgctcgtggacgcctccgaaggcccgctgccgcagacccgcttcgtgctgcgcaaggccctcgaagccaagctgccggtcatcctgtgcgtgaacaaggtcgaccgccccgacgcccgtatcgaagaggtcgtcggcgaaacctccgacctgctgctcggcctggccgacgacgtgcagcacgagggcatcgacctggaccttgaccagctgcttgaaatgccggtcatctactgcgccgccaaggccggctacgcctccgtgaaccagcccgccgacggtggcctgccggacaacgacaacctcgagccgctgttcgaaaccatcatctccaccatcccggcccccgaatacgaggagggcgccccgctgcaggctcacgtggccaacatcgactcctccgacttcctcggccgactcggtctggtccgtatctacaacggcacccttgagaagggcaagacctacggcctgtcccgtgtggacggctccctcgagaacttccgcgtctccgaactgctgcgcacccagggcctcgagcgtatcccggtcgaatccgcaggccccggcgacatcgtggccgttgccggcgttaacgacatcatgatcggcgagaccatcgtcgaccccaacgacccgaagccgctgccgctcatccatgtggacgatccggccatctccatgaccttcggcaccaacgactccccgctggccggcaccgagggcaaggaccacaagctcaccgcccgcatgatcaaggaccgtctggaccgcgagctcatcggtaacgtgtccatcaaggtgctgcccaccgaccgtcccgacgcttgggaagtccagggccgtggcgagctggcgctggccgtgcttgccgagcagatgcgccgcgaaggctacgagctgaccgtcggccgtccgcaggtggtcaccaagaagatcgacggcgtgatcaacgagccgatggaaaacaccaccatcgacgtgccggaagagtacatgggtaccgtcacccagctcatggccgaccgtaagggccgtatggatggcatgaccaaccacggctccggctgggtccgtctgcagttcaccgtgccgtcccgtggtctgatcggcttccgcaccgcgctgctttccgccactcgtggcaccggcatctcctcctccatctctgccggctacgcgccgtgggctggcgccatcaccattcgccagaacggttccatggtttccgatcgcaagggtatcgccaccccgtacgccatgcagcgtctgcaggcccgtggcaacttcttcgtcgaaccgcagtccccggtgtatgaaggccaggtcgtgggtgtgaacaacaagcccgacgagctggacgtgaacatcacgctggccaagcacatgaccaacatgcgttcctccaccgctgacgtgctcgaaaccctgaccccgccgatcaagatgagccttgaggagtccctggacttcgccaacgaggacgagtgcgtggaagtcaccccggagtccatccgcgtgcgcaagatcatcctcggccgtgaggactggtacaagtggcgcgccaagcagcgccgccagaacgccgcccagcagggtaagtgatttggtgcggctgtagccgaccattctctctagctcccctctctgaggggagctaagtttattcctcaccaagtcatatccccacctatactgaaacgcatgactgtgaagagcactactgaattgcgtccgtggtcgtatcgccagaacgcgctggtcaaatcgttgatcacgattgcggcgggcgtggcttccgcctttgtgggcacgttcgcccaccgtatgggtgcggaactgaatattccgtatggtctggtgctggcgtttctgctgatcggcctatcgacatggtgcgcccgttcgcgcatgggcgcggtcggactggccctgcacctcatcgcctcctcactgaccgcatggggcatggcgctgaccaccacatccggcaaagcgctcatcgtcgccggattccaaggcgacatgccgttcttctcccaacatgccggctacatctggctgtacggcctgatactggtccaagtcgtcctgctcattcttcccgcccgctggttcgtcattcccactcattctgaatcgcgcgcgtaactatatatggcgatacattcccgggaatgcgtcgcgtatcggcgggcgtaggggattacggccgctaccatagaactttatggcacgcatgaaactgttttacttgggcccggagggcaccttcacccatcaggcggcaatgacggccgccgaccagttcgccacactcggcgacttcgacctcatcgctctgcccgacgtgcccgcgatcatgcaggccgtacagtcgcgccaaggctggggcgtcatcgcatgggaaaacaacgtcgaaggctatgtggtcccgaatctcgacgcgctgatcgacgcccccaacgcggccggcttcgcccggatcagtgtggacgtggccttcaacgccttcaccgtgcgcggccacagcatctacgactgcaccggcaaccccgtcagcgcccacccgcacggtctggcccaatgcacccggttcatcgccgaacaccatttgcagcccgaacccgcatcctccaacgccgccgcctgccgcgacctgaagcccggccgcgtggcgctcggccccagcatctgcggcgaactctacgatctcgacaccctcgccgaacatgtgcaggatttcgatggcgcgcacaccgaattccttgtcatcgccccgcgtgatgtggtccaggaactcaacgcccgcgcccacagcaatgacgccggcgacttcgaaaccatcatcaccttcatcccgctggtcaccggccccggcgtactcgccgacctgctggacgtcctgcgcgatgcgggactgaacatgaccagcttcatctcgcgcccgatcaaaggccacgacggaacctacagcttcatcgccacccttgacgccgccccctgggagccgagattccgcaccgcactggaagagatcgccggacacggcgactgggcaaaaaccctggccgtctacccacgccgcgaacgcccgaacccgccggtcgacgcctggatgctgcccgagggcggcgtccacatcaccaatcgcgcgccggaaggctggcagtacaccgaggaagcaaggaaggaactgctgtggtagatacagtcggaatcgtcggactcggattgatcggcggctcgctcgcacgccgcctgaccgagcgcggcgtgcgcgtcgtcgcgtggaaccatcgcccgcacccctacgcccaggccgaagccgatggcattttctgcaagagcacgctctccgaactcatggatgccgagccggatgtggtcgtgctgtgcaatccgctcaaggcgatgcccgcaatcctcgccgccctggccccgctcatgggcgaccatccgaacaccacgctcaccgacgtgggctcggtcaagggcatggtccgcgatcaggtcaaggctgccgggctggggaagtgctacgtcggcgcccatccgatggccggcaacgaactgtccggctggcaggccgccgacccgcatctgtacgacggtgccctatgggccatcaccgtggacgagtccacggactaccgccgcttcctcgacgtcgccgcgatgatcaccaaggacgtcggcaaccgcgtcatcgtcgtggacgacgaaacgcatgacaaggccgcggcgatgatctcccacatgccgcatgtggtgtccaccgcgctgatcaacgaactggtcgccaacccggaccgcaacatcgccgccgcgctggccgccggctgctggagggacatgacccgcgtgtccctgaccgacccggaccgcacgcgcgcgatggtcgaggaagactcgctgaacgtcgaagcgctgctgcgccgcatggcggcacgtctgaccgatatggccgaccaactgcacgctggtgccgccggcgagcaggatgtgatgggattcttcgccgaaggcgaccccttccgccggtacaaggccgccgtgacacatgccggcatcaccgctgcacaagacggtacggccaccgctgcgccgcaagccggcacaactgccgccggattcccggaacgcgagctcgccgtccccgaagccggctggcagcagaccttgctgttctccgcacgccggggagaagccatcaccggtttcatccatccgcgtcaggccatcgtccaactgcgccccgccatgtaactgcgccccgccatgtagcccgtgtgcaggttcccctcgccgcccgtcacgaagaaggctacgcgagggggatgaagttcccgcttgttttcgtgagaagaccgtgtggctccgctgttcgaaagacccaaaggagtaaggtagtctgtaccgtttttcgggaaacgcatcgaagttgatgcggtggatggttaaggggatgatgacgtatgacgttaccaaggcagattccggccggtgcccgcgtggtggtgcgcatcaccgacggcattgacccggtcgaccaccgtatgaagttccgcgactatgtggggcatgtggtttcctgggatggatacacgttggagatggtgcgtgacgccgccgccaatggttcgcgcccggcccagaacgtgaccatccatcaggaacagattgccacattgaaacccgtgccggagcggcgtaacacgccaccccggccgtaacccaaggccataaagaattcggaggagaacgagagtgtcatctacgcagttcgacggcgatatcgactccttcgtctcctatctgaagtccaaccgcggcctgtcagcgaatacgctcaaagcgtatcgcgcggatctcacggcatgcctgcacctgttcgagctgcgcggcgtgaccgatctgaacgagatcacgctggatgatctgcgcagctggatggcggtggaatcgcgcgatcacgcccgcagcagcatggcccgcaaaaccgtggccgtgcgcgggttcttcgcgtgggcctatgagcatgggctgaccaccaccgacccggccgccacactgatgactccctcgattcccagcacgctgcccgcggtgctcaccgaatcccaggccgagcaattattggatgtcgctgaacatgccgttgcaacaaaccagtacaaggacgatgggggagcggcagccgcgcccggcagcggcaaggcagctggcaagacagctgataagtcggccgataccgtaaaccgcagtgaggcacccgcccgtgcagacaagcgcgacaacgcccgagtcaccgccgaatcgcagcgcaacgccgcgattctcgaactgctgtatgccaccggcatccgtgtcgccgaactggtgtcgatggatatcgccgacatcgacttctccaatcgcaccatcaaagtcaccggcaaaggcaacaagcaacgcgtggtgccgttcggactacccgcccagcgtgcgctggagacttggctggaacaggggcggccggtactggcccgtacggcaacggatgcagtcaagtcccgtgctgccaacgccctgttcctcggcgcacgaggcggccgtatcgaccaacgcatagcccgtgacatcgtgcacagagcggcccgagaggccggagtgccggatatcagtccccacgccttgcggcattccgcggccacgcacatgctggatggcggcgccgatttgagggaggtgcaggagatgctcgggcattcctccttgaaaactacacaacgctatacgcacgtctccatcgagcagctcaagaaccgttacggacaggcctttccgcgggcatgaccactatgtggacattggttaacaaactcagcaaagactgaacctagccggcaagaacccctgaattttacatgggtgtaacaaaaaatacactgcttgtctcccaagtgcgcaaaaatgacaggtaacagcaacggggttgggtgtccgaagcggcgggaagcgtaagtgtcccgacgatgaggaaatccgaccccgttcgcatgaggcggggctgagacgtcctgcaacctaatgaataggagaaaacatatgaagaagaaagctcttgctttcgctgccatggcttgctccgtggccatgctgctgagcgcctgcggcggctccaacagcaacgctgcctccggtgacaccgctggctccaacatcatcactgcgtacaactccgaaccgcagaacccgctgatcccgggcaacaccaacgaaaccggcggcggcaagccggtcgacctgctgttctcccgtctggtctccttcgacaaggacggcaaggcttccaacgaagtggccgagtccatcaccccgaacgatggcgccacccagtacaccatcaagatcaagtctggctggaagttcaccgacggcactccggtgaccgctgagtccttcaccaaggcctggtcctacgtggccaacgccaagaacgcccagaagtgctcctccttcttctccgccatcgccggctatgacgatctgcagaaggatggcctcaagggtgacgagcagctctccgtcctcaaggtcgtggacgacaccaccttcaccgtcgacctgaaccagtccgactccgtgttcccgattaaggtcggctactcggccttcgccccgctgcctgagtccttctacaaggacccgaaggccttcggcgaggctcctgtgggcaacggcccgtacaagttctccaagtgggaccacaacaaggaaatcgccctcgtcaagaaccctgactacaagggcaacgaggacgtcaagaacgatggcgtgaccttcaaggtctacaccgacgactccgccgcctaccgcgacattcaggccggcaacctcgacgtgatggagtccgtcccggccgccttcaccaagaccttcaagactgacaagaaggtccaggcttactccgaggccggctccgtcatccagaccttcaccatcccgtcctcccttgaccacttcaagaacgacgaggaaggccagctgcgtcgccaggccatctccatggccctcaaccgcaagcagctcatcgacaaggtgctcaacggcaacgccaccgccgccaccgagttcacctccccgaagaccccgggctactccgactccctcaagggtgccgacaacctgaagttcaacgcctccaaggccaaggaactgtgggccaaggctgacgccatctccaagtacgacggccagctcaccttctcctacaacgccgatggtggtgccaagccgctttacgacgccgtcgtgaaccagctcaagaacaacttgggcatcgacgcggccaccaacccgatcccgaccttccaggaattccgtgacgcggtcaccaaccgtcagatgaagggcgccttccgtaccggctggcagcctgactacccgtccgccgagaactacctgtggcagctgtactccaccgctgctgctgatggcaacggctccaacgatggtgactacaagagcccggccttcgatgacctgtgcaagcaggctgctgccgcttccagcactgatgacgccaacaagctgtaccagcaggctgaggaaatcctcctcaacgaccttccggccatcccgctgtactactccaacgcctccggtgtggcttccctcaacgtgaagtccggctacgccttcgattggcagaacctcccgacctacaccgagatgtccaagaagtgagtctgactcactgaacggataccgctaggtagttcggaaataaagggcgaggatcgcaagatccccgccctttttgttgtgtgcggggtgcttgctcacgccatcgggaaccaagttaaagtatccactatccgaccgcaaccatggacatatccaccagcattgcccaatctcaaaccttgcgttaacgcaaatttacatatcacagtccgggcatgcggtaaactgtcggagtatttatcgaccggcgggggcgtactataccctttctggccggtctaggaaataaggagcaaccgtatgggtaagtatcttctgcgacgcattctgcagatgattcccgtggttctcggtacgactcttctggtatatgcccttgtattcgccctgccgggcgaccccgtcaaggccatgttcggagacaagcctgtcaatgaggccgtcgcagcccagatccgcgcagaataccatctcgaccagccgttcatcgttcagtacttcatctacctgaagaatgcactgaccctgaacttcggcgataccttcgccggccagcccgttctcgacgaaatcacccgcgccttcccggtcaccatcaggctcggcttgatggcgttcgtgttcgaggcgattttcggtgtggtcttcggcattatctcgggcctcaagaagggcaagtggtacgacaccgttatcctgatcgtctctctgctgcttatttccgtgccgaccttcgtcaccggcttcgtcatgcaatatgtctttggtattcagtgggcgatattgccggtgacggcaggcgccgaccccggcttccttgatctgctcatgccggccatggtgctcggttcggtgtcgatggcctatatcatccgactgacccgctccgaaatctcctccaacatcgccgaggattacgtgcgcaccgcacgcgccaagggcatgtcgaacggtcaggtcatgctgcgccacgtgctgcgtaactccctgattccagtcgtcacctacctcggccaggacatcggtgccctgatgggtggtgccatgatcaccgagcagatcttcaacatccacggcatcggcttcctcacctaccagtccattctgaagggcgaggcaaacctggtggtgtccatcgtcacgttgctcatgctgattttcgtagtgtgcaacctcgttgtcgacatgctgtacgcggccctcgatccgcgtatccgttacgcgtgatagggaggagtgagtcacatggcaaacgaaaccactgaaaacgagctcaaccagaccggcgagccaggaaccgaatacttcatggaaaccctgcccggtcaggaccgttacgtagctcctctcgacgagaccccgttgcaggacgtcgattccgtcgacgaatccgcaccggccaccagcatgtgggccgacgcatggcgaaccctgcgccgcaacccgttgttcatcatctccggcttgctgatcctgttcatcatcgtggtggccatcgcccccggtctgttcaccaagcaggatccgaacgcctgcgatctgggcaactccttgagccccgcctccgccggacaccccttcggctacgacctgcagggctgcgacgtgtacacccgcgtggtctacggcacccgtacctcactgtccgtcggcgtgctctccacgctgctggtcgtgattgtcggtaccctgatcggtgccgtcgccggcttcttcggcggttgggtcgacgcggtgctgagccgtatcaccgacatcttcttcgcgctgcctatgctgcttggcgccatcgtggtgcttcagatgttcaagacctccaagtccatctggaagatcgtgctggtgctgacgctcttcggctgggtcggcgtatgccgtatcgcccgaagcgccgtgctggaatcgaagaacctcgaattcaacaccgcttccacggccctcggctccacgcctgccagaaacctgttccgtcacatcttgccgaactccctggccccgatcatcgtcatcgccaccacttcgctggcctcctacatcgtggccgaagcaaccctaagcttccttggcgtcggcctgccgaccaccacggtgagctggggtggcgatatctccagcgcacagaccaacctgcagactgatccgctggtgctgttctacccgtccgccgcactggccatcaccgtgcttgcgttcatcatgatgggcgacgccgtcaaggacgccctcgatccgaagagccgtacggcctgagcgaggggagtggagaaacattatgactgacaacaccaacgccaagatgctggctatgcagaaagagcatggtccgctgctcgaggtcaaggatctggccatcgacttcaccactgacaccggcaagccggtgcacgcggtgcgcgatgccaacttcaccgtctaccctggccagtgggtggccatcgtgggcgagtccggttccggcaagtccacctccgccatggccgtgctgggtctgctgcccggcaccggtcacgtggtcaacggctccatcaagctcgacggcgaggaaatcgccggcgccaagcagagcgagttcgacaagctgcgcggcaccaagatgggtctcgtgcctcaggacccgatgagcaacctcaacccggtgtggcgtatcggcacccaggtcaaggaagcactgaaggccaacaacatggacgtggctcacgaaaagcgctccgcccttgccaaggctctggccggcgacgaggtcgaagtcaagggcaacgacgacgagaccttcctcggagccaaggaactgcccgagctcatgaccgaggccaagaaggctttgactgaagccggcgtgtccggcgaggccttcgacaaggccgtcgcccgcttcaccaacgaatgggttccgggctccgaaacccgttggcgcgtggccgacgacctcatcaaggccggcgtggccgacgaccaggcctggtatctggctaagaagtacgtcaccggctccacaatggatgaccgtatcgcgggtctgctgtccgaggccggtctgcccgacgccgctacccgtgcccgccagttcccgcacgagttctccggtggtatgcgccagcgcgcgctcatcgccatcggcttggcctgccgccccgatctgctgatcgccgacgagccgacctccgccctcgacgtgaccgtgcagaagcgcatcctcgaccacctgcacatgctcaccgactcgttgggcaccgccgtgctgttcatcacccacgatctgggccttgccgctgagcgcgcccagcacattgtcgtgatgtacaagggtcaggtcgtcgaatccggcccatcccttgaagtgctccagcacccgcagcacccgtacaccaagcgactggtggccgctgccccgtcgctggcctcccagcgcatcatctccgccaaggagcgtggtgaggatgcggacgctctgctcgatcaccacatcgccggcgaaagcacgctcgaaaagagcgagcacatcatcaccgtcgaccacctgaccaaggaattcaagctgccccgcaagaaggagatgttcaaggccgtcgatgacgtgtccttctccgtcaagcgtggcaccacactggccattgtgggcgaatccggttccggcaagtccaccgtggcgaacatggtgcttcacctcctgaagcccacttccggcaaggtgttctacgaaggccgcgacacctccacgttcaaggccaaggatctgctcggtttccgccgccacgttcagccggtgttccagaacccctacggttcgctcgacccgatgtactccatcttccgttccatcgaggagccgctgcgcatccacaagatcggcgattccaagtggcgagccaaccgtgtcaaggaactgctggacatggtcgagatgccggcttccgtgatgggccgttacccgaacgagctttccggcggccagcgtcagcgtatcgccatcgcacgagccatggctctggatccggacgtcatcgtgtgcgatgaggccgtgtccgccctcgatgtgctggtgcaggatcaggtgctgcgcctgctcaacgacctgcaggccgaaaagggcctgagctacctgttcatcacccacgatctggccgtagtccgccagatcgccgacgaggttgtggtgatgcagcacggcaagctcgtggagcacgccaccaccgacgaggtcttcgaccacccgcagaagcagtacacccgagacctgctcgacgccatccccggcggcaagctccaactcggtctggactgataatctgcgtttgagcgcattgtattgggttctttccatccgtggaaagaacccaatattcgtatgcgcaggtttgcatgatggttcgcgtggaacgaaaggcaaaaattggtgttttcccgatgttgtcccacaaattgtgggacaacatcaacatcaatcgatagacatgagtgttgtcccacagcagatttctcacgaagcccggaattacgccattcttagtgtggtcgataattactcatgctgtggggtgtgggacggcccgcgaaaatcgtcgattttcggatgttgtcccacggaatacgtcatacctcgtatgtgatcgtgagtggggcgtgatcggaccagcgtttgtcatacgtgggagccttgtcgatgacgaatccgcgtgcggtctccgccaactcgggcgtggcgaactggtagtcgattctccagccgacattgttgtcgaaagcgcgccctcgctggctccaccaggtgtatggcccctgaatgtcgccggccaacgaacgcatcacatccacgaactcgtattcgtccagccatttgtccacgtaggcacgttcttcgggcagaaatccggcgtgcttctcattggccttggcgttcttgatatcaagcggcgtgtgcgcgatgttgaaatcgccgcagagcacggcctgtttgccgccatgcgcagcctcgtcccgcaacgcgcccatgcgcttcagcatcgtgtccagaaaacggtacttctgttccattttggtcggataatcggtgttgccagcatgcacatatacggatgccacggtgatcgcgtagccctcaggcgttttgacatcggtttcgatccaacgccctgaatccacatcctcgctcagacctggcagcccatatcgcttgtcaagcacttccaagtcggtgagcagtccgactcccgcgcggcctttcacccggcagacctcgttcatggcatggaggttggccggtgcctcgatcttgccggcggtggcgtattcgaaaccaaattcatcgaaaatagaatcgacatcgtcttgaggcgcgcgaacctcctgtatgcaccagacatccggcgcatgcttgccggcccaatcctcgatgcccttgcgcttggccgcacgaatgccgttgacgttagacgtggtaatggtgatggtcatgcggccatactattttggcctccctacgaatcgaaccggacatcggcggccgcgatgctcagctttctctaagcctgagtgctagtgttagcaaggttgcaaccgttacatgaaacgaggaattatgggactgttcggattcggcaagaagaagagcaagaaggaagccgagccggccattgagcctgtcgatgaagacaaggtggccgccgcagaagcgaacgctgccgcaaaggccgagagcgcggagaccgtgctcgccgagccggccagcgaataccagggccgcggcgaagagcgaggcccgtgggatgtcaacgatgaggacgtgcccgattatgacgattatctggatctcggcgcctactacctgcccttcctccagggcatccagctgcgcatcaaggccaaccgcgccacccagcaagtgcttggttccaccatcaccttcggctcctccagcctggagatcgaagcctttgccgcacccaagaccctgggactgtgggatgacgttcgcggtgacctgcttgaagccaacaaggccgcttctgaagtggacggtgtgttcggcaccgaactgaagctgccggtcaatgtcaagggcggcaagaccgtgaacacgcgcatcgttggtgtggacggcccgcgctggatgctgcgtggcatcttctccggcaaggctgctatcgatccggacagcccggagaccgaggcgctgaacaagttcttcgccggcatcgtcgtcgagcgtggcgaggagcctttggcgccgcgcgatctgatcccgatgcatccgccggtcgcccccgctgagcgtaaggccgccaaggccgcggccgaagccggcgaggcgaacggcaaggaacacttcaaggacattccggacaacaagccgaagggcccgttgagccaggatcagaccaccgaggtgaagaccaccttggcccgtggcccgatgttctccgaagttcgctgatctataggaagagacttggcagacaacaaacgcaccggtctatccgcgctggccgacgccggcaatgacggcgaggacttctccgtcatcgatgccatcggcggccctcgcggcgtcatcgaatccatgctgcccggcgtggtgttcgtcgtactgttcgtggccacgagcaatctgaatctcaccattgcggtttcggccgtgttggcggtattgcaggttattgtgcgactgattcagcgccagtcggtaatgggcgcggtctctggtctggtggcggtaggcatctgcctgatttgggcatggcagactcatgaggcccgcaattactacattttcggattcattaccaatgccggctatgccgcgttgcttgccgtgtcactgatcgcgcgcgtgcccggactgggtttggtcgtcgaattcattcgcagcctgcccaccgagcatttcaaggcatggttccatgactggatggacgacaaggccctgaaacgcgcctatatgattgtcaccggcctttgggtcggtctgttcctgctgcggctggtggtgcaggtgccgctgtatctgaccaaccatgtggctgcactcggcgtgacccgcctgctcatgggcattccgttctgggcattggcgatttgggtgagttacctcattatcgccacgccgatgcaccggcataaggtcgcggctaagaagacacagactgaagtcgctgttgatgccgaactcgaaccgagcgcaaccggaaaggacgatgatgcaagctgaagttcgtatcgaacgatacgccgaccaaggccgctgcgtggcccatatcgacggtcgtgtggtgttcgtccgcttcgccttgcccgacgaactcgtgcgagtcgagcttgacgagccccacgaccgggacgaccggttctggaccggcgaagtcgtcgaggttctcgagccgtccgaagaccgagtcaccccggcatggccacttgccggtcccttggcgatgggcgggggagtgggcggcgcggatctcgtgcacgtctctttgcccggccagctcaagtggaaggccatcaccgtctccgaacagatgagccgactcggccatatcgacgtggccgttcccatcgagcgcatgcccggcgacaaggcagccggcggcctcaattggcgtacccgcatcgaaatgattgccgacgacaacggcatgccatccatgcgccggcgcggcacacacaaccgcgtggccatcgacaccatgccgcttgccacgcgcacgctgctggacgtcgccaagcgcgaacacgtgtgggagggcggctttgaacccggctcccagattcgtctttccgtgcccgaaccgcgcggcgagatcgtcgataccgcggcagcagacgacaattacgccgtacttgtggacggcgaactgcgcgccggctcccagctgctcaccgaacaggtgaccatcaacggcacgaccttcgactatcaggttgacgccaacggtttctggcaagtgcatcgccaagcgccgatcgccctcggtacgcacgtgatcaacctggtcaacgggcagctgcagtcagcggcggacgccgtaatctgggatttgtattccggttccggcctgttcaccctgccgctggccacaatgaccggtgaacgcacccgcatgctcagcgttgaaggcgcgcgtgtggccgtcaagaacgcccagcgcaatctgcgcgccatgaatctgaacgacgtggacgcccgcgcgggtgacgtctcgcgcacgctggaccatgtgccggcgcatctggccaagccgaatgtcgtagtgcttgatccgccgcgtgccggtgctcgtgccaaggtctgccgccagattgccgcggccggcgcatccagcgtggtctacatcgcctgtgatcccaccagcctcgcacgcgacaccgcgacactcatcggcgaaggctacgagctcaaagacatccgtgccttcgatatctacccgatgacccaccatgttgagacggtggccttgtttacccgctgacaggtgagcatatgacacgacgaattctcggattgctggcctgcatggcggctgtgttgtccctggccgcctgcacgccggccggtagggcggtcggcgatacccaagacagcatgccggaagtcgcccacgattccacacatcccacggatgtcacagtcggctttgtggggtcgactgacaccgccgcagacgagttcgtcatcaatgcgctgtctgatgacaaactcaatgtctactatgcctcgctcggaacatccgcaagctcggcaaacgcaactgatggtgtatccggtgaaaccgaatcttctgacgccggcactaccagcgaaaacggtgccgatagtatggatgctcatactggcgtcgacaagaatgcggccaccgcacagcagggtgttgccgatttcgtagctcgcgcggtcaaaatcgtggttatcagcggcatcgacgttaccgacgccaaccgggagagctggaaccagacgttgaccaatgcgcgtgaagccggtattccagtcgctctcattgatccaaagcatgcgcccgaagatgaactgctgtacgccgtcatccttcacctcaacaccaacagtgccgattctggcgacactgccgataccaagccaatgactattactgacgccgtgctcaccatcacgcgcgacgaaccccacgaacgcgagatcaaagtcaccgtctcctgagccgaatcagccccttgaagctgagaaagcaccctgaatcatccctgagccttagtggattgcgaaacaagacgcggtaggctagggaatatgagtgcaacaacagccgtggaaatgcctgagatcggagcgaccggtcttacccccaaagaagtggtgcagcgtatcgaaagtggccaatcgaatgcggtgaaaacctccagctcgcgttcggttcaagatatcgtgcgagccaacgtattcacgctgttcaacggcatcatcttcgccgcgatggtactggtgctgatcaccggttcctggagggacgcggtgttcggtttcgtcatcatcatcaacacgggcatcggcatcgtcaccgaactcagggccaagcgcacgctggacaggctttccatccttgtggcctccgaattcctcgtgcgtcgtgatggcaaggatgtcgaggtatctcataacgaaatcgtgcttgacgacttgttatggattcgtgccggcgaacaggtgccggccgacgggcagatcatccagacctggggactggagcttgacgagtccatgctcaccggcgaatcgcgtaccgtgcgccacaaggtgggggagcaggtgtattccggcgccaccgcggtctccggcatggcattggtcaaggtcaatgcggtcggcagccattcctacgccgccacgctcaccgcgcaggccaaggtatacaagaaaaccgtgtccgacctgaacaagggcatcaacacgattctgaaattcatgaccttcctcgtggtaccgctgtgcattctgctgattctttcgcagattcatacggtcggcggttggggcacggcactctccaccggcgaatggcggcaagccgtggtttccgcggtcgccggcgtagtaggcatgattcccgaaggcttggtgctgctgacttcgctgaacttcgcggtggccgccatgcgtctcgcccgtcacaatacgctggtgcaggagctcgaatccgtggagacactggctcgcgtggacgcgctgaacctcgataaaaccggcacgatcaccgatggcggtatcgccttcaaccggctcgtgatgctcgattccgccaatgcggctgcggaacaggcagccacgcaggccctctacgactgctgcaacgaagagcagcccaacggcaccggccaagccgtactcgccgggctcaaggcccaaggatatggggcaggtgcggttgagtctcgtgtcccgttctcttcggcgcgcaaatggagtgcggtgcgtaaatccggcgagacctggtacatgggagcgccggaggtgattatttctgcgcttgagggtgactattcgtcggtgttgcagcgggttaacgagtatgccaatgacggcaaccgtgtgttgctggttgcgcggtctacagctcccctcagtccgcttcgcggacggctcccctcggagaggggagccgagaagagcgagctggctcccctctccgaggggagctgtcgccaaaagcgactgaggggagcagttgagggagccaatgtctcggacgacccgcaactggatgtgcaggctgagccggtggcgttggtgttgtgctctgagaagattcgcgaggacgccgagcggacgctcgcttggttccgtgagcagggtgtgcgctgtcgtgtgatttccggcgacaatccagtgaccgtgggtgccatcgcccgcagagtgaaactcaccggcgaccatgagccggtggcgatggacgcgcgcgaactgcctgaggacgtgaacgaacttgcccgcgtgctcgaaaacgtcgatgtgctcggccgcgtgctgcctgaccagaagaaggccatcgtgcaggcgttgcacacgcagaaccacgtggttgccatgaccggcgacggcgtcaacgacgcgctcgccatcaaggaggcggacctcggcatcgccatgggcaatgcggcgcccgccaccaaggccgtggcccaggtggtgctggtggattcgaagttctcgcacctgccggacgtcgtggcgcggggccgtcaggtcatggccaatatggagcgcgtggccagcctgttcctcgtcaaaaccgtgtactccgcgctgatctcgctcggcgtagtgctgacgcaaatcccatacccatacctgccgcgccatatcacgtatatcggcgctctcaccatcggcatgcccgcgttcattctggcgctcgcgccgaacacgcgccgctatattccgggattcctcaagcgcgtggtcacgttcgcgctgccgggcggcatcgccaccgcgctgtcggtgctgctggccgcttgggtgctgccgccggtcatgggctggaacgtgaccggcgatgccgcggacctgtccgccctgcgcgccaccagcgccatcatcctgttcgcgatgggcgtgttcgtgctggcccgcgtggccagaccactcaacggttggcgtggcgtgctggtggcggtgttcgcggcggcgggcgtaatcggcgcgttcgtcccgttcgtggcgaacttcttcgccctgattctgccgaccggcgccacgatggtggccacgctgatcgcgttggccggttccgcgctgatcttcgcgctgtgcctgtggctggcgccgctcgtgcgcggactgacgggcaagctctcgcgtcggcattgagacggcggcgcgattgtctcatacttcaagccgacacgccagagcctcggtaacgtgcccgtaccatgtgtagcggataatcagcggcatcataagccgattcatgatttcggaggaagcatgtccttacgcgacgaccagctggctaccctcaaggcagccggcaaggacttcgattactacaacatcgccaatctcgacggcatcgatcatctgccgtactcgctgaaggtactggtcgagaatctggtgcgcaacatcgacggtgccaacatcaccgacgagcacgtcaagaccctgctcgactgggatccgaacgccgaacccagccacgaaatccagttcacgccgtcccgcgtgatcatgcaggacttcaccggcgtgccctgcatcgtggacctcgccaccatgcgtgacgcggtcaaggacctcggcggcgacccggaggtcatcaacccgcaggtccagtccgacatggtcatcgaccactccgtgcagatcgacaagtacggcatcgccgacgcggtccagcaaaacatggacatcgagtaccagcgcaacggcgaacgctaccagttcctgcgctggggtcagcaggcattcaagaacttccgcgtggtgccgccgggaaccggcattatccaccaggtcaacatcgaatacttggccaaggtggtcatgagcaaggccgaggccaacggcaacgcgctcgcctacctcgactcctgcgtgggcaccgactcgcacaccaccaccgaaaacggtctgggcgtgctcggctggggcgtcggcggcattgaagccgaggccgccatgctcggccagccgatctccatgctcgtgccgcgcgtggtcggcttcaagctcaccggctccatcccggagggcgttaccgccaccgatgtggtcctgaccatcaccgacatgctccgcaagcacggcgtggtcggtaagttcgtggaattctacggcgaaggcatcgcctccgtgccgctggccaaccgcgccaccatcggcaacatgggccccgagttcggctccacctgcggcatcttcccgattgacaatgtcacgctcgactacctgcgcctgaccggccgctccgaagagcaggtcgcgttggtcgaagcctacgccaaggccaacaagctgtggggcgacgcttccgacccggattacgtggaaccgcagtactccgaatacgaggaactcgacctcggtaccgtggtgccgtccatcgctggcccgaagcgcccgcaggaccgcattctgctgtccgaagccaagagcatgttcgagaagaccgcccccgcctacgagaccgagaagaccgtcaaggatccggtggccgtgtccaccgacttccgtggcgatttcgacatcgaaaacggcgacgtggccatcgcctcgatcacctcatgcaccaacacctccaacccgtccgtgatgatcgccgccggcctgatcgcccgcaacgcacatgccaagggccttaagcccaagccctgggtcaagacctcgctggctcccggctcgcaggtcgtggccgactacctcaaggccgcggggctgcaggacgacctcgatgcactcggctaccagctcgtcggcttcggctgcgccacctgcatcggcaactccggcccgctgctgcccgagatttccgaggcgatcaacgccaacgacctgaccgtcaccgccgtgctttccggcaaccgcaacttcgaaggccgcatcagcccggacgtcaagatgaactacctggcctccccgccgctggtcatcgcctacgcgctcgccggcacgatggacttcgacttcgagacccagccgctcggcaccgacgcggacggcaacgacgtgtacttgaaggacatctggcccaccaatgccgaggtcgccgccgtggtcgacggcagcgtgagccgcgagatgttcctcaaggactacgcctccgtgttcgacggcgaccaccgctggaagggcctcgacgtgccggaaggcgagctgttcgcgtggaacgacaagtccacctatgtgcgcaagcaaaccttcttcgacggcatgaaggccacgccggacccggtcgccgatatccacggcgcccgtgtgctggccctcctgggcgactcggtcaccaccgaccacatctccccggcaggcgcgttcaaggcctccagcccggccggcaagtatctgaccgagcgcggcgtggagtcgaagaacttcaactcttacggttctcgccgaggcaaccacgagatcatggtgcgcggcacgttcggcaacatccgtctgcgcaaccagctgctcgcctccgtgggcgaggaggtgacgcctggcggcttcacctacgacttcctcgccaagaagccgaccacgatcttcgaagcctcccgcgactacatcgacaacaaggtgccgctcgtggtgctcgccggcaaggaatacggcaccggctcctcgcgcgactgggccgccaagggcacggtgatgctcggcgtcaaggccgtgatcaccgaaagcttcgagcgcatccaccgctccaacctgatcggcatgggcgtgctgccgctgcagttcccggcaggcgaatcctatgagtccctgggcctcaacggcaccgagacctacgatatcgccggcgtcgagaagcttaacgagggcgtgacccccaagacggtccacgtcaccgccacccacgaggacggctccaagaccgagttcgacgcggtggtccgcatcgacacgcccggtgaggccgactactaccgtaacggcggcatcctccagtacgtgctgcgcaacctcatgaagtaaccaccttcttggctcccctctcttgaggggagctgtcagcgaagctgactgaggagagcaaggccggtatccgccaacggataccggccttttccacgcatgccaaaatgctatactgtatagcatcttcgaaatggaggttgccatgaccatggtccaaatgaacgttcgcattgatgcgaaactgaagaacgaggtcgaagaagtcctcaagggcaaaggcatatcggtgagtgacgtaatccggtcgctgtggttgtacatcgccgaccgcaaggaagtgccggcattggaaacgaccgccgaagagcaagcccgcgaggaggaaaagcagcgcaagctgaaactgattcgagaaggtgccggatacgtacacaaggaactggtcaaggccggactgatctcagaagacaccgacctcatggaaggccttacctacaagcagttccgcgacaaaatgtacgacgagcaacttgatgcgtattacaacatgaagagggccgattgatgaccgacgtttccatgcagcgtattttgctcgataccaacgtactgttggactatttgctccatcgcgatgatcacgccaagatggcggaagcggttatggaacttggcgcgaagaacaacattacgttgttgtgcgcgtcattgtcgctgaaggatatcgcatacctatcatcatcggcgattcgtagggaattcaaaccgaatgaatcggaagtggagaatttcactcgcggctttctgtcgtcacgggtgccatggcgttgtatcgagcaggtgaaggagatgtgtgacatcgtcgctgtcgatgagtcgacatgtgataaggctttttccctgcaaaaacggcatcgggattttgaagatgatctgatcatcgttgccgcgcaacaatccggtgccaactgtgtggtcacatcggatgccgaactaatcagtcattttcccgaatattgcaaaacaccggctgaaatcgtggcggcactggaataaatgagcggttggcttccctcacggaggggagccaccaatgatgtgccggccaccgtagcctactgcgcctgtagacggaactgcttccagatgtcgctgagcttctgaccgttgcgcgtgcgcttccacacgtccagaccgccgccgcgacgtcctccggcggcggcacgggccgcggcggtcggagtcggatattcggagccgtcatccagacggagacgaccgttttcggtgaccgtggcaaaccagcgctcgcccttgcgcggccgatcccacaccagacgctcgcccggcaccagcagaccagcgtcaatcacctgccggatcgtgacgcgccgcgaactatgagacggccgtggagaagtcttcgacaactcatcgatattctgcttggtcagatcacgggcgtccttgtcataccggatgccccagtattccacgatgagtcggaccgactcttcctgccgcgcctccagcagggcaggtgtgcagtcagcgaaatccttcaactgattggtcagcgggaaacgacgtgaatccgcgcgcaacagcatgcggtcgcgacgtgccggatattcactcaacctgtccaactgatcctcagggccctgcaccagcgccatattgccgagtcggtacatccagaaatcatgctgatcctgcggccagtccgcaaacgatttcgaccgttcgatatccaacggcataatcggcagcgcactgaaccggcgtggtcgatccaactgcatgccggccttctgctcgttggcgcgaatcagcagcagacggaccaaatcgccgtcaccctgcatctcgccatgcaaacggaccaatgcgccttcacggtcgccgtccgagacatgcaacccgttcacgcgctggaccaaatagcccttgtcaagatcacggatggcggcgttcgcataaccgcgccgctccaacgttccagcgcgattcagcgtgcggatgccggtcacctgttccaatgcggtcagaatttccagcagccgacgctcgtcatgggcgcccaacgattccaacgtggccgtggttctggcgatacgcgaggcacgaaccacgaacggcgacaaatcggcgtcgcccagcccgcgatacgaattgaccaacgcccacatggccacgggcttccactcgtggctgcggtaatcgtccaatccctcaagccggctacgcacctcggcgggcagtacggtatcgctggggcgcgcgataatccgccacgccatcgcgtagggtgccagcacctggttgatgaacgtgggcaccgtgcctttgtcgatgtacggttgcagcacgtcggccaggaaatcctcgatgagcttgtcggtggccggcttgtgcgtgagcacgagatgcagataggcgaagaattcctcacagtcatgcggatcgtcgccaagcgggtcaatgatgtcatcccagcgggcggcgtacacgtcaagttcggcggtcgacaggctggccgtggcgcgcgccttgaacacgtctgacggggtgagcggcaggccgcgcatgttcatcacgtcgaagatgcgatgcgcgccgtcgagatcgtcggtggtcacgatgacgagcgtcacctcgttgaccagatactgcgcgaattgctggcgttcggatgccgaccaattggagatctcgtcgtacgtcttgcggatgttggcgacgatattgcgttgcgcagcggtcgccagatcgtcgtcgttcatgtcgaacacggattcgaggttgtcctcctgcacgtgttcgcggaagaacgccgcgtcgcgctcgcgcaacgtgaggcgaggctcggtgacgatgccgcgcagcttgtcgccgggctccaccagcagcgcgtcgagttggcgcatgaggtccgggtctcgctccagatcgcgcaacacggcgatgatgatcgacagggataccagccgctgctgcccgtcgattacgtcgtaacggttatcgccctcgcgcaccagaattagcgagccgaggaagtacggagtaccgggcgacttgcaggcgtcatccaagtcgcttaccagttgcaggatgttctcggtcttccagatgtaggcccgctggaatgaggggatcgtgaaccggaaatccggggtgaacactttcccgagtggtagttccttcgcactgattgccatgtcagccccttcgtcgccggcctgtggacggtatgccggcataccaacttgtgctcaagcctaccagtgtttgcccgacggcgggcacatcacgccggctcgggcaccgacccctcatacaagtagaacgaagacgggttttctcccggcacggatgcgggcagtgactgctcgcacacctgcgtcaggccgcgatgcacatagaacccgacatcgcatgtggtgtccgtgaacaggaagtagtcgcgcacgccggccaggcggaacgcgtccatcagcgtctcgaacatgcgccggcccagcccgtggccgcgcgccgccgggtcaagtacgaacagcaccacttccgccgcatagtcatgcccggcgctcgcggcctgggcgcgcagccgtttgtcgatgccgagaatgcccagaatctcgccggcggccttgattccgcccttcgcgaacacgagacgcgccagcgcgttccacgagttgatccgatgcgagttgagcgggctccgatggtccagcgcatcgacgcgccccacgatcagggcgaccggctggccgtccagttcggcgacgaacgcgttggtggtgcgcgccagacagttctcccagtccgcttcggccgccagcagaccggtccgctcatcgaattcggcataccaggtgcggcgcaccaggtcgatcagcgccggatagtcatccctacgtaatgttcgaataatcgcttcactcatattcccattatgactgatacggctcaacaaccggacgacttacagccgcgccggcagatcggcccgctccaccagccgcgccatctgcacgcggcccatgtcgagcttgttcgccgcggaagaaagatgcgccttcgccgtacgctccgaaatgaacatgcgggaggcgatttcggcgttcgtatagccctcggccgccagcatcacggcctcgcgctcgcggtcgggcagcgcgtcgagcagggcgcgcgcctcatcgcggcgcgaacgcggccgcgtgacgctcagatcgtcgatcagctgtttctgactggccgtgttgaactgcggcgcgccctcgcataccccgatgatgcggcggatgatatcgtccgccgcatcggttttcgacacgaacccctcggcgcccgcctccaccgcgcgttccacggtgccggacggactcaacgaggtcaggatcagcacgtgcggcgcgggggagagcgagcgcagcagacgggtcgcctcgatgccgtccacgccgggcatggcgatgtccatcagcaccacatccggcttttcctcggcagcccgcctcacgcaggtctcgccatcggtggacgtggagacgacttcgatgcgcccgtgggaataatcgttgaggatcaggctcatcgcctggcagatcatcggatcgtcatcgatgacgctgacccggatcggcttgggctctaagccggtgccgcttccggtcagaccgccgcgttcgggctttccaccagacacactattcccgttcttctcactcacgctagccatcttagctgcgccaaggcagttgcacgtcgacatggaacaggtgccgatcgtccatcccataccggcattgcccgttgaccgagtgcacgcgcgctgccaaaccaggcagtccggccccatgggcccgctgcgtctcggtcgcatccgtggcgatcggattgctgatatggatatgtacgcccgcctgcggcgtggcggagacctccaacgacaccggcgctccgggcgcgtgccgccgcgcgttcgtcaatccctcctggatcgcgcggtaggccaccttgccgattgactcatccatcacgctcagctgctggatatcgatccaggtgttgagcgacgtgcccgagttgcgcgtgtccgcaatcagcgcatccagcgattcgcgggtcagcgacgtgtcgtcggacggggcgagctgctcccatgcctggtgcgggttgcgcagcatgtcgatgatcgagtgggcctcgtccaatgccccggccgactgccgacggatgtcctcggccttatccgccaacgattgcgcttcgggggagtcgccgagcttggccgcctccgccttgagcgcgctggcgttcagggccatcagggacagggaatgcgcgagggtgtcgtgcgcttcggctgcgatggcgtcggcgagctgctggttggtcaggtcggtctgcagggtcgcggcatgcgtggtggccgcgctggccaccgcattcgccgtgcgcaggcgggcgcgcgaacggatatgcaggccgatgagcgtagcgatggtcacgaacaccagtgaggccaccgtggcggtgatgatgacggtcggctcctccaccagcatcaccatcggggagcctgaatcgccgccggtatgcggttgagcgaaaatcagatgccaaatcgaggctttgggctgttgcagggcgtcgcggagctgggagatgagcgtcacgatggtgccgccaaccgtggcgcggatggtcgtgttccggtttgaacgacgggcgagcaatgaggtcatcgccatcagtgcgatgagcgagtcatacgggaacacgaccaccagcgcgcaggcgatccagaacgtcgcctccgggtattcgctgcgggccaagagcaggaaccctgccgggaatgccagcaaggtgcagaggaccatcagcgtgtatcctgcggaatcctgcgcaaaattctgggcgaagaacgaggtttgcgccatgcacatgaaactggccaatggcaccataacgaccgaacaccatacgcgcgtagtcacgggcacctcgtccgtatccggtgtaggaaccggggaccccgtgccgggcatagggcgagcgtcaggccgtgagccgggtcggaaaccggggtatggcccggcggcgcgttgtgggttcgtcatgctttccactgtatgacctgcatccggcccccgccactggacatgcgggcaccgttatcacctccgtattgcccgaacaggcaacgaacaatgaccgttcgtccactaacgtcgctgtttcgcggccggtagcgtcgtgctcacatccctatttcggggaagatacgagaaggagcacatcatgtccaaccacaacatcgccccgcagccggttccctcatccccacagcagtaccagccacaacagcctcagcctcagccgccgcaaccgcaacatctgcataccaccatctgcggcatcgcggccgtggtgtttggcgcgttgggtttggtgctgagttttattcccatcgtcaacaatatcgccgcaatccttggcttcatcggcgtcatactggcgattatcgccatagtgggcaccttccggggcaagaaacgcggcaaggtgctgtccattgtggcggcggtgctgtcggtgttggccattgtgatcacgctggccatgcagtccgctgccagcaaggccattgacgattccattaaggagtccaagggcatcgacacgtcacaatcctcatcatcaaagtccgcgggcaaatcgtctgatgcctccaagagcaaggcatccgagcagaaagcgcagggcgagcaggatttggaaggtgatatcgaaggtgcccacgtgaaaatagtctccgccgtgaaaagcgtcaacgactataacggcaagcccaccgctctggtgacttatgaatggacgaacaacacgtccaagaacaactcgttcgccactttggctcacccgaacgtgttccagaacggcaccgaactggagacggcagtatacttcgatcagcctgaaggctatgacgcgaattcgtatttggcccaagcacagcccgggaccgcggcaacggtgacgctgggctatgtgctgcaagacgattcgccgattacggtggatgtcactgcgttcctatcaacggatcaagacaccaaggtgacgcataccttcacgttgcagtgaatcgcgcggcggtccaagctgcgatcgaatgtcaatcgaatctcaagtgcatgccacgcgcatggtggaaacgcccgttacgctttgagatgagcagaacgagccgatcgatcatattcatggaatgttcagctttgttcctctaagattggtactggaacaaacgctaaaggagcgattatgacattcggtcagcagccccagaacaacgggcaatacaacccgcaatacaacacgcctgattacaacgccgcccaacagtctggatatggccagcaatacgcacagtccggttacggccagaactactatgcccagccgcagggcgctcccacctaccaatacgtgccgcagggtactggtgccggtgcgggtgcggccaccatcaacacgacgatgacctacaactatgaggaagcccgccgagtctcagtgaccaaggtgtacggcgagatgaccatcggcatcctcgtcaccgccgtggtcgccgtgctcggccagatcactggagcctactacagcttcctcatggccaccggcatggtgggcctcatcggcctgtgcgtggtgcagattgccctggccgtggtgctcggcatgcgcgtcaccaagatgaagtcggccaccgcgcgcgtcatgttctatgtgtacgccgcattgatgggcttcaccttgagctcgatcttcatggtctacgaccttggctcgatcggcgtggcactcggtgtcaccgccgcgttcttctttgcgctgaccatgttcggcatgactaccaagttcaacatgctcaaggccggcccgatcctgatgatcggcctgattgtgctcatcatctcgcagatcgtgctcgccttcgtgcaggtcgacggcatgaccaagatcgtctgcgccatcggcctgatcctgttcgccggcatgaccatctacgacgcgcagtccacgcgcgcgctgctgaccgaatacgaggcccagggcccggaaatggtcaagaagatctccatcctgtgcgccctgaacctgtacctcgacttcgtgaacatgttcctgtacatcctgcagctgctcggcaacagggactagcctcgacagccgattggcgagcggcatgtagcctgcccgtcaaacgtcacagcccgaccacattgtggccgggctttttcatgtctgtcacattcgcacgttaggctggctccccgtgaaaagacaagaactcgtaggcatgctgagcctgttgttgaccgcgctgatctggggttttgcgttcgtggcgcaggtccagggcatggattcgatgtcgccgatgttcttcaacgccgcgcgcttcacgctgggagcactgtctttggtgccgattctgctgtggatgcgtggccgggggagcgcggataagggcgatacagccggggccgatgtcgttgggaccgaggcatccgtggccgtctccacagatgccgcatcgaacggtgcatccgacgtcgttaccatcaccggtgccaagctgaatgcgaacaagcccgattcggccgtggcgcgattgctcgccaacccggtggtcatttccgtgatctgcggcatcgtgctgttcaccgccagcaccctgcagcagtatggcattctgtacggcaaatcggccggccgtgcgggattcctgaccgccatgtacatcgtgatggtgccgttgctggccttcgtgttcctgcgccggcgcatcggcatgctggtgttcgtggccgtggcgctgtccatcgccggcttctatctgctgtgcatcaccgatggtttcggttcgatcggcctggcggatatcctgctcgtgttcacggccgtgctgttcgccgtgcatattctggtgatcgatactttgggcggcaccgtggacgccatcaagctttcattcggccagttctgcaccaccgccgtgctgagctgggcgggttcgctgatcgaaggctcggtcgactgggccggcgctgctcattcctggattccgattctgtacgccggcatcggctcggtgggcatcgcgtacaccttgcaggtggtcggccagcaatgggtgccaccgacgcgagccagcctgctgatgagcctcgaatcgttcttctcggcggtaggcggtgcgttgcttctcggtgaagtgatgaccccgcgcggctacctcggctgcgccctcatcttcctcggcaccctactggcccaagcgccggccaggctgccgaagtggccgcaacggtgaatgaatcggccgcaggccgattccatagcacctcagtccgaggtcttaggcgcttcgcccacttgcggcgcgccgttgatgtcgcggtggatgttctgcatctgtacctcgatgttctgcaatgagcgcgcgcagtcgagcagcgtctgggaatgctcggcgagcttgttgtccggcaaatcggtcttgtagcgcagcgcatgctccagcgacgcccaataatccatggcgatggtgcggaactgcacctccaccggcgtgtaatgcgcgcccgaggagaggaacacgggcaccgcgtagattacgtgcaatgaacgatacccgttctgtttcgggttcttgatgtaatccttgacgcgcagcacctgaatatcggactgcgacgacagatagttggacacggaatacacgtcgtcgcggtaattacagatcacgcggatgccggccacatcgaacagattgtccttaatcgaattgacgccgatcggcagacccttgcgctccagtttgccgatgatcgagctcaccgacttcagacggcgttccatatgatgtatcgggtcatggctgaaccgcacctggaactcgtcgtcgagaatctccagtttggtgctgatctcgtacatcgcgccttcatacacctgcatgaggtcaacgaattcaacgacctgttcgggagtgaaggtgcctcccggaagatccaacgctttgagacgggcttgcagatcggaggttttgagtcggctatgtcggtcaagtatcacgtccaccaatatactcggcggattccagccaatctggacgttcgcggggaatctttccaagaacccataatttgacatcgtgacaaccaatggcatacgtgaccggagcatgacgaaccccgtcgatagaatcggtcgttatgaatgaagacatgatgaccgaggcggagcgcgcctcgattgcagccgatggaaccgatggtttgctggggaaacgcggcaagggcgtgttccatatccatacgctcggctgccagatgaacgtgcacgattccgagcgcatcgccggcgtgctggaggccaatggctacgtgcctgcaaccgaggaccagatcaatgacaatgacctcgatttgctggtgctcaatacctgtgcggtacgcgagaacgcagccgaacgcatgtatggcaccattggccgattcaatcgcgtcaaactggttcggccgaacctgcagatcgccgttggcggctgcatggcccagcttgaccgcaagaagatcgcggatactgcgccatgggtttccgcggtgttcggtaccaagaacatcgaagatctgcccaagctgttggatcagaatcgtgcgaccggcaaggcgcaggtccaggtcactgaacaattgcggcagttcccgagccagcttcccgccgcccgcgcctcccgcatcagctcgtgggtggcgatttccgtgggctgcaataacacctgcacgttctgtattgtgcccaccacgcgaggcaaggaaaaggaccgccgccccggtgacattcttgatgagattcgccaatgtgtggccgatggtgccaaggaggttacgcttctcggccagaacgtgaattcgttcggttatggtattggcgatcgatacgctttcagcaagctgttgcgcgcctgcggcaccatcgacggtctcgaacgcgtgcgcttcacctcgccgcacccggccgccttcaccgacgacgtcatcgccgcgatggccgaaacgccgaacatcatgcaccagctgcacttcccgctgcagtccggctccgaccgcatcctgcgcgcgatgcgccgctcctaccgctccgccaagttcctcgacatactgggccgcatccgcgccgccatgcccgacgcgcagatctccaccgacatcatcgtcggcttccccggcgaaaccgaagaggacttccagcagaccatggacgtggtgcgccaggcgcgcttctcctcggcgttcacgttcatctactcgccacgccccggcacgccggccgccgcaatggaacagattccgcgcgacgtggtgcaggaccggttcgaccgtctggtggcgttgcaggagcagatcaccgaagagaacctcgccacattcgagggccgcgacgtcgaagtgatgatcaccggcaaactcggcaagaaggacaccgacacccaccgtgtcaccggccgcgagaaaaccggcgtgctggtgcacatcggcgtgcctgaaggcgaaccggtacctgaaatcggcgatttcgtcacggccaccgtcacacacgccggccgccataatctgcttgccgaccccgacgtggccgccggccagacctattccgtgcggcactgagggggcgtatatgacgcaacgagtcgtctccatcgtcggtcccaccgcgtccggcaagacggggttgggcatcgccatcgcccggcgtctggccgaagcgggggagcgggccgaaatcgtgaacgcggacgcctaccagatgtaccgtggcatggatatcggcaccgccaaacccaccgccgaggaacaggcggccgtgccgcaccatctcatcgacatcatcgaccccgaagacacgatgagcgtggcccgattccagcagcttgcgcgcgagaccatcgccgacctgcaatcacgtggcatccggccgattctcgtcggcggctccggcttgtacgccagagcggccatcgatgacatcaccttccccggcaccgatcccgacgtgcgcacacgtcttgaggaacgcgagaaaaccgagggtgccggtgctttgttcgacgagttgcgggccaaagaccccgaggccgccgcgcgcatggacccacgcaatccacgccgcaccatccgtgcgctggaggtcatcgagcttaccggcaaaccgtattcggccagtctgccgcgctaccggtacgtgattccgtccgtgcagatcggactcgacctggaccgcccggatttggaccatcgcatcgatttgcgcaccaagcagatgtatgacgatgggttcatcgaagaagtcgaacggttgcgcccgcatctgggtgccaccgccgtacgtgcgctcggctatcagcagatcatcgacctgctggacggcatctgggatgtgaacgacgccttcgcggacatcgcacagaaaaccaagcgactcgcccgcaaacagatgggatggttcggccgtgacccgcgcatccactggctgcaggccctgaacccgaaactggtcgacaacgcgatggccattatcgcgcacgccgacgccggcgactacgacccgatcgacgcccgagccgacgaatacacccagcatcatctgggggatatcacggcgtaggaatcagccaaaggccgatgcaatcacccgcaatcagtgtgcaggcccctgattccagccggcgatcaagaacacgcgcgtcggattcgccgggcgtagtatcgcgtcgaacatcgtctccagtgcagacgtgtcaccccgatatgccgagtgcttggcggagcgatactcttcgcgcgtcactgagccccagtcgagatcccagccggcgtcatgcgccaagcgtgaaccgaatatacgcagcaccatcgcattgccgccacggaacggatgcagataaccgagctcatcataaatagaagcaaatgcgtgaacgaacacgtcgcgatccaacgcatgcaggttgcgcttgtccgccaactccatcgcgatgttgtgcgcgccggtctcaatgagcccagccgggaagaacgcctcaggattcgcggctcgagcccggtcgttcgtcacctcgcgtgtggtgtttgaggtacgcaacttgcccgcatcctcaaacacgccttcgaacagccccttatgaatggcggtcagctcatccaagtcgccagacggattccatcgacgttccgccaacaacacggtacgtgcgaacaccgcatccgcccgatccgtggcatgatcatccagactgccggcagccagacgatcctttccggcagggtcggcggcggcgcgcagacgcatggcagtctgttcgtccgccacgtcgatgagatgggtcacgggcttcaagccgcgttcgtaggcagccgcggcgcgcatcgttgcctcgcccggcgtcatcgcttccagtgcgcagttcttgagtgcaaatgcgactgcgctcgcacgctctgcgggtgtcatgcaacccatgataaggcatattcgcgccccagcggggaatcgactcagacgaacgcggcgaatcggctgtcgggattcgtcaatcgaccatatcgtcacggtgtcgtcaccaaccatgcacccccgtactagtagaatcagacccgatatggcacgaacagcatcctccaacagcaccaaaccccgtaaatccaaagacaacgggtctacccatgatggcgaaaccaaggtccagcccgagcttgacctcgaacctgagccgttgtggaagaagatcctgctcgcgattccgcgcgcgttcggctccggcgtacgcgccgtcaccggcgtcggcgaatacgatccagcctaccgtcgtgatggtttgtgcttcctgctgctcgtgctcgccgtactgttctgcgcgtccgaatggttccgcgtcagcggtccattcggccagctgcttcacgccatcgcggccggtgtgcttggtctgatgagcgtcgtgctgccggtgttgctcgccgccgtggccttccgactcatgcgcaattccggtaaagggtccaataacccgcgtgtggtcaccggttgggtgctgctcatgtggtcgatttgttcgatcatcgacgtggcgatcgccgccgaccacaccggattcgacatcacgattctgcaatccgccggcggcctgttcggcttcttcctcggctcaccgctcgcctggggcctttccaacgtgttcgccatcatcattttcgtggtcgtcggcctgttctccttgctgatgattaccggcacccacgtcaccgatttgccggaggatgcgcgcaaaatcgccgctaaaatccaacgcaaaccgtatgtgccgatgggccaggagacggatgggagcgccagccagttccccaacgaggtccgtgtgggagataccactctcgcctttgccgacggtgttccctcgcatgacggcgacgatgacggaagcgacaacgatcaggccggcgatgcacggcccagcctgttcgcacgactgttcggccgcaaatccaagaccgaagacgacaaaactcttgacaagtatgctgccgacgatccattcgaccgtgccgccagccagcatggtgccaccgccgaaaccccggtggtcgatccgatgaccggcgagattatcggtgcgcgaaccattgcatcgtcttcgtacgacggccgtccgcacctatccagccctgcgcctgctgccgatgcagatgatggcgacgcttcccgaacccgcgtcatcaccagtggccagaccgtcgccatgcccggtgggggagcggtagacgacccgtgggcacccagtgccgcccaggccggtactgtcgcgctcgcaggggcagccggtgcgatgggagcggccggagccgccggtgccgcggctgcggcagccgcgaccggagcctacgcgggtgccgatgcggacggcagcggagtcggccagggcgtgcccaatacgggcggccagccgaatgccaccgccggcaacgatacagacgacgacgccaataggccgtatcagttgcccgacctgaacctgctgaccaaaggccagccccatgcgatgcgcaccccggccaacgatcgcgtgatccgggcgctgacttccaccttcgaacagttcaacgtggatgccaaagtcgtcggcttcctgcgtggcccctcggtcacccaatatgaggtcgagcttggccccggcgtcaaggtggagaaagtcaccaacctgcagcgcaacatcgcctacgcggtggccagttcggatgtgcgtatcctttcaccgattcccggcaagtccgccatcggcatcgaaatcccgaacgaggatcgcgaaatcgtgcacttgggcgacgtactgcgctccgacaaggccgtgggcgacccgaacccgatgctctccggcatcggcaaggacgtcgaaggccacttcgtgaccgccgacctgaccaagatgccgcacctgctggtggccggtgccaccggttccggtaagtcgagttttatcaactcgatgctcacttcgatcatcatgcgtgccacgcccgaacaggtgcgtctgatcatggtggatcccaagcgcgtggaactgtccgcctacgcaggcatcccgcacctgctgaccccgatcatcaccgatccgaagaaagccgcacaggccctcgaatgggtggtcaaagagatggatgcacgctactccgacctcgaattcttcggattccgccacgtcaaggacttcaacgaggccgtgcgcgccggcaaggtacatgcgcccgccggctcccagcgcaaggtggccccctatccgtacatcctcgtggtggtcgacgagatggccgaccttatgatggtggccaagaacgatgtggaaagctccatccagcgcatcacccagctggcacgagccgccggtgtgcatctggtgctcgccacccagcgtccgtccgtggacgtggtcaccggtctgatcaaggccaacattccatcccgactggcgttcgccacctcgtccgccaccgattcgcgagtcattcttgacacggtcggtgccgagaccctgattggtcagggcgatgcgttgttcctgccgatgggttccgccaagccgattcgtgtgcagggctcgtgggtgtccgaatccgagattcgcaaggccgtggagttcgtgcgcacccagcgcaagccgaaataccgcgaagacatcgaacagatggccaaggaagccgaaaagaaagacagcatggagcccgacgaggagatcggcgacgacatggacgtgctgctgcaggccgccgaactcgtggtcaccagccaattcggctccacctcgatgctgcagcgcaagctcagggtcggcttcgccaaggccggccgactcatggacctgctcgaatcgcgtggcgtggtcgggccgtccgaaggctcgaaggcccgcgaagtgctcgtccagccgcaggacctgccgcaggtgctcgccttcatccgaggcgaaaccagctcgctcgaagccaccgccccgcaatagcccgaactcggcgaataattcacccatcgaccttcctctgatgagggaggtgccccgaaggggcggagagagaagcgcggccacgcggccatcagcacgcaacctgattcccgaataatggcagtcaatatccagccaatactcactcaaggtagaagtgtgggggtaacgtgaacactatggatgagaacacaatggacaagcagtcatcgcccaaatcatcgctgttcgacggatggaacgcgccgccgaacctggtcacctactcgcgcatcgtactcgtggtgtttttcctgacactcgacattctcgccggtgcctggggtgagaacaacctgaccatgcgctgggtcgccgcggtgctgttcatcatcgccgcgtccaccgataaaatcgacggttggatggcccgcaaatacaatcaggtcaccgaaatgggcaagctcatggatccgatcgcggacaagctgctcacttgcggcgcaatgattgtatgctccgcgttcggcgagctcggctggtgggtaaccatcctgttcctgattcgcgaaattggtatcaccgttatgcgtttcttcgtcatggagcgtccgggcggcaaagtcatcgccgccgcatggcccggcaagctcaagaccgtattccagtgcgtgggtctgtccatgctgctgctgccgttctggtctctgggtaacggacaagccacgccgttctggatgaccgcttactacttcctgacctacgccatcatctacgtggcattggtcctgtgcctctactcgggtgccgtgtacctgtacaacacgttcgtcgccccgaagcggaagtgacggatattccaatgcgggaattgtgcgacagtctcgcggccggcatcctcaagatttgcgaggcgaacaatacgaaaatcgcctgcgctgaatccctgaccggtggcctgcttgccgatgcgttcgtgcgtattcccggcgcctccaacgtgttgttgggctccgctgtcacttacgacatcaatgccaaggcctcgatcctgcacgtggacaaggccctattggatcgagaaggtgccgtacaccccgaagtcgcccggcagatggccgtcggtaccgctcgcctatacagccagccggaatacggcgaccgaatcatcggcctttccaccaccggcgtggccggccccggtccggacggtgacaagccggccggactggtgtatgtgggcctgcgcatccccgcaagcctcaccacggaccatgccgaagtgctcaaagccgtcgaactccatcttgatggcatgcgcgaagagattcgtcgcctcaccgtattccacgttctgcaaaacttgagtctattcacagcaagttttaaggaataaaaccgttgggttgtcgtgttgtacatagtggaaacactgaaccgacctgggaaggggcgatggcgatggaaacgatgacccgagtgaacgaacagatggatgtggccgccaagaagccgatggctgtgcagccgggtgtcgcccgtatgcgtgaactgactccggcccagcgccgtgcggtgatgttcgcccagcagcaggtgctcaaggcacaggccgccaagaaggccaaggatcagcgtcaagccgttcgtgaacgtatgtgggatgaggattcgccgtcgtacaagccgactgccgccgccgagcccgtggtggctgaggaggagcctcgcgagttttcgctgcgtggtgctatcggtcatgtgctgcgcgagctgcgcacgcgcgatcgccgcacgttgcgtgaagtctccgagaaggcaggcgtttcgctaggctacctttccgaagtcgaacgtggacagaaggaagccagctccgaactgctgagctccatcgccgatgcgctcggagtctccacttcgcgcatgctgcgcatggtggctgattatctcgactcggtcgagggctgatcggttggcggtgtgaagccgcgtcccgtaatctatgtctagctgtgaacccgtatcgcttgtggcgatgcgggtttttgctgtcctgcggttggtggcacactggcgtgtatgcgtgaacgggaattctgggaattacttgaagaggtgttcggtcggacctacggtcgttcgctgtcgcgtgatcaacggatgcccaaactggcgaatatgaccgtggtcgaggcgctggacgcgggggaggagccacgcgtggtctggaatgtgctctgcgaccaaatggaggttccggactccaagcgttggggccacgatcataacgcgccgcccatgcccgccgtctgacactgcgggattacggagtcgctgaatcgtgaaattggcgatttcggcgtgttgcacgccaaattcgaacaaatgttcgtgtgtgtggttatagttatccacagtgacaagaagccgcatacgtgtgcacagggtgcttgccatctgccataatccttaccgcagtagggtttaaggaggccaggtggccaagctcgggcaagctggaaccacaatggttggtttggattgcctcacatggcatgtccgtcatacggtggaggcatccgattcgcacacgacttcgacaaggagaagatcatggcacttgagaccaagccggccaaggacccggcagccgaggacaagcacgagctcgatcccaagcgcaaggcggcgctggacaccgcgctggcgcaggtcgagaagagttttggcaaaggttccgcaatgcgactgggcgaccagcccgagcagaacgtcgaggtgattcccaccggttcgttggctctcgatatggcgctcggcatcggcggcctacccaagggccgcatcgtggagatctacggccccgaatcatccggtaagaccacgctcgcattgcatgtggtggccaatgcccagaagaagggcggcgtggcggcctacatcgatgccgaacacgcgctcgacccggcctacgcccgcaagctcggcgtggacaccgactcactcatcgtctcccagccggataacggcgagcaggccctcgaaatcgctgacatgctgattcgctccggtgcgcttgacgtcatcgtcatcgactcggtcgccgctttggtgccgaaggccgaaatcgaaggcgaaatgggagacagccatgttggtttgcaggcccgactcatgagtcaggcgctgcgcaagatgaccggcgcgttggctcaggccggcaccaccgccatcttcatcaaccagctgcgtgagaagatcggcgtgttcttcggcaaccctgaaaccaccaccggtggtaaagctctgaagttctacgcctccgtgcgtctcgacatccgccgcatccagaccttgaagaacggcgacgaagcggtgggcaaccgcacgcgcgtcaaggtggtcaagaacaagatggccccgcctttcaagtccgccgaattcgacatgctctacggtgaaggcatttcccgtgagggctcggtgatcgacatggcccagcaggttggcgtggttaagaagtccggttcgtggttcacctatgagggtgatcagctcggtcagggacgagagaaggtccgtcagttccttaaggacaacccggccatcaccgaggagattgagaacaaggtcaaggccgagttcggtctgatcggttccgccgatcagttcgcggaagatggcgaagccgcagcagcggccgccgtcagcgaggctgctgcggctgacgtggccaaggacagcaaggccgcagcggcgcctgctgccaaaacgacccgtgccaaggccggcacagctaaggcctgaacatgattagtgccgaagcgttcttgcggcgcaatcctgttgcgtcgcaagacatgcccattgccgagcagcatgttcagtcgaaaccgtcgggacgtttttctcgacgggggagagacgctgccgttgtcgaagatcccaatgatttggacgcttgccgcgaggctgcattgcgtttgctggacgcggccccgcgtgcatccggtgcgttacgcgaacgattgcttgccaaagggtacggcgaggcgatcgtggacgaggtcatcgaacggctgattcgcgtgcaactgattgacgacagcgcttatgccgaatcggccgtacgctattgtgccggtcgcatgatgggccgtcgtggtacggtcatggaacttgctcgcaaaggtgtggaccgcaagctggctgaacaggtgtgtgacgaagctgagcaaaatggcatctttgaagatgccgcatgggaattgggccgccaaatagcccgcaaaacccatggcctcgatcgtcgggtccgtcagcgtcggctttggtccgccggcggccgcaaaggccacagccccgaaaccctccgtcgagtcgccgccgaattgttggtgtagccaagaaaaaaatgagacctcttataccccgggttctgtcgtgccgtgcgcgaacgcacggcacggatggccatccatctcgacctgacgttaccgccaggctctagcagcctacccgatgacacgggcgagcagcccttaccgccatctgcttggccttgctcccgatgaggcttgccatgcgacctactgttaccagaggcccggtggtctcttacaccgccgtttcacccttacccgtcgaggacgggcggtctgttctctgttgcgctatctctcaggtcaccctgggcggacgttatccgccatcgtgctctatggagcccggaagttcctcagccgatcccaatgaagatcacggccgcggccatcaagaggtctcaagcttgcaattatacataaggtgcggaaaaggcggcatcccgccctgcggtgaggccatgccgttgcccggttatcctgttttctccatggttgggcatagttgggcgattcgtgaacgacgcgccgaatatcggatggggcgtgtcgggcgtgttgtggcgtgtcgtatggagacgaatcaaatctgtaagagcttggtatgtgcgagaaagagcaagaaaacgctgcctatccattgcagtatttaccatgacgaacaaacgagccagcctgataaaccggtatcaaatcttcttataggagactgctgccaaagccccagtatatacatcgtttcattgcagagaaaagcccgggaataaacatatattctctgggcgagtttccggccgttcacccattgttcgtctacaatgaaacatacccggtcggtgatgatgccgttcggaacacatatagcgggttacaccgcttgagttagaggaggtcaacatggaaatcgtcgttaccggacgccacacgcaggtcaagcaaaggttccgtgatgtggtcgagaccaagatgaatcgtgtgaccgctatcgccccggatgctcagcgcgcgcagatcgtgctgacccatgagggcaacccgcgtcaggccgataccgccaagcgcgtggaaatcaccgttatcgccggacgtaccgtggtgcgtgcggaggcttccagcaccgatgaattcagcgcgctggacatggcgctggataagttgacgctgcgtctgcgtcgtactcgtgaccgtcgcaaggatcaccgtcgtggttacgcgaacccggtcccggtggatctgggtgttatcgccccggagcccgagccggaggtgtcggaggaagagccgaacaacagcccgcaggctgcggtcgcctccgatcttggccctggcgaatccgtggaggtccaggttggggatacgccgattgtcatccgtcgcaagctgcacatcgccgagcctatgagcatcgacgaggcgctgtacgagatggaactgatcggacacgacttcttcctgttcgtgaacaaggagaccggacgcccgtccgtcgtctaccaccgtcacggttggagctacggcgtgttcgaaatcgacactccggagaatgtcaagaaagcctgaaggtaaggcctgctgacacgatcagctgataccgcatggaccgcttccaatatggaggcggtccattttttcgtaaaaaggtcgaaaaattcgactgctgacggtgtgaggcgctatcctgatacgcggacaccaccacttatcagtcaagggagaacccagtggtcgatattattgacaaagccctgcgaatgggtgaaggccaccagctcaagaagctggagaacgtggccaaggccgtgaacgctcttgaggacgagatctccgccctctctgacgaggatctgaaggcccaaaccccgaagttcaagcaggaaatcgaaaacggcaagagcctggacgagatcatgcccgaggcgttcgccaccgtgcgcgaggtctccaagcgcacccttggccagcgtcacttcgacgtgcagctcatgggcggtgctgccctgcactggggcaacatcgccgaaatgaagaccggtgaaggcaagaccctggtcgccaccctgcccacctatctgaacgctctcgaaggcaagggcgtgcacgtggtcaccgtcaacgactacctcgccagctaccagagcgagctgatgggccgtatctaccgtttcctcggcatgaacgtcggctgcatcatcaccgagcagaagccgccggagcgccgcaagcagtacaacgctgacatcacctacggcaccaacaacgagttcggcttcgactacctgcgtgacaacatggcatgggagaaggccgacctcgtgcagcgcggtcaccactacgccatcgtcgatgaggtcgattccatcctcatcgatgaggcccgtaccccgcttatcatctccggcccggccgaaggcgacgtgacccgctggtaccgtcagttcgccaagctggtgctgaagctcacccgcgacgaggactacgacgtcgacgagaagaagaaggtcgtcggcatcctggacccgggcatcaccaaggtcgaggacttcctcggcatcgacaacctgtatgagccggccaacaccgccctgatcggctacctcaacaacgccatcaaggccaaggaactgttcctgcgtgacaaggactacgtcgtcacccagggcgaggtgctcatcgtcgacgagcacaccggccgtatcctgccgggccgccgctacaacgagggtctgcaccaggccatcgaggccaaggaaggcgtggaggtcaaggccgagaaccagaccttcgccaccatcaccctgcagaactacttccgtatgtacgacaagctcgcgggcatgaccggtacggccgaaaccgaggccgccgagttcatgaacacctacaagctgggcgtgctgccgatcaagaccaacaagccgatgatccgcaaggaccaggacgacctcatctaccgcaccaagaaggagaagctggccgccatcgtcaaggacgtggccaagcgtcacgccaagggccagccggtgctgctcggtaccgcttccgtggaaagctccgaagtggtctccaccctgctcgacgtggccaagatccctcaccaggtcctgaacgccaagcagcatgagaaggaagccgccgtggtcgccgtcgccggccgcaagggagccgtcaccgtggccaccaacatggccggccgtggtaccgacatcatgctcggcggtaacgtcgagttccttgccgacgccaagctgaagtccgagggctactctccggaggacaccccggaagagtatgagaagcgttggccgggcaccctgaacgagatcaaggcccaggtcaaggacgagcacgaggaagtcaaggagctgggcggcctgtacgtgctcggcaccgagcgccacgagtcccgtcgaatcgacaaccagctgcgcggtcgttccggccgtcagggcgatccaggcgagtcccgcttctacctgtcgctggaagacgatctgatgcgtctgttcaacacccagctggtggcccaggtcatggccaagggcatggaggaaggccagccgatcgaggccaagtccgtgaccaagggcgtgcgcaccgcacagaaggccgtcgaatcccgcaactacgagattcgtaagaacgtgctgaagtacgacgacgtgatgaacaagcagcgtaccgtcatctactccgagcgccaggctgtgctcaagggcgaagacatccacaaggacatcctgcgtttcatttccgacaccgtcgagtcctacatcaagggtgccaacaagggatccgagaaaccgaaggactgggattgggagggcctgttcaaggcgctcaacaccgtgatccccaccaaggtcgacgaagacgaggtcaggaagatcgtcggcggcctcaagggtgcgaaggccgtcgaggccgtgcgcgacctgatcgtcgaggacgccaggcagcagtacggcgaaatggaggagaccatcggcgagaccggcttgcgcgatctcgaacgccgcgtggtgctcgccgtgctcgaccgcaagtggcgcgagcacctttacgagatggattacctcaaggacggcatcggcctgcgtggcatgggccagcgcgacccgctggtcgaataccagcgcgaaggctaccagatgtacaactccatgatcgaggccattaaggaggagaccgtccagctgctgttccacatcgacatcaagcaggtcgccaccaccgacgaggccgttgacgaggtcgaggagaccgccgaaagcgccgacaccatcgccgtggcctccggccccgacgagaacggcgaatccgtggtcgaggccgccgagggcgaagtcgaggaagaggacgaggatacggacgccaagcaggcgatcgccgaatccgcagccgcctccggggccggcgagtccacgctgcctgttgccggaccggctccgatcagccacgccgaaggcaaggtcccggtttccaagcgtccgaagagcgaagagctcaagacgccgtgggccgacggccgcaccttccctggcactggcaagaacgccccgtgcccgtgcggttccggccgcaagtacaagatgtgccacggccagaacgagaagtgacgcatcgctagttagtaactagctcatggctccccacacggggagccattttctatgcggttcatcagcatgtattcgtgcggtgccgtacgcgcgggacggcacgcgattttcgcggattttgacgtcgtatcccacactgttgcgggatggcacgagtgtcaatcgattgactagcgtggcgtcccgcagtacgaattacggaatcgttgaaattccgccattctcggtgttatggtgtcacggtccgcaaagggtgatgtgggacggcacggctcaaacggcgaaaatgagctgccgtcccgcagttttacgggatagcacaaaaaagaggcttctgctgttttcgtgggttgtcgggcgcgtcgctcgtccaactgacgatgtggaacccgtcgggcgcgcgttcggcgttcgggcaccactcatgcacgcatgagtcgatccaccgggccccgtccccggcgacgaccctgatggaggcgcgctgttcgggcgtcaacgtttggaagaacaggccgaacacgtccctgccgtacccgtcgtgcgcctatatcgcccgatgccgttcgtggtcgacgaccacggtgatgcacgtgtggcctttgcggtagctgatctcgtccacgccgatcgacgtgaggccgccgaacggagacggcatcgacgctttcaaccgttcagcgaccctatgggcggcgtcttccggcggcgcgccacgcgacgtgcggaaaaccgcttacggtcttctggttcgcgacgctcatcggccacgcgcgttccgattcgaaatcgcgtgtggaccggctgcccggctcggcccacggcacggaagcgaccacgacgccgcacgccgccgccctggtcatgcccgcggcacctccttccgcatcgggagcatcggagcatacccgcacgtggacgcacccggatctcgagcacgggttcggaacgcggcggcgaatccgtgatccgcgcatcctctgcaaccgtgcctttgacgttcggcaatccggtgaatgggcttttgcccaggcgttcttcgtgattcatttctttggtcggaaaacagaatacgcgggaacgcccctcacgcttacgaaaccaacggctcgacgacgaaccgacatccacgaaaacagcaatagcgccatattttgcaatatggaagattcagggccttgaaatgacgaaccattacaatgagcggcgaacatacatcacacggcgtaggaaacgccaaggagggcatcatggccgagatcacatggaagtcgattctcaccaagctggtcgggggagaccaccttactgctgaggaatcggagtggttcgtggacgacctgatgcaaggtaacgccaatccggccgccgtgggtgccgcgctcgctatgcagcagcagctgggactgaccgccgacgaggtgcgtggtgccgccaaggccatggtctcccacgccgtgccgctgaacgtttccggtgggaccaccgacatcgtgggcaccggtggtgacggcttcgccaccgtgaacctgtccaccatgggctccgtggccgccgctgcagccggcgtgaagatcgtcaagcacggcaaccgcgctgcatcctcgaagtgcggtgccgccgatgtgctcgaagacctcggcctgccgctggatttgaagccggaggccgtcggcgaagtgggcgacgaggtgggcatcaccttcgcgttcgcccgcaccttccacccggccatgcgcttcgtgggcccgattcgtgccgcgctcggcattccgtgcgtcttcaacatcctgggaccgttgaccaaccccgccaacccggcacacgtggccatcggctgcgccaaccgcaaggtgagcccgatcatggctgccgtctacgccagccgtggtcagtccggcttggtctacacttcgcatgagggcatggatgagctcgcccccaccggcccggtttccgtctgggagattcgcgacggcaaggtcaccgaaaccgagttcgacccgaccgtggatctgggtctcgccaagattaccgtcgaccagctcaagggcggcgtgccggacgtcaacgccaacgcatttaaggacttcctggccggcaaggacattacgtcccgcaccaccgcgctgctcaacgctgcctccgccatcgtggctgacggcaatctggtcggcaacggcacactggccgagcgcttcgccgaggcctacaagctggccgaggatgctgtcgactccggcaaggctgaagccctgttcaacaagtggatcgaaaccgccaagtccaaggcgtgatatggaatgggtttgctcgaatatatttacctttccttcattatcaactatttcgagttgcaggagtccatcgacttcaattcgtgacctatcttggctcggccgcaattacggacgagctacgcctgtgatacattggttcgctatcgctcacacctcgcctacaaacagcccactgggctgtttgcttaacggctcggcctcagagaggggagccaaggactacacaacctacgcgaactacaccctcgcgccgtcgtcgtaatagccaccctgatcaccggggcggtctttgcggttgaggattttggccaccaatccgcccagacccaaaatgacgcccagcccgaagagaatattgagcagcgcgcctaagagaggaatcgcgttcaagccgggaacgaatatcatcaccgtttcgcctgcgagaccgatgatgagcaacgccgtcagcagtaccgtagatgctttgaccggaccaagatcagggttcgggggagtgaagccgccatcatcataggcgtccatcacattatcggtatccagccagctagagccggtgaaatcacgggggcctggctgcttgccttttttgccgccacggctcgggcgagcatcatcggtgaacgagccgatatccaagtcatctacggaaagcagtgcttccttctcgcgtttcttggcctgcttctcgaactttttggcctgcctggaggaagccacgtcatgcaagtcggcctgatgctcggcttcgaacgcggcccacgccgcatccaaatcgttcatgtcatgcgattgcggtgtatcggcaccattcgtggccggtccggcggcaccgggagtcgacgacttggacgaagtatcggaatcctgtccgttgcccggcgtgggggttggccgctctccgtcggcattgctattctggttctcagtcataactgtcactctaatcaggcgaccggccaatggctagttcgtctgcgggaggaatgccaagtgctctactggttcttcgtcaaaggtctcggccctattgctcatcatcgtttgagccctgctgtcagcggactgaataacgtgcctcgagagggtggcgcgattatcgcagccaaccatctggcggtgattgacgatgctttgattccgattacctgcccgcgcatggtgcacttcatgggcaaagccgaatacttcgagggcaagggattgaagggcaagttcaagaagtggtggttcacgtccgtgggcgtgttcccggttgatcgttccggtggcagcaagtcgcttggcgcactcgagcatgcacgcgagattatcgaggatgggcacctgttcggtatccacattgaaggcacgcgcagcccagacggtcgactgtacaagggacacaccggtgccgcacgacttgcgctcgagaccggttgcccgattgttccgaccgccatcatcggctcggacaagctgcagccgattggcacgtcgattcccaagaagggcaagaccaaggtgttgtatggcaagccgattgaggttgcgaagaagccggctgatgaaattacacatgatgatttgcgttcgctgaccgatcgtgtttccaccgcaatccagaaaatgagcggtcaggaattcgtgaacgaatacgcccagaaggtcaaggccgagctcaaggcccagcaggccgctgaagaagccgaaaagtaattaacaaatgaggctccctcgtctgaagacagagggagcctcattcaaatctcacacgatggtgagggtgatgacggtggggttgccgttggcgtcgcgcaagcgaatcttgccgccgttggagaggtccgtatcgccgcttttcacggtacgtaccgtgccgaacaggccaccgagcaccttgtcggttttcacctcgaacccgagaccttcaagtgtcttggttacggcgctttcctgtttgccgacaaggccggacggtatcgtcgccatctccggacccttggaaatcaccacgtccacgctatcgccccacttcagctgggctccggcttcctgagacgcggaaatgacttgaccggcctcgaccttgtcatcgtactgttcggtgacattggccgtgagcttcaactcgccgagcgcggcttgcatctcatcctgggtcttaccgacgatgttaggcatggtcaccggcatcggtcccttgctcaaagtaaccgtcacctcatcgttgtgcttggccgtggtaccgggatcaggggagatcgtcaatgccacaccctgcggcgtgtccatcgaatactcatccttcgactcgtcatgcttgacattatcgaagccggccttcttgagcgcgttcaacgggtccttgccattggccgaattcgcgtcgagaatatccttcgggatggtggtcatccgcacgcccttggacaccaccaccgtaagctcctgattggctcgcttgcttatgcggctgttcacaacggccttggtcttgttcacggaagaagagatgatcttgccttccgccacgtcgtcgctgtattccttgtgcgtcttgtaggggatgccgagagccttcaacgtgctctcatacgtggcccaatccgcgccggccaacgagcattcggtgcttgcattcgcatcgcaggtcacgtcatccggcttgggcacactccaatagctgcccggtccggcaaaccaccaccagccggcggttccgccgattgcagccagtaccagcacgatcaccagtacgatgatgagcggttttttgctgcgctgcttctttggcccggtgccgttggaagcgacgtccggctcatcggaaaaggcaagcgctcgggtgaaggcatcgccggcctgaggcagcacttgtgtctcgctgccggactgtgccatgatttgcgtcttatggggagccgaagcatcggctggcgtcgacgaatcaagtgccgtggtgggggcgaccggaggagccggaggattgacgtctgcggcgccaccggtatcgacggtattgcttgcgacatcatcggccaaaaacgctggtacggacggcttgaacgttgctgcaccggcaggtacgccggtcagcggggcctgctcggcgatattgcctaccagcgctgcagcggtggcatcggtatgatcacctccgatgggttcggcatgcaaacggtattgccacgtctccagcggcaatttggcggccaactggctcaattcctcagctgctgccgcgccatcggtggggcgggcatccacctgacgcgcggtcagatgggcgatgaacgccgccacggacggatcaatgccctgacagaccgtggccacggacggcacgtcctcatgaacatgcttgaaaacaagcgtcaccggattatccgaatcgaacggcaccttgccggtcagcatctcccatgccatgatgcccaccgaatacaggtcgccttgcgcggtggcctgattgttctcgatcatttcgggagccagataagcggcggtgcccaatagcatgccggtggagctcaatgtggcctggctggcggccttggccagaccgaaatcagtgatctgcacatggccgcgatcattgatcaaaatgttctcgggcttgatgtcacggtgaaccacgccggcgcgatgtgcggaagccagaccatccagcgtctccgcgaccacgcgcagcgtctcacgtacggagaatgtgccttgggcgttcatctcatgccgcagattgacgccatgcacatattccatgaccagaaaatcaagtccattgaactcgccggtgtcatacacctgaacgatgtgcgggttggcgatggacgcggccgaattggcctcgcggcggaaccgttcgacgaactgctcccgatgcgggcctttggcgagttgtgtgtgcatgaccttaatcgccacggtgcgccccagacgctcatcgatggcctcatacacggtggccataccaccctcggcgatattgcgcacgatgcggtagcgtccctcaatcatctgtgcgggctcgttctcactcatgttgtatcgtacggttcctttaatcacgactaaacatgttcagtgtacatggccccggttacgcggccggagcatcagcgcatagctttcacgggttttcaccggtgttcatggtctcatggtccggcggctcgcattgtggactatcgcaaggattcggggacgaatcgcgcacaagcctcggtcagacggcgttgcgcttcggaattcagctcaagaccggcaatcgccttacgggactcaccccatagggcagcgatgcgctcgcgggatcgatcaagagcaccggtcgacgtgaacagttcaatggtgcgggccacctggttgtcattgcgacaatcttcttcgaagatggcaatcagatcggccttatccgccgtatctgccgcagacagagcatcagccaacagcactgtgcgtttgccttctcggatgtctccgccaactggttttccggtattgcggcttgatccgacgacatccaacaggtcatccgccagttggaacgccagtccgagcggccggccgacggccaacgcgcaatgcctggcctgatccgggctctctcctgcggccagcagtgcaagcagcagtggagcgatggtggtgtaactggctgtcttccagcggaatacgttcaatgaggcgttcgccagagcttcgggattggacagtggggccatctcgacggccaagtccagtacctggccgatttccacctcgcgttgcatggtaagaaacgcctcgttcagggcatcggtgttgggaagacggctggcggaccggcgtgtgatttcaatgcaggcggtggccagaatgtcgccgagcatcaggcccaagccacggcctatggcaccgctgtgtacggcctgttccaaggcacgatgtgcggaaggcctgccccggcgcagatcggattcgtcgatgatgtcgtcatgcaccagtgcggccgtctgaaacacttcaatggcgcaggccaggtcgatcatggcgtcacgccgatcaggcgtcacgtcgccggcaagaatatcgaaggcgtccaacgcgagcagcgcacgcagtcgtttgcctccttggctggaggaggcggcttggtccacaacctgttccatcaccggtttcagggcgtcggcaacctcgtcggtggcgggggcggcagtcagttcccgcaccaactgaatgatgcgtggctcgatgatttcgcggttgttagcagttgtgcacatgcctaataacttatccacagggtttgaagaacacaagaacgttgggaatcaagggttttgaagctagaaccacaatggtcgttttttcctgcgtcatacggcgttttcagccatagtgggcacacaccccctcggcgcatgagctatccggctcggcgcgcaccacaacaccaatagattgcacaccattagtcaaggaggacatgatgaacaacaacacgccgcacaagccgcgtaagagccgacacgccaaacggcacgccgccgagcagacggagccctttggctttgacgagttggagacgagatcacaggaatttcgcaatgatcgacgacttcgaggcgcgcaacaggctaatgccgactgggtggccgaaccattggacgaatggctgtcttgtcttgatgccgggaacaccgacctaggccgagagacgatggccgcgtttgcggtgggcatgcgtgagaccttatcgattcgtgatgcgctgattctctcgttggttattgatgaaagccgttgccccaagtcatggcttatggaattcgcggcgcgaccgcatctggcgcgtacgagaacacgaatgggcgagctgctgacttgcgcattcgaggatgaaggcatgatgccggataaggagcgttgccatgccggcatcggtatgttgctcgatatcgccgaagcctcaccggtgccgtactgcatacagccattggccgtaatcgcctacaccttatggtggctgggcgatccgcgagcaatggtgttcgccttgcgatgcctgctgctcgatgaggattgttcgctggcggcgatgatattctcagccgccgatcgaggcgtggcaccggcatggtgctcgggctgagtgaacagaaacggcggatttccgaggttttacgcgcgatgcgcggaaggaaagcgtgtggtgatcggcaacacgtcgggcaacgatgtgggaataatcgtccgtggagggtggtttactcacatagttgacgatttgcccttgccagaagtgggcccatgtggtatatgcacttcacggcgagagatcaggaggagcagttttggccacgaaggaaacgacggcaaccaagcagacagccgagtccagcgaggagaccgagaccaagaagaaggccagctctacgaccaccgcacgcaagacttccgccaagaagtccaagtccgcagagccctcgaaaaagaccacgcgcaagtccgctgcgaagaaaaccgcgaagaaggccaaggacgatgagctcgtcaaagacgaggacactcaggtcgatgacgagcttgatgacgatgccgaggtcaacgacgacgatttggacgttgacgacctcgacgaggatcttgacgacgttgacgaagacgatgccgacgacgaagacctcgatgaggacgatgccgacgacgatgatgtggaagacgacgaggacgaggaagaagccaagtccaaggcacccgagcagcccaaggaaaagggtgcctacgtggtctccgacacggatgatgaggaagaaaacatcatcccctcgggcaatccgaagcgtcgtgtgattgcggccggcgcaaccgccgacccggtcaaggactacctgaagcagatcggccgtgtgagcctgctgaatgccgagcaggaagtcgacctgtccgagcgcatcgaggccggcctgtacgcccagcacctgctcgacaccgaaagcgaaggcatggagttcaagcgcaagcgtgaactcaagtgggccgccgccgacggcaagaaggctaaggaccatctgctggaagccaacctacgacttgtggtctcgctcgccaagcgttacacgggtcgtggcatgctcttccttgatttgatccaggaaggcaaccttggtctgattcgtgccgtcgagaagttcgattggaagaagggcttcaagttctccacctacgccacgtggtggattcgtcaggccatcacccgtgccatggctgatcaggcccgcaccattcgcgtgcctgtgcacatggttgaagtgattaacaagctgtcccgtgtacagcgccagatgctgcaggatctggggcgtgaacctacgccggacgagctggcccgcgagctggacatgccggttgagaaggtgcaggaagtgcagaagtacggccgcgaaccgatttccctgcacaccccgcttggcgaggatggcgattccgagttcggcgacctcattgaggataccgacgccatcgctccgtccgacgccgtggccttctccctgctgcaggaacagttcaagcaggtgctggaaaccctgtctccgcgtgaggccggcgtcatcaagatgcgctatggccttgaagacggccagccgaagacgctggacgacatcggccgtgtgtatggcgtgacccgtgaacgcatccgtcagatcgagtccaagaccatgtccaagctgcgccacccgtcccgttcgcagaccctgcgcgacttcctggatcaatgatcatctggctcccctctgtgaggggagccaagcatttgaagagaaaaataggactgtatgcccaaagaagaatacggcgccaaggacctagctgttcttgagggcttggatgcggtgcgcaagcgtccgggcatgtacatcggcaccaccgactcgcagggtcttatgcactgcctgtgggagatcatcgataactccgtggatgaggccttggccggcttctgcaacgatatcgtggtcaccctgcacaccgacggttccgtggaagtcgcggacaatggccgaggcattccggtggataaggaaccgaaaaccggcctgtccggcgtggaggtcgtactgaccaaactgcatgccggtgccaagttcggcaactcgtcttataacgccgtcggtggcctgcacggcgtgggctcctccgtggtcaatgccctgagctcccgactggacgtcgaagtggatcgtgacggcaagacgcaccacatgaccttccaccaaggtcaccctggcgtatacacggatgccgacccggccaatccgtctcccgattccccgttcaagcgcactcgcaagaaccgacccaccgagctggaaatcatcggcaaggtatctcccaaaaccactggtacccgtattcgctactggtatgatccggagatcttcaacaaaaccgccgagttctcatacgaacagctcatcgaccgcgtgcgtcagaccagcttcctggtgcccggcctcaaaatcaccatcatcgacgaaaacgtaccggaaacggcggcgactgacaccgtcaaggccactgatgacgcaacagtcgaacctgcgcaagaccaggcaccggccttggatgtctcgtccgacgatgccgagagcccggccgaggaggacttctcactgacggccggcgaccaggtcgttgatggcgcgttcggcgaacagcccgcgcacccgcgcgtcgtggaattcctgcacacaggcggcgtcaaggacttcgtcgacttcctgtccaaaggcgagccgatctccgacatctggcgcatccaaggcgagggcacctataaggaggagacccaggccgtgggcaagggcggtgaactgcacgcccaggaaatcgaacgcacctgcggcgtggatatcgccctgcgatgggtcaacggctatgacaccacaatcatgagcttcgtgaacatcgtggagacgcccggcggcggtactcacgtggacggtttcatgaacgccatcaccaagcagattcgcaaggcggtggaagacaacgcccgcaagctcaaggtgaacatgaaggactccgccatgaaggtggagcgcgacgatatccaagccggactcgtggccgtggtcaccgcacgcgtggccgaacctcagttccaaggccagaccaaggacgtgcttggcaccgcgcaggtcaagccgatcgtcacccggctcaccgacaagcaattcggcgagatgatcaccggctccaagcgcgggtacaaggaacaatccggccgcgtgctggagaagatcgtcggcgaaatgcacgcacgcatccagtcgcgcaaggccaaggaggtcacgcgccgcaagaacgcgctcgaatccgcctcgatgccggccaaactctccgactgccagccgggcaatgacgacgtggccgaactgttcatcgtcgagggtgattccgcactcggtaccgccaaggccgcccgcaacgccggtttccaggcactgctgccgattcgaggcaagattctgaacgtgcagaaggcgtcgatcacgcagatgctctccaacaaggagtgcgcggccatcatccaagtggtgggtgccggctccggccagagcttcgacatcgaacagtcgcgctatcacaagatcatcatgatgaccgatgccgatgtggacggcgcgcacatccgtatcctgttgctgacgctgttctaccggtacatgcggccgcttatcgaacacggctacgtgtatgccgcagtaccgccgctgcaccgcatcgcgttgaccggctcgcacaagggcgaatacatctacacgtattccgatgacgagctggccggcaaactggccgacctcgacaagaagcacatcggttacaacgacgacatccagcgatacaagggtctgggcgagatggatgccgaccagctggcggacaccaccatggacccgcgcacgcgtatgctgcgccgcatccgcatggaggacgccgcccaggcatccgagatcttcagcctgctgatgggcgacgacgtgccgccgcgcaagcagttcatcgtcgacaacgccgacgatttcgaccgctccaagatcgatacctgatcgaagacgtcgctgataatgacatcgtgcttaccgagaatttccgtaattggcgtttgaggtgagcacgttgtcatatgttttatgcgtgttgcccatgagtcattcgatagactgatgacatcgttatcacaaccggtgccgtactgtgaatgggagatgggacatggccagtctgttgcttgccgtcatctatgtggcgtttatcagtctgggattgccggattcgctactcggatccgcatggcccaccatgagccaggatctgaacgtgccggtggcgtgggccggcggcatctccgcggtgatttccatgttcacgatcgtctcggcgctgctttcggaccgaatgacattgaaattcggggcaggcaaggtcaccgccgtttcggtggcgttgactgcggcggccttggccggtttctccgttacctcgaattactgggtgctgttggccatcgccataccatacggccttggcgcgggcggagtggatgcggcgctcaataactacgtagccattcactacgaaagccggcatatgagctggctgcactgcatgtggggcgtcggcgcatcggtcggcccctacatcatgggctatgcgctctctcaaggccaaggttggccgtggggctatcggtacatcgcgatcctgcaggtgatgctgaccgtcatcctggtgctgagcctgccgctgtggaagaaacgtggcgcaattgcggtcggcgaatcgaccgatgacaccgcatcatctgacggcaatgccgagagatttggcactgctgaaggggtgtctgttgctgaacgcaaaccgctcggcgtggccggcgtgctcgccattcgcggtgccaaggaaatcctcgtgatgttcttctgctactgcgccgtcgaatccacggcgggtctgtgggcctccagctatatggtgatgcacagcggcatcgacaagatcaccgccgccagctgggccagcctattctacgtaggcatcaccgtgggtcgtgcgctttccggctttctgaccatgcgattcaaggacccggtcatgattcgcctcggccaagtgctggtgttcgccggcatcctcaccatgttcgtgccattgcctcaccaccttggcgtggtcgttgggctggtggtcatcggcttcgggtgcgcgccgatttatccgtgcgtcatccactcgacgccggcctacttcggcgaagacaaatcgcaggccatcgtcggcgtgcagatggcctgcgcctatgtgggctcactgctcatgccgccactgttcggcatcatcgcgcaatatgtgacaatcagtctctacccgtggtatttgctggtgctcttggtgctgatggtggccatgcacgagcgtcttcgcaagttgcgcggctgatcatatgcgcatttgggcccgtcgcctactatgcttggagcccatggtgataagtggagaagaacatgaacagatgcccgagcccgtacgggagcgattgagagcgctgaaggatgcgccgggctcggtaatcgtggtcggctcgatgaacgccgattacaccgtaaccactaaacgactacccaagccaggtgaaaccgtcaatggtggtgccatgaaagtgctgccgggcggcaagggcgcgaatcaggcatctgccgccgctcgtctcggtgtcaatgtccagttgctgggcgcggtgggcgaggactccaacgcggacttcctattaagcaagctggatgaggccggcgtcgacaccgccgatatcctgcatgtcgaaggccccagcggcgccacggtaatcaccgtgagcgctgagggcgagaacaccatcgtctattcgccgggttccaatgccaaggcaagtgccggctatgtgcaatcacatcgcacgaccatcgccgaatgcgcggtattgggactgtgtctggagagcccgattgccaccgttatcgccgccgcgcagaccgcgcatgacgctggcgtgaccgtgctgctcaacgactcgccatttatggacgagctgcctcacgaactggtggaagccacggatattctgctggtcaaccagcatgaagtggctcaactgctgggcctgccggatgatgacgtggaatcactcgactggtatgaggtcgccgaacgattcaccgattacggattcgaccgggcgatagtgacgcttggtgcgtcggggtcggtggtgatcgagaacggacgttggcatcgcgtatccgccgcgcaagtcaatgcggtggacaccaccggttgcggcgactcgttcatgggaactgtgctggctggcttggccgctggccatacgctgctgcaatccgcgcaaatcggctcctatgtctccgcctatgcggccaccaagcttggtgcccaaagcgcctacggcaccgccgaagaagtcatcgcctacttcagctgacctataatcgtacatatgtacgaaaccctgagcctgttttccgaacccaccaaggtgtggttcgagcatgccttcggtcagccgaccgaggcacaggctcaggcatggccggcaatccattccggtcgtaatgtcttggtcatcgcacctaccggctccggcaaaacattggctgcgtttctctcggccattgaccggctgatgaccgtgccacgcacgcggcgtgccggtgtgcgtgtgctgtatatctcgccgttaaaggcgctcgcggccgatgtggccaagaacctagaacagcctttggagggcattgccgcacaatgcgaggcgcaagggctgcccgtgccgaagatcgcggtcgccactcgttcaggcgacaccaccgcacaggagcggcggcgcatagcctcccatccaccggatatcctcgttaccacgccagaatcgttgtatctgttgctcacttcgaaggcagggcggattctcggcactgtcgatacggtgatcgtcgatgagattcatgcagtggcgggcaccaagcgcggcgcacatctggcggtaagtctggaacggctggagaaccttgtcgcggaatcgcgcaagcgagatgcaatcgatgcggatgctgatgagggcagtgataccgccatcgatgctggcctcagtgaccttcatatgcagcgcattggtctatccgctacggtgaatccgcctgaagaggcggcgcgattcctgggcggcggacaaccggttaccatcgtgaatcccggtgggcggcctgcaatggatctgcgcatgattgagccgttggaaaacatgcgtgatttgcagtccgtgaatgccaagcagcgtgtcggtggcgtggaggctgaacggtccgctccgcatatcagcggtgtcacgccggccatgcagcgacttgccgaacgcaggggcatcgtgccggtggatgatagagatgtttcttccacttctggggacgattctgatgcgagtgatgcgttcgattcctccgcgttggttggagcggcgggcgaccgtacctccggttccatctggcccgtggtggaacgcagtattttggatgagattctcgcgcaccgcactacattggtgttcgttaattcgcgtggtgtggctgagaaactcactgcgcgcttgaacgatctgtatgcgcagacccggcatggcaccaatcccgacactgtgcgggatctgggctctccggaaggccgcgaagggttctccacgcattacgatgctgtggtcggctccaccaccatgcttgtcggctcacatgagggcgatgatgtcatcgccatggctcatcatgggtcggtttccaaagaccgtcgcaaaatgattgaggaacggcttaaacgtggtgaattgcgttgcgtggtggccacctccagtttggagctcggcattgatatgggctcggtcgacttggtgattcaagtcgatacgccgttgtcggtctcctccggattgcagcgtgtaggccgtgccgatcatcaggtcggtggcgtctctcacgcattgttctacccgctcacccgtcagcagattgtcactggggccgcaagtctggaagccatgattgccggcgatatagaaccattggccgtgccgcgcaatccgctcgatattctcgcccagcagaccgtggccgctgccgcgatgcacgatttgaacgctgatgactggtatgccacggtgcgccgtgctgcgccgtttgccgaactgccacgtgacatgttcgatgcggtaatcggcatgatgtccggcgaatacaacagcgaggaattctcggcctttcggccgcgactggtatggaatcgggataatggcctgatttccgcccgtcccggttcgcagaaagtggccgttacctctggcggtacgattcccgatcgagggctgtacaccgtggtcctgcctgaggcggacgccggcaaaggccagcgtcgcgtcggcgagttggatgaggaaatggtctatgagtcgcgtgtgggcgatgtcattacactgggtacctccacatggcagattcaggacatcacccgcgaccgtgtggtcgtgactccggctccgggccgcaccgcccgcctgccgttctggcacggtgaaggcgctggccgtgactacggtttcagccgtaccatagcccgcttcacccgagaaatcgccgccggattagacgtgaagcggactgaggggaggtctgccgcagaaggtccagctgtcccaaccttcatcccaacaatcctcacccgtctccaccacgatggcctagatgccaacgccatcaccaacttggcccgcctactctccgagcaacaagccgccactggtacggttcccagcgaccaaaccctcgttgtggagcgcacgcgagatgaagacggcggttggcgcatcgtactgctgagtccattcggccgccgtgttcatgaaccgtggtccatggccatcagtcgcaggctgcgccagcgttatggttttgacgggcaggtatatgccgctgatgatggcatcgtcatccagctgccggatggcgacgggcatattcccgctcaggatctgttccttttcgacccagaagacctcaaagcagatgtagagcgtcaagtgggcgagtccgtgctatttgccgcacgattccgcgaatgcgccgcccgatcactgttcatgcctcgttccgatccaggccgtcgcgtgcccctatggcagcagcgactgcgcgccgcacagctcctgcaatccgcacgtatggccaagaactttccgctgctgctggaaaccgcgcgcgaatgtttgcaagacgtatacgacatgcccgccctgaacgaggtgatgaccggattgcaagccggcaccattaccgtgaaggacgtggaaaccgagtcgccatcgcctttcgccgagaacattctctttggcttcgtcggcgtggtgatgtaccagtatgaccaacctcaggccgagcgtagcgcgcaactgctgtctctcgatccgcacgtgctcgaacgcttgctcggcaccaccgatatggcacaagtgctcaacccggacgtgattcgcgaagtcgaacaggaactgggggagcacactttctggaatgagcttgccgacgatgatgtgactggtcgcgtgacccgttacgccaaaacccatggtcctttcaccgccgatcagctcatagccgatctacacctcgatgctacggatgccgtgcacactctggatgtgctggctgccaaaggcgagttgctgcaaggccgctttgtagatgatgacgagcaaggccaacagtggctccataaggacgtattccgccgtattcggtctcgctcattggccaaggcgcgtaaagcagtcaagccagtagaatcagaggcgttccagatgtttcttatcgaccgacaaggtatcgggccggtcggcggcgaacgatatgaaggtgctgacgggctcatgcgcgttatcgagcagctggagggcatatcactgcccactgcactctgggagtcggcagtattccccgcacgagtacgagactaccaacctgcattgctggatgagttgctgaccagcggcgatgtggtctgggtcggctcaaaaaccgggggaaccagtgcgatggaccccggtgaggttgctttctatccggcggattcaatattgttcagcggtgtggaacatggtacgacatcgaacgcctcagacgccaccatgccggaagcgattctgaccgcactggactcagggggagcgttccatgcccgtcaactgatggatgccgccaaacgtgcgtggaatgagaccgcggagccggacatcaatccaaacaccggcgaaatcattccgcaagagtggagcgaacagcagttcaaggatgccttgtggagcttggtctggcaaggtaaggtcaccaattccagcttcgcgccggtgcgtgcattaaccgcaggcgcagcaagcccgcgtaaatccactacatcacgtcgtcgtgggcgtgtcgctccgattcgccgagccactacggatatgacgttaggaggtttgtggtccgccgtaatcgggcaagctgaagccgaagacaccgaccagaccgaacgggcactcgcactggtcgagacgttgctggacaggtatggcgtcatcgcgcagccggtgattgacaaggaaaatatcccgggtggctactcagcgttgtatccggtattgaatcgcatggaggagcatggtcgactggtacgaggcatgttcgtccgtggtttcggcgcggcccaatttgccgagcgcgacaccgtggatgcgttgcgtcatccgtcagagcatcgcggccagtccgtggtggcattgagtgtgctcgaccccgcaaatctcagtggctccgccatcgcgtggccggacgcgcctgccggtgcgggtaaaccggcacgccgtatcggagccacggtcgtgctcaatgcgcaaggcgcgctactatacgcggccgccaaagccaagcacctgacagcgttcgatcaatcggtcggccatgaagccgctgtcaatgattccgacgaacaaatgcgcaaggccgccacagaactggcctacgccctcaaacgcaatggcaccggctccgtgacattcagcgacatcaatggcgaacccctcaacgcccgtcaccccttcgcccgcatcctccaccagtccggcttcacccccgttccccaaggcatgcggctgtactgattgagcccagctatcgaatgcggtagttggagcctcgttgggtcatgatgaggccggcgcgggtgagcttcttatccagtgtgtagagggcgttcttgagtaagccctgttgctcgaagaatgggccgccgataagtttgaccaactcgctggtgttgacgaactggccatcatccttgaccagcgcttcaagcaaactgtattccagacgggacagtgagattgcgctgtgagtggatgcgtagtaggccttgtgattcgtggtgtccaacgtgagattgccacgaatgatcatggcgggggagtcggtggcaagcgagccgacgtatgagagcagttcgccatcggagaatggtttgctcagcgcggcatctgggcgtcgtacgttagcttgtgcgctagaggcagcattgtccgagcgttgttcggcttcggcatctgagttgtttgcgcgtgaattcgcgctgaaggagctgtagggcgtctcttcgataggggcgtactcgtcaggcagcgctcgccagcggctgccttcaccaatggttttgctgagtggcgtcgaagtcagcagcagaatcttgacggaggcacgggcattgcgtagggattcgatgagctgctcggtggaaatgccgagcagggattcatcaagaatcactgcgtcaaatgactccttggcgacagcggcgagcgcgatactaccggtgcttgccaaagacacctcatgacgaccggcaagcagggcaccatgaatggcgtgggccaacggttcattggatacggcaaccagtagtctcatcgccacctccttaatgcttagtgtaggccgggtttagggtctcttctctattgtttggctcactatcgttcgctcctcgcctacaaacaccccactggggtgtttgctttacggctcggcccatcagagggagcttaattgaggttacgcaatgaaggcgatgggggaggcgaggtctactccggaaccgtctcggcgcatatcgggcttgggaagctcgaccggagagcctgcggatgtagaagcgtgcaacgggtagaggcccacccaggcaagaatcagcgtgttctggcccttcaggaatcgctgggaacgcacgccgccggtagcgcgacccttggtggggtacatttccagcggagtgaccttcgccgcgccgttttcggtgccgggcagtgcatcggaatcgccggccacggtgagcaccactgcaccggatccggaagtcaagccgttctcgccctcttcataggtccatgccaccttgccggcgggaaccacgttgaaggccgccacacgggcgccctcggccagcttgatgccggccataccgcccgcagtacgaccctgcgggcgcacgttcttcgcctcaaaggtcagtagcgaggaatcggaggagatgaacaccagacggtcgtcatcctcggccacggcggcgaataccacttcgtcgccatctttcagatcaatgacgggccaagaatccatggtggtgggtgcctcacgattccaacgcttgatgacaccgttacgggtaccgatagccagcgacggcaacggcttggcctcggcggccccgccatcctcgctctcgtccttggcactggtcttgccggacgtcggctgctccatggcaatcgccgtaatcacacgctcaccgcgaatcggatcggtggattcggtcatgccgatcagttcgtcggcctgaactcctcccttcagcgacaatgtggcggtagcgggcaaggcaggcaaatcaaccacatgcgcgagcaccaggcggccggccgacgtgaccagcccatacgtagcgcgcgtggaagtctcgaagattgtggtgatctgatcgtctctcaaacgctcatcggaagtggatcgtgcattgaacacgtccatcgcgcttggcgtggtacgggcaatcaaaccggtagcgctcatcatcaccacgcacggctcgtcctcgatcttcaaggctccggtcagcgtggactgttcgccggtcttcttggccgcagctgcggctgcggccacatcggcttcggcggaggagatcgtagtggcggccttcaccgcttcgagcgcggacttggacacgcccgaagccccggcaccctgcgccacgaccggcgtcaacgtgccatccgggtcggcatccagcagcacggtacggcgcggcgagccccacttggcgaccgcttcgtccatctcgtcggtgaccacctggtcgagcgcctcggcggaggccaggatccgggtcagctcctcgatacgcttcttcagatcatcgcgttcggcctcaagctcgatacggttcatcttggtcagtcggcgcagacgcaggtcgaggatgtactgagcctggacctcgtccaaatcgaaaacgaccatcaaacggctcttcgcggcatccgcatcatccgaggtgcggattacctgaatcacctcgtcgatgtccaacatggccagcagcaggccctcgaccaggtgcaggcgctccagcgccttcttcttgcgatattcactgcggcggcgaatcaccacacggcggtggtccacccacacctgaagcatctccttcagacccatcgtgtgcgggcggccctccaccaacgccacgttgttcatggcgaagttgtcttgcaacggtgtgtgcttgaacaactgcaccagaaccgcatgcgggtcgaaaccagtcttgatctcgatgacgatacgcgtgccgttatgacgatcggtcagatcgaacgcgccggaaatcccctccagcttgcggttcttcacaccgtcggaaatacgttcgattaccttctccgggcccaccatgtacggcagctcggtgaccacgatggcctgcttgcgggccgtgacatgctcgatatgcgtggcggcgcgcgtggtgagcgtaccacggccagtggcataggcctcacggatgccgtcgcggccgatgatcgtgccgccggtgggccagtcggggccgggcacgtagcgcatcagctgttccagggtggcgtccgaatgcgccatgaggaacttggcggcgtttaccacctcgcccagattgtgggtggccaggttcgtggccatgcccacggcgatgcccgagccgccgttgaccagcagattcgggatggcggccggcagcacggttggttccttgagcttgttgtcatagttcggcgtgaagtcgacggtgtcctcatcgatatccgcgttcatgccgagagcggctgggccaagcctggcctcggtgtaacgggaggccgcagggccgtcatccagcgagccgaagttgccgtggccgtctaccagcggcagacgcatcgcgaacggctgtgccaaacgcaccatggcctcgtagatcgcggaatcaccgtgcgggtggagcttgcccatcacctcgcccaccacgcgggcggacttcatatatgggcggtcgggagtcaggttcatcttgcccatctggtagacgatgcggcgctgcaccggcttcaagccatcgcgcgcatcgggcagtgcgcgtgcgtaaatcaccgaatacgcatactcgaggaaggacttgctcatctcctcgttcagcggtgtctcgacgatatgctccttgaccgtgcgcggatcgtaggtttgcgcggacggtttgcggtgtgatgccatgaaactccctttcgaacgcccccatattagcgggagggcgcgaaacagtgcgcagagaacggttctcgataacaactgtgcgctggtttcggtgcgccaatcgcacatgtttgccgataaaacggcgtgattccagtgtttcagtcgatgtgcgtttgtttgattatgtgcgttggagcgcacagttgttattgagaaccgttctctgcgcactgagccaaggggaggggtgctacttgaatgggcaactatgagtgttgagacgccggatatggacgagttgctgcggctggtgcccacagtgggctatggggatgacgccccggccgatcggcgtgggggagcactgcacctgtccgccgtgctgcccgccttgtccgccgccatcggacatccgacccccaccaaggtccacgccgatcccaaggcctgccagcgcgcattggggctgcctgatgccgaatcggccatcgtggtgctcgtggacggcctgggctactggaacctcgccatgcgcctcggccacgcgccctatctgcgttcgctgatgaacgaaagcgccaatcagcgtcccatcgctacctgcgctccaagcaccactgtggcggccatggccgcattcggtaccggaacctgcccgggactgaccgcaatggcgggctatacgcagctcgaacccgccagccataagctcatccaactcatccagttcaaagacgcgctggcacccaaaccagccaatccgcacattcctgtgccgcccatggtcgatccgctcgacttgcagcgcgaggagacggtgttcgagaaacttgcggctcaagaggtgcgcgtcacgagctcggggttgcccaagttctccaaatcgccattgaccgaagccgcattgcgaggcaccgactatcaaggcaacgtcaccccacgcgatcgtgtgctggccgccgcacgcgcctcccgcacccccggcctgacctacctgtacatccgtgacgccgacaaagtcggccacaattacgggtgggattccgaacactgggtggccgcattcgaacatatcgacgcccagctcgcgctcctgaaacgcagcgcacccaaaggcacgctgatcgtcatcgtagccgaccacggcatggtgcaaaccgacatggaccagcggattgacatcgccgttgaaccgcagctcacccgaggcgtgtcactggtcgggggggagccgcgctcgctgatgctgtatgccgagccggatgaacgacctgaggatatagcttgccggtggcgcgattgtctgcaagaccgagccttggtgcggaccaaggatgaggccatcgcggacggattgtttggaccggtctgcgagcgagtccggccaatgctcggcgatgtggtcgtgcaggcagcgggagccgtgaccctcgtcgattcgcgtacgcaaggagacaaggccacccacctgccgagcgtgcatggctcccaaacagcattggaaatggatattccctgcctgatcgatatggcctgattcggaaattcagtctccgaacagaatctcgtcccagcttggtacggccgaacgtcctgatttacgcttggccggtttggctggtgcctcatgttcggtggcggcggattcggccgcccgctcctgctcggtggctactagctgtgcattggggccactccgtatggtcttgtccgaaacattgtcagagccctgctctggtgccgtggcaggcgattgctgtaatcctgcggcagatggcgaaacagatccggcggtctgcgaagagaccggactgggggccgtagtgccatgagcctgggtcgtggccggtgagatggacgtggatagatccactgggggcatggaacctgtggaagtgacagagggccggattgcggcaggccgtgcggccggaatcgaaggcgtaggagccgcccaagcagacacggcgcgctcgatacgcgcggagcgtacggagtcgccgggcagttcgggaatcgtcggcttgagtttggaatccgtggctgattccggattctgttcgccgagcagttttcgagcggcattgttcaggctcatcacggaattgtcgtgcatattccacgtccattcggcatggatctcacggcccgcggaagtgaatatcgccacgatgcgccaaggctcaagtccacgtcgggtggatttccaggtcactgattccatgccgattcccgcagaggccagcgtgcgttccaccagttcgctgatggtgcgcacgctgctgtctttgggtgccgccacggcaaggaactgttcgatggcatactgtttctcggtctccacagccatggagaaacgacgtaccagcatttcgctcagatgatatttctccgcgacacgggccggatcggcaccggcgcgaatcagcgactgtatctgggaaatcggcaaagtggactgctgatgcggctggggagcctgtcgcatctcgcttctgacctgcttggcctcaagaatcgcccgttcgagcgtgtcgtccacgctcacagccatttccctgccgccaagggagaatacgaggtcccccgtcttgctcacgcgcacgaaacgggctttttcaagccgatcatctggcatattcgcaccactttccgtcgcaaagacattacttcttttaagtatgccccacgtgtcgaactttacgagtatttcaaatcgtgtatcctatgggcgagtacggcgctgaccgtgctatatatatcgacttacgaaccaaagacgacgaaaggaccatgatggctcaggattatgattccccccgcaacaaggatgaggacgaggaatcgctgcaggcgctggggaagtcctcgcagaacgcctcgagcgacatcgacgacgatgagaacgccatcgccgaagactacgaactgccgggcgccgatttgagcaacgaggattcctcggtgaccgtcatccccatgcagggtgacgagttcatctgctcgcagtgcttcctggtcaagcatcgcagccagctcgcctacacggacgaggatggccagccggtgtgtgaggagtgcgccgcctgatggcgttcgacgagacctacaacgagcccgaatccaccgaggtcctggtcaagagcctcgaccccgaacatccggcccagctgcactatgcccacgcgggcgatgccggtgccgacctcatcaccaccgtcgatgtgacgctgaagccttttgaacgggcactggttcccaccggcgtggccatcgccctacctgcgggctacgtggcgttggtgcatccgcgttccgggctggccgccaagcagggcgtcaccgtgctcaacgcgcctggcaccgttgatgccggctaccgtggcgagatcaaggtgcctctgatcaacctcgatccgaagcacaccgccgtcttccatccgggcgatcgcatcgctcaattggtgattcagcggtatgttgaggctcggttcatcccggccgagacactgcccggatccgatcgcgccgaacgcgggttcggttcgacgggagtggcgtcctgaccggattaggccggttgaatgactaaggtgatgacggcaacaacggttgtggaaccaatgatggcgaacaggtgaatgcacaaggctccggttcgcggctacaatgaacttcatgacgagggaggtgactggcatggcagagattgatggcgagcagtacgccgcccgtaagttgggttgtgagatcagtgccgatccgctcaatccgctggatccaatcaagaaggtgtgcaagtcccatcaccccgatgaggatttgtccattcttgaccgtgcctaccggcgtgccgtcatccagcactccgcccagcgccgcaagtctggcgagccgtacatcatccacccgctggccgtttcccagattctcgcggatctgggcatgggcccgatcgtggtggcagccggcctgttgcacgacacggtggaagacaccgactatacgttggatcaatgccgcgccgaattcggcgacaccgtggccggtctggtcgatggcgttaccaagctgagtcagcttgaagtgggtgattccgcccaagccgaaaccattcgcaaactcgtggtggccatgagccgcgacgtgcgtaccttggtggtcaagctcgccgaccgcgtacacaacgctcgcacctggcgctatgtgaagaccacgtccgcccagaagaaggcgcgtgaaacccttgacgtgtacgcacctttggccaaccgactcggtatgaacgccatcaagacggagctcgaggaactgagcttcaaggtgctctacccgaagatctacaacgagatcgtggtgctggtggctcgccgagccggccagcgcgatgtgtacctgaagcagattctggcggagatcaacgaggatctcgacgagcagaacatcaaggcatacgtcaccggacgcccgaaggattacttctccatctaccagaagatgatcgtgcgcggccatgatttcgcgaacatctacgatttggtcggtgtgcgcatcatcgtcgacaccattcaggactgctatgcggcgcttggtgccgtgcatgcgcggtggaacccggttcccggccgattcaaggactacatcgccatgccgaagctcaacatgtaccagtcgctgcacaccacggtggtgggtcccggtggcaagccggtcgaaatccagattcgcacttgggacatgcaccgccgcgccgaattcggcatcgccgcgcactggaaatacaaggaaaacggccaggccggccgcgccctgagctcgccggacaagtccgatcgaaagcgtgatgaaaacaatcaggagctttccgaggtcgataacctcaaatggattcagcagctcgccgactggaccagcgaaacccctgattccaacgaattcttgggctcgctcaaggaagaccttggctcgtccgaagtctacgtgttcacgccgaaaggcaaaatcgtatccctgcccgctcacgccacgccggtcgacttcgcgtacgccgtgcacaccgaagtgggccaccgtacgatgggcgcgcgcgtcaacggtcgtttggtgccgctcgacaccacgctcgataatggcgataccgtcgaaattctgacgtccaaatccgatacagccggcccgtcacgcgattggctgagcttcgtcaagagcccgaaggcccgcaacaagattcgtcagtggttctccaaggagcgtcgtactgaagccatcgaggagggccgtgacgagctgacccgcgcgatgcgcaagcgcaatctgccggtcaacacattgcttacgcccgaagcactggtgggtgtggccgacgaccttaacttcccgaacgcggacgccgtgttcgccgccattggtgacggacaggtctccacgcagaacgtcatctcgcatctggtcaaggatgcgggtgccgacgaggtcgatgaggaagtcgagcaggaagtcctgccgctgaagcccatggaacgcaaggcctccagcagctccaccggcgtgtccgtcaagggcgtgggcgatgtgtggatcaagctggcccgttgctgcatgccggtgcccggtgacaatatcatcggcttcatcacccgtaatcagggcgtatccgtgcaccgcaccgactgccagaacatgatcgatctgaaaaacaagcagcctgagcgtgtggtcgaagtcgaatggaccagcaccaagggcctgttcatggtcaagattcaggtcgaggcgctggatcgacgaaacctgctttcggacgtgacacgtgtgctttccgaccatggcgtgaacatcatttccggtacgatcgccaccggttccgatcgcgtggccaccagccagttcagcttcgaaatggccgatccgcagcatctcaactcgttgctggcagccgtgcgcaagattgatggcgtgttcgacgtgtaccgcatcactggtgccaaggaatccgccgaacctcgactgcgcaagatgaagtaggccgttaccttactctggctccctctcagagaggggagccaagaacacgaaaaggtcctgactggaatacctgaactgcgccccgattgttggacgtggtttattaagggtacctgattaggctgtgagggacatgttccggaattcctccggggtgtgtccctccagtcgtatctggcggcgtttggtgttccagtggatgatgtacgcgtccagttcgttcttgaactgttcgtatgaggcgaactcgcgtccggcgtagaactcgtccttgaggtggccgaacacctgctcggtcgcggcgttgtcgatgcagttgcccttcctgctcatggactggcggatgttcagtcccgcgagccggtcgcgccaccaccggtgccggtactgccagcccatgtcggaattaaaccgacatcggtttaactcggattaagccgggtttgttgttaagccggggaacggttcggggtcttggtggctggccgtgtcccatgtggtttcccggcttaacgttccgggttatgttcgtcttgtcccatttgattcgaacgaaggagtttgccatgggtgagacgacggttggccatgtcgcgggcgaggtggtccgcgcgctttacggggccggttatatggaatccaccataggccagtaccgcaagtccatcagggcgttggaacggtacgccggaggcccggatgcggtgtacacgcgtgggttgggcgcggggttcgccgcgtcgaccttcagtgagcggacgggcggtttcagcaggcagcggtggttcgattacggcaggctggcgcgtttgtgcgactcgtatctgcggtccggttcggtggacctgggcaagtggcgcaggagcaggcttgcggagccggtggttccgggtttggccgtggtcatggagcgttgggaggcgtatctcgccggttcgggactggcttcggcgacggtggggcattaccgtcggatggcgggcttgttcctcacgtggctggaatctcatggggtcgtgtcgttggatggttcggatggctcgcatgtgctggggttcctggccgggctgcgttcacgctggtcggagtcgtcgatgcggcacgccgcgtcggacctgcgcccgttgttcagatggctcgggcgggatgacctggcggacgcgatcggcctgaccggcatacgcaggacccacgcgatcgcgggaacgttgcccgacgacgagcaccgccgcttgctggaggcgtgcgcctcgcggtcggtgccgtcgagggacgcggcgatcaccctgctgtcgctgacgtgcgggctgagggcatgcgatgtgatcggtctgaggatcgccgacgtggattgggattccatgagcataggtctggtgcagcgaaagacgggcaatccgttgaccgtgccgatgacgggaccgctggccgcgaggctggcgtcctggctgttggacgaaaggcccgccaccgacgacgaccgtgtgttcgtgcggtacaaggcgccccatgtcgcgcttcggggtcattcatcggtgtacgaggcgatcagccgtgtcatgcggcacgccgggctcggacgccggggcggttccaggctgttgcggcgcaacgcggcgacgaggatgctggaggcggccacgccgttgccgacgatcagcgcggtgcttggccacgccgaccccgattccacacgcgtctacatggccacgcaccgcgggggaatgctcgcgtgcgtgctgcccgtgccggaaggcggatcgtcatgagacccacggaacacggattcgtcggcccgctcgccggcgaattggaggagtacatccgcttcaaggcgtccatgggcaggcatggcgccacccgcgtccgggtcctgcgctcgttcgaccggcattgcctcgaacacggggccgtgcgtctggagcggggcgtcgtggagcgatggatcgcccataggatcgacgcgaatcccgggggttgccgctcgtggttctcgtacatcagggacttcggcaggtggatgcgactggcccacgatcccgacgcgtacgtgctctccgaccagtggaaggccggatccccgcgtccgacgccgtacctgctgacggaccgcgaggccgccctgttcctgcgggccgcgggaacgttggagtctccgtcgccgtgggcgtggcagtctcgcgcgttcttcatgctcatggcctgctgcgggctgcgcacccgagaggtcaggagactcgccgtcgggcacgtcgaccacaaggcccgttccatcgacgtggtcgattccaaggccggtcgcagccgcaggctgcccgtgggcgacgaggtcgccgccgaactgctggaatgcgaccaacggtcccgcgaacgcttcggagacgaccgtcccgcgttcttcgtcacctccaccggcaatccggtctccccgggcatgcccggcgtggtgttccgccgcgtctggacgcgggccgggctcgagtggccacaagccggcaaacggcccaggccctatgatttccggcaccggttcgcgttcgcgaacatcgagcggtggactcgcgacggcgtggacgtgatggcgatgctgccctatctggcggcctacatgggacacgccggcatcgacagcaccctctactacgtgcacgccagccccgatttcatggacggatacgcggacctcgtcgccgacgccgaacgcgtggtcccggaaacggaggaaccatgagcaaggcaaggaaaacggccgccagctccggtgaaccggacttctggcgagtcgcgcgcgactggctgcaccactggctgcccaaggtgcggggcagctcgccgaagaccgtcgaggcgtaccgcatcggcctggaatcctacgtccgatggctcgaaaccacggaaggcacgcagcgcagccacatcggtttcgggcatttcgaccgggcgcgcctgggccggtgggtcgaatggatgcggaccgagcgcgggtactcggaccgcaccatcatgctgaggatgacgacgatgcgcgtgttcctcgaccacgcgggcctcgaacacccggcattgaccgcgctgggcaacgacgcggccggcatacgtgtcaaaccacctgcgcgcaaacccgtcgaccacctcggggaggagcacaccaaagcgttgctgaccgcatggggcaccggcgacgccaaatcgcgcaggaaccgcatgctcctgatcctcatgtacgacaccgccgccaggatcggcgaactcgccgcactgaccatcgcggacgtgggtatggataagccggccagggtcacgctcaccggcaaacgcggcaagagccgggtcgtgcccctgggagaaaggacacgaacccacctggccgcctacctcgaggaattccatcccggaccgtccatgcgcgacggcgacaggccgttgttccactcgacgaggaacggcgccatccagccgctctccgtggaccggatcgacgagatcctcaaaaccgcggcggccagagcacgccgcgggacgtgcccgtccatgcccgaacgcgtccactgccacctgatccgccggacccgcgccatggacctctaccaacagggcgtgccgctaccgctcatcatgcaactgctcggccacgaaagcatgagcacaaccagcgcgttctacgcgttcgcgaccctcgacatgatgcgcaaagccgtcgatgcggccaaccccggccccgacccctccaaggagacatggctcagcgagcaacgactccgacaactacacaccctcaaataacccggaacgttaagccgggaaaccacatgggacacggccagccaccaagaccccgaaccgttccccggcttaacaacaaacccggcttaatcggagtgcaggatcgggttggcgtcttcgggcagcttctcctcgagcatggcgagcaggcgccactgctgggccatgtcgggatgccggctgacgtcccaggccacgatctccttggatcccatgtcgcatacgggagccagatacgccttgccgtcggcgaccctgaactcggtgacgtccgtgcccagcttcacccacggccggtcggccgtgaagtcgcggttcagcaggttctccaccctcgcgcccgtctcgtcccggtacgagctgtatttccggtacgggttcggcctgcgtatccggcattccaggcccatgcgcctcatgaccttcagcacgctcttgtggctcacccgcaccccgaactcgtgcacgaggcacatgcgtatctgccggtggccgcacccgttgggcgtgcgcgcgaatatctcggcgaccatcggctcgatgtccggccgggtcacggcggccggatgcgacagaagatggtaatacgtgcttttcgccagtccggccgccctgagcaggtgccggagccgatgtcccagccccgccagcatggagacgatcaccgttctgtcccggttgccgatctccacgccagcagggcgtcgactttttccaggtacgcgaccctcgccttgaggtacgcgttctcctcctcaaggagctgttcccttgtgggagccggcctcggcttggatttcgcgcccctgggcctgcccttcggtttcggacgcagcgcgtccgggccgccggaccggtactcgcggcaccagcgctccaacggggcgggacccgcgatcctgtacttctccatgacttcggccttcgtcagcccatgctccacatggtcgcgcaccgccgcgagcttcgtctcgtagtcgtatctcctgttgccttcgcgttctcccatgagcgccgcctccccgccaaaccggtatgacaacacccattttcccgcggtactgacgggcacgccaagccggcgggcgagagaacgcctcccggccccgccccggatcaggtcggcgacgacccgcatgaaaccgtcatcgtaatgacgcctgcgatccctacacatgagaaaccgcacctccgatcatcgaatctgaattacttcagtccaacaatcggggtgcggttcagaatcaggaccttttcgtatatgttgtcggtcttactccgccacgtccacggacagaatcacggccggctcgagcgggcgatccatcggatcggtgtccagtgcttcgagcttatcgacgaccttcttggagtcgtcatcggcgacctcaccgaagatggtgtggtgaccgtccagccacggggtcggcacggtggtgatgaagaactgggagccgttggtgccatggaccttaccgtccatgccgcgacgcagaccggcgttggccatagccaacaggtacggcttgtcgaacttcaggctcgggtcgatctcatcgtcgaactcgtagccagggccgccggtaccggtgcccagcgggcaaccgccctgaatcatgaactgcttgatgatacggtggaagatcaggccgttgtagaacttgccgtgggaaggctggccggtgtacgggtccgcccattccttctcgccggtggcgaggcccaggaagttggccacggtgttcggagccttgtcgtcgaacaggttgatggtgatgctgccctcagaggtattcataatgatggtagtcatacgttccatgttctcattgccccacgtcattgactggcattgccgccatcgctgctatcgagtcggcgattgtcagccaatgaatttgatgccggttccgctgctgctaccggttgaggagccgctcgaaccgctattaccggagtttgaactggatgatccgcccgtggagctggaagaggaaccggagccattggctgatcctgaacccgatccggttgaaccgttgccggtgccggtggtgcctccggtggtgccggaaccggtggaaccgccagtcgtgcccgaattagtggaggaatcggtgccggtcgaaccatcggtggatccattggtgttggaatcggttgaggagtcggtgccggttgagccggacgtgcttgaatcggtgccgtcgttggacgagccggatgtggagtccttggtgttggaatcattcgaaccgtcggtaatgcccggctgcggcagtccgttattctgattggacgtgtcggtctgcgttttggtgtcggtttgcgtgggcgtggtggacggagtgatgatatggtccgtgccacggccctgcgtgaccagcatgacgatgccggcggttactgccacggcgagcaggccggataccagcgtgacgataatggcggtgcgcttcgaattatgggagcgggccttgcgcagttcattgaccgaataggttcgtccgttcgctcgattggacacgacttcgcgcggcttgcgcgcggtggaaacggtattgaccatgccggtcatcgtcgtatcggactcggattcggctgccttatcggacttattatccgtagtgtcatcgtcattgccggaagacgaggccgactgtagtttctcaccggaggcggtgagtatgttttgatagattttggtggccaccgcggagacgatgtagctggctgccgcgccgattaccgagccggcgataccgattttcgatgccagtaagaatgaggtgacggcggcaagggtgcccgccacgatggatgagagggaaagaccttcgaaaaacttcttcacaagacacgaccgtaaagtgtcgggctggaaggttgcttaaggctcggtgataccgagaggatgcctacacgagaccttcaaaacctagccagcggaatgtggaatgactcaaaaatatggtgccgatgagcagtgggaatcagcgcaaagtggcgcaaagtagcgcaaagaacaaccgaaattggttcgcttggagcgaaaacgacgttcagcagaacgtcatgcagcccaagcgaagctgccgttgccggcacccaactcgaaatgcagtttggcgatgccaagtccgatttccgattgcacgccttcaagagcctcggccttcaccgtaacggttcagggcaatggagaacccatgaccatccatggccgaaactgaatcgtcagttccggtgcagcgactgtttggtcggcttgattaccgacatcagcacggcgacgaagatcagcgcaaagcccaccagtgaactccacatgattgtctcgccccagaacagcgcggagaacgtgacagcgaacagactttccgtacacatgatgattgacgcctgcgaggcaggcacgtgagccagaccgatgttctgcatgatctgggcactcatcgtggcgccgaggaacagatagagcacgctggccactactgagggtgccagccagctggcgttcggcatgggttcggtgaacaacgcgccgatgatgaacaatacgccggcaacgccgaactgcacaaaagtgacggcgatagggtcgaagcgtttggtgtagacaccaaggcaggtcagattgaacgagaagatgaccgcggtggcgatggtcagccagtcgccggcactcagcgacagcgaaccgcccggcttcagcgagacgaagccgacgccgatcagacagatcacgccggcgaccagattgatggccttcgggcggttttttgaaataatccacgtggcgaacggggtgagtacgcagtaggcggccgtcaggaacgcgctgcggcccggttcaatggtctgcaggccgatggtctgggtgaccatcgtgccccagtaggtcaggcccaccacgagcgccggcacaatgattttcggcgtcagatacggcacgatgtgcttatggaacaaggccagcatgcacaggcaggcgccgatcatgcgcagacccatcagccattggggcggaatcgcctccatggcgaatttggcgagcagatagctgccaccccataatgcagcgcagcccagcaacatgagtcgggcgagattcgggggaaagttgcgggaccagcggctgcgcagcttgctgaaacgttcgaccaaacccatggtgcacctcaggacagttaggaaaacttgtggctctctcggctcacagattacgggaactaccggccaaaatcgaccggtcgatgggtgtcgggtgtgtgacaggtgtgtggctggtgcgcgaccggggcatggcatcgccaagcaggcaaaaaccggatgaaagctgtgcgaaggtgaggttactcacagcgaacatccgggctagtcgcgttcgaaaccggtactctggaaagagtaaggatacgttatccgtagcaatcatgaaaggattcgacatggcagtcattactccggaaatcaaggaattcatcaagaacaaccttggctggatcaccaccgtctccaaggacggcgaactggacctcggcccgaagatgtccctgttcgtgctggacgacacgcacatcgcctaccacgagcgcaccgccggccagcactacgagaacctcaagaacggttccccgctggtcatcgctttcgccaacctcgagaagaagcagggctaccgcttccgcggcaacgtggtgctgcacgttgacgacgacatctacaacgagcaggtcaaggtcgccgaggaaaagggcaccaagaagccggccgtgattccggttctcgaagtcaccgagatccaggaccttgcctccggtccgaccgccggcaagaccatcgccaaggactgattagctgacgtattggtggcttcctcgtcagagggagccactttttcgctttttagtgcgcagtactaggtgacggccttgggcgtcggtggtggcgaagaggtaggtgctaccaccgtccttgagtttgagctttttgcgcagctgggccacggttagggggaaattgcgtacggcgatgttggcgtgcgtgaggccggccaatagctgtttcagttctttcttgttcatggtggcgatggattcgatggcgaatgacctgcctggaaaatcggcaataggttcggccgccacgaacaggtggctattcgggctgatgtgatgcacggcgaagcgctgttcgagaacatcaaagcatccggccttcatgattgaggcgttgggctcgtaaaggtacttccaatgcgaggaatcgaagtcgttcgcgctttcctcagacagggaatcttcggtattgcaagtattgcgtgcagccaaggcagaatcgctgatagtggtgtgattgtcgctgttatcgccggccttgtacgacagcacctgctcgtcattagcacataccacgagcggtgaggcgtaacggccgcgccccaacaccagcaacaattccttgcactcattcccggtggagacgatatgcacctcatgtaccgcgccggcgaaatcggcgacggtcttatgccagtcgagcatgggggagagcttgaccatgaccgtcggtgccttggccagcagcatatccttcagggtcagcacatccggcatgcaatcggcaatcgcgtaggtacgcgagccatgatcgtcacggcgggccggatcgaggaagatcatggagactcggccaagcgtgtcaagcactgctgttgaatcatcattgatgacttcggcgtggtcaaggccgagtatcgggaaattatggcgagcgatatcacataaaatggattgttgttccacatatatggcacgattgaacactcgggacatgtaagaaaagtcgacgccgaaaccgccggtcagatcgactagggatgccggggagtcgtcgtcgactgcctcttcggccaacaatcgctgtgccagccgagccttgtactgtgcggtgaattggctggaacattgttccattgggacttgcggcgggaagatcagcccatcatgggacgcccagtcaggtagcttgagtgaagcgcgctgccagccggcaatttgctccagcgcgaacggcacatccacgtcgccatcatgcttggcgtgcaaggccacatcacgcacatcttcacggcggtgtttggcgatgaacgcccaagtcgactcagaaatctccatgccgccattctaggggttgtgctgagatgagtatggcaaaccgcaagagaacgaggtggcgaaaaccgatgatcgatgaagtgatgatgctgcgtcatggccgtacgcaatacaatctcgaacatcgcttgcaaggccagatcgatgtgccgctcgacatcgtaggccaatggcaggttgaccagaccggattcgcgctcgcttcacggtattactgggccaaggtgaaccgacttgccgagcatcccgaagccatcgcccagcccggtcctgacgccgccgaacgcactgatacgcgccagttcgaggaggctcctgccgccggccggcgcatggtggtgatgacctccgacctgttccgtgcccaacagaccgcacacgccttcgccgatattttgggattgccagtcacctgtgaccaacgactgcgtgaacgcagcttcggcgagtgggaaggcatgacccgcgccgaaatcaaagccgtggcagccgacgactacgcctcttggaaacagcacactgggggcgaaaccaagcatggtgtggaaagccgtgccgccgtggggcagcgaggtgccgatgccgtgcgcgcactggtcatcgactccgcctattcagacagcacgcccaccacgctgatgctcgtcacccatggctcatggattaccgccaccatctccaacctgctcgaacttgacccggacggcatgaacgcactcggcggcatgcgcaacgcctgttggtgccggctcaaagtgcgccacagcgtcaacggcacccccatcgaacagcccctgtgggagttggaggaatacaacaaggctcccgccatcgccgacagcgccgactgggagaacgggccgaccgatctgcgaggaccgcacatgccaagttggcagccaatcgtctggtgatggtcgctatgcgaaaccccgctcgcaaattcgaacggtgggtctagactaatctcggtttggaaccgtacagcgatagaacagtaagaaagcgcggaaggcgggtgagacgacatgctgagaatcttcagctcaatcaatggccaagtggagcagatcgagaaaccggaaaacggctcctggttatgtttgagcgaacccactgatgtggagctcgccaccgtcgcctcgcaaaccggcatcgacctggccgacctgcgtgcccctttggatgacgaggaacgttcacgtgtagacgtcgaagacgattacacgatgatcatcgtcgacattcccaccgtggaagagcgtggcggacgcgactggtacgagaccatcccgctgtcgatcatcgtcaccgaaaacctcatcatcaccgtctgcatgcaggacacgcccgtgctccacccattcatggaaggcacgatccgaggcttcaacaccttcatgcgttcgcgcttcatcctgcagatcctgtaccgcaacgccacgatgtacctgcgttacctgcgcatcatcgaccgcgaaagcgacaagcttgaactgaagctgcgccactccatgcagaaccgcgagatcgtgatgctcatggagctgagcaagactttggtgtatttcaccacatcgctgaaatcgaacgaaatcgtgatggagaagctcaccaccctgcaacgcatcaagcaatacccggacgacgaggacctgctcgacgacgtcatcaccgaaaacaagcaggctatcgagatggccaacatttacagcggcgttcttgcgaacatgaccgacgctttcgcctcgatcgtgtccaataacctgaacaacgtgatgcgcatcttcaccatcatctccatcacactgtccatcccgaccctgatcttctcgatgtacggcatgaacttcgatggcggcatgatgggtatgccgttcactgacaagccgtggggtttcatgctcattatcgtgatttccatggtgctttccggtgcggttgcctggttcctcacacgttcgcgcatgttcaagtaaggcgtttgacggttatgcaccactggtcatcgttcgccagccgtagcatgctccgcgctcgccgtccgatgcggcgcggatttcgctcccgactgatggcaggattcgccgcggcctttggcgtgatattgccattatccggtctggccggttgcggccaaattcaagtcaccaccgtctccggagcgccggaggggcccaccatcgccattggggtcgcagccgacgagccatcggtgggagcatggcatgacggcacataccagggcttcgacatcaccatcgccaaatacgtggccgccaaactcggctatgcgaacaagcagatcgtcttcaaacaggttcgccccgaaaaccggcgctccatgctggacaatggacaggtcgacatggtcgtcgcctcttggcctatcaccgatgggtccagtgcgatcgttgattttgccggaccatacctcacgaccagcgtcggtttgctggtcaggtcggatgagcgtggccgattcaccaatgacgcaggttcggtgggtgacgtaggcgacggcacggtgtgcgcagtgaaaggtgacgagacagtcggcatcttccgcggcaaccacccgcaggcccggattcaggagcgcagcagttatgcgcagtgcgtcacggccgtgcaagtagggtcggcggatgccatagcctccgatatggcggtgctttccggtcttcaagcggccaacgggccccagtatatggacgtgattgcggacaagggcgaggtcggttatggcatcgccgtgagtcaaggcaccagccaattggcgcagaaaatcgcggaagcattggaagacatggttgaggatggcagctggacggccgccaaggatacgttcacaagccaaacaaagctcacggtttcgctgaacggcgaccccaaagccatcgtctcggatgctgaataacgattgacgacgtgtccagttgcgaggctaccttgctgatttatgagtgacaacgagaagagcacgcaaaccgaagagcccaacttccgctacaacgccgcactggcgcaggacatcgaaaacaagtggcagaagatttgggacgagcaaggcaccttctgggccgccaacgtcaacggcgatttgaaggacggcaagggccgtaacgccgaaggccgcaccgcctacttcgccatggacatgtttccctacccgtccggcaagggcctgcacgtcggccacccgctgggctacctggcctccgacgtggtgagccgctaccaccgcatgaagggcgagaacgtcctgcacgccatgggttacgacgccttcggcctgcctgccgaacagtacgcagtccagaccggccagcacccgcgcgtgaccactgaggcgaacatcgccaacatgagccgccagctgcaccgtatgggcctgagctttgacaaccgtcgtacgttcgccaccatcgaccccggctacgtgcgctggacccaatggatcttctcgcgcatctacgattcctggtacgacgaggacgccaccaacccgtccggctccaggggctccgcacgcccgatcgccgagctcgtggccaagttcgaatccggcgaaaaggccattccgggccacgagtccgacggcaagcagtggtccgacctcactgacgccgagcagcaggatatcttgaacgacttccgcctggcctacatctccaagtccccggtcaactggtgcccgggtctgggcaccgtgctggccaacgaggaggtcaccgccgaaggtaagtccgagcgtggcaacttcccggtcttccagcgtgagctacgccagtggtccatgcgcatcaccaagtacggccaccgcctcatcgccgatcttgacggcatcaactggcctgagaaggtcaagctcatgcagcgcaactggatcggtgaatcccatggtgcctccgtgcacttcaccgtggccactgccgacggtgacaaggacatggaaatctacaccacccgtcccgacacgctgttcggcaccacgttcgccgtggtttccccggaacatcacctgctggagaacgtgcccgccgaatggccggccgatgtacccgaagactggaagggcggctatgccaacccggtcgaggcggtgaaggcctaccgtctggccgccgaagccaagaccgccaaggaccgcgtgaacgaggccggtgagaagaccggtctgttcaccggcctgtacgccaccaacccgatcaccggcgcgaagctcccgctgtttactgccgactacgtgctgatggactacggcaccggtgccattatggccgtgcctggtggcgaccagcgcgattacgactttgccgtgaagttcggtctgcctgtcatctacaccgtcacgcctctgccggattccggcgacgacttggccaactacgagggcaaggcgccgttcgtctcccatgacggcatcgtgatcaactcctccgtcgaggccaccgaagccaagggcgacgcgctgagccttaacggcctgcgcgtggacgacgccatcgccaaggtcaacgcctggctcgaatccgccggcgtgggcaagggcaccgtaagctaccgtctgcgcgactggctgttctcccgccagcgctactggggcgagcccttcccgatcgtctacggcgaagacggcaccccgcacctgctgccggattccgcattgccgatcaacctgcccgacgtgcccgactatgagccgcgcaccttcgatccgatggacgcagagtccaacccggaggcaccgttgagccgcaacgaggactgggtcaaggtcgagctcgacttgggcgacggcaagaagacctactaccgcgacaccaacaccatgccgaactgggccggctcctgctggtactacatgcgttacatcgacccgaccgacaccaagcacatggtggagaaggacgagttcgactactggatgggcccgaaccacaacaagtactcgggtgatgaaggcggtgtggacctgtacatcggcggcgtcgaacacgctgtgctccacctgctctactcccgcttctggcacaaggtgctcttcgacctcggctacgtggactcggccgaaccgttccacaagctgttcaaccagggcatgatccaggcctacgcctacaccgacgaccgcggccagtacgtgccggccgacgaggtcgtggaaggcccggccgacgcctccggcgagccgaccttcacctggaacggcgaacatgccaaccgcgagttcggcaagatgggcaagtccctcaagaacatcgtgaccccggactacatgtacgagaactacggtgccgacaccttccgcctgtacgaaatgagcatgggcccgctggacgagtctcgcccgtggaacacccgcaacgtggtcggtggcatgcgcttcctgcagcgtctgtggcgcaatgtggtcgatgagaccaccggccaggcccatgtgactgaggacacgccggacgaaaagaccctgaagctgctcaacaacacgattgccgaagtgaccgcggaaatggaaggcatgcgcccgaacaccgccatcgccaagctcatcgtgctcaacaaccacctgaccggtctgaaggctgtgccgcgtgccgccgtggagccgctgatcctgatgctcgcgccgattgccccgcacatctgcgaggagatgtggagcaagctcggtcacgccgaatccctgtccgccgagccgtggccggtggccgacgaacgctacgtgggccacgacaccgtgaccgccgtggtgcagatcaagggcaaggtgcgcgccaagctcgaagtgccggtcgacatcgatccggccgatctcgagaagcaggcgctggccgccgtcgccgaccgtcttggcggcaaggagccgcgcaaggtgatcgtcaaggccccgaagatcgtctccatcgttcccgcggagtgacttgttgcgagccagctcccctctttgaggggagctggctcgcgtagcgagactgaggggagcgtcaaccgcccacctcaattgtggataacttcataagctagaaccacataccccgtttcagctggacaaacgcccatgaatccatcagcgtggatgcatgggcgtttctcataaccatcgcgcagaccatgccgccaaccgtttgcgcgcattcagcaggcagagcgcagccatgccccaaccgcgagtggaacggcccacgacgcctccgccgcctcctggccatgcacggatccgtccggctggccacccgccccaaagggcgcagagcggcctgcggcaggcgacccgtgacaaacgtgcgttatcggatctgattggcgtacgttccgccgatgccgtcggcgaatcagccagactcacccgggatcagccgcgattgtcgttcaccattgggcatgccttggccgtgatattgctgctgatcgtcgcccttggcatcagcttggcattgctggtccaacagtcgatgaatatggccatgctgtctcaaccgaccgccatgcagaccacgggcggctccgctggagatcagacgatgccatcgcagaacaccacggacgagaaacgcacggatccgcagcagtcggagcattccgatgccacagcgaaccccgaatcggataccacgcaatctccgcacatgcagacggacggcagcgatgccggcgcttccacgcatggtcttatcaacctcaacacggctaccgctgaggaattgcaatccatcaaaggtattgggccggttaccgctcagcggatcattgatcatcgcacggcgattggcgggtatacatcagtcgatcagctgctggatgtcaaaggcatcggctccaagacgttggagaccatgcgagggcaggtgacggtcggatgagcagggattggatactgcgcgagcaggggagccgcgattggaggatgctgccgatcgccatagtgatgtgggcggcgagtctgggagcgcacgcattattcgcatggaggatgtctgatggactcggcaccggtcaggcaaaggctgatgccggagctggcattgacgtcaccataatcggcatggaatggcctgtcacgcgaatattgcctataacagtggcgtcatgtgctgccgtggcggcgatgattgtggtgtctttccgcctgcggatccggtggacgggaacattgaccgtatgcgttgcggtggcgtgcatcggcagtatgacggcaatcgcgtcggacaccattgcctggcatgatcctgcctccgcacaagctcgccaatccagttcataccacgaagtcatggccacggtgacgacgcccgtgatcgcttcggaccaacgcacatacgattgtcagacggacatacggctgagcggcatcactgtggatggtacggatgtacgttccacggtcgctgtgcgtgtatacgccgacgaatcgtattgtgggcagttgcgtcgaggcgcggtctatctgctgacaggcgtattgcagcaagcgcgatatggacgcataccactatggctgctcttggaaggaaaacagccggtagcacaggtgcgggctccgccgtggcatctcgccgcgattgcgcatgtgcaggaggcgtttttcaccgtgaccgaacaattgtccgatcaggggcgtgtgttggtgccgggattgacgatgggtgtgcttggccaggattatatcggcggcgagaccggtccgatgccggtcaacagcacgtatgcgcaaacgttggagaatcagttccgccagtccggcatcatgcacctcatggccgtatccggcggccactttgtactggtggcgggattggtgcgccggttatgcatgtggatgctgcttgatcggcggctgacggcgttgctggtctctggagtatatgtgctgctggcattggcgatgttccccagtgattcggtcacccgcgcgttcatcatgggattgataggtgcgttgacgtatgcgatggggcggcgtacgcaagcgttgagcgccctgtgctggacggtaatcggtgtattggcggtgaatccggatatgtcggccagctacggattcgccttgtcttcggccgccgtactgggtatcgtgctgtttgcggggcggctggccggtgcctttgagcgagcgatgccgcacggcatcgccgaaatgatggcgatgaccgtggccgcgcagttgttcaccctgccgattcaggtgttgatggaaccggagttgccgttgctgtccgtgccggcgaacctgttggtgtcgccgtttgtgggattggccacgatggcgggattgatggcattggcctgcgcatggtgcgagccatggctggccggcgtattcgcgtggatatcgtcatggggcacgctggtgatggaacgggtggcgttgtggctgggtggcagcacgatggccgtcatcccatggaaagatggcgttacgggtgccgtgctgattgtggcggtggaaatcggtatcggcatgctactggtgttcgtcagccgttgcctccagcatgtccgtcgttatgaggccggaatgcctggcgtgcgcttcggttccgcttggcatgtccgcctcagtctctggtgcgaggagacgagacgtctctttacgcggcggcaagccgaatagccaatgcggtattcggtgcagcaaccatcgcaatagccagccgaacctatgcgataggccgcgcggcataaaccatcagccggtaaaactgcgatacagttgagaccagttcaaccagctgcatgaaggagtgccggcgatgatgttgtctcataatccgatagtcgaaccatttgcattggcccacgccaccatcgtcaccggagataaagccggaaccatactgcgtaacatgacgatcgtggtcggagccgacggacgtatcgaacaggttgcacccagcatcgaaaccagtatcccagccgaataccactatcttgacggcaccggcaaaatcgtgatgccggggctgatcaatgcgcatacccatctgttctcccaaggcaagccgctcaatccgaagctggcgacgcccaaaggccaacgtatggtcgccacattcgcgcattcgccattgggcaagccgtacatggccgcaaccgtaaaacacaacgccacaacattgctggaatccggcgttacgacgatccgcacgcttggcgacgtgggatatgaagtcgtgacattacgcgatcagattgatgcaggccaaatcctcggaccgcgtatcttggcgtccggaccgctgatggcgattcccgaaggccatggcgccccgcttatcgcactgaccagcggcaccccggaagaggcgcgtaccgcagtcgcgcagaatctcaaggctggcgtcaacgccatcaaaatcgccgcgaccggcggcgtaaccgatgcacaggaaatcggcgaggccggcagcccgcagatgagcgtggaacagatgcgggcgatttgcgatgaggcgcatcagtatggtgttattgtcggcgcgcacgcgcaaagcccggaaggcgtgcggcgttcgctgctggccggcgtcgataccatcgaacacggtagcgtgctcgacgacgaattgatcggcatgttccggcacaatccgaatgcgttgcgcggatactcggcattgattccgacactgtccgccggcctgccattgaccttgcttggacaggacgtgaccggcatcaccgacatccaattggagaattccaaaaacgtggtcggaggcatggtttcaggtgctcgtcaggcgcacgaggccggattgatgataggcgtcggcaccgatacaggcatgacattcgtgccgcagtacgccacatggcgtgagctggagctgctggtcgcatatgccggtttcagtccggctgaggccctgcacgcagccactgccgtcaacgcctccattctcggcgtcgatgccgagaccggttctttggaagtcggcaaatccgctgatttgcttgtgctgaatgccaatccgctggacgacctgcgcgcgttggaacacccggcattggtcatcgcggccggtcacccggtatggcgtcccggtcccaagcgtttcgcggatatcgacgccctgttggatgaggcatacgcctaatcgcggggtgctgccgggccgttatgccggcaggtcattgtccaacctgtgtggcgagatgggggcatggcgaaaacagcagcgaacgtaccggtaaccgtggtgcccggaggcgactcgtatttgaacgacgcgcgcaccaaggcactgtgcgcacaagcgttgaaggcgcgacccgacgccgaactcatcgagctcgacgccacatcggccgaccaatatgccttcgatgaagccgtcagcccatcgttgctttccgacgttgccgtggtcaaactcgtcaacctgcagaatgccgacgaaaagctcgccgaagctttggtgacgtacaccaagcaggccgccaaggatccgaacggctccagcgtggtgatctgccagcacgagggcggcgtcaaagggcgcaagatcatcgaccaactggtgaaagccggcgctcgcaaagaggacgtgccggatttgaagaaaccggatgcccaactcaatttcgtactcggagaattcgagaaacgcggtcgtagagtcgaaccgatggccgcgcagcagctggtatccgtgctcggcggcaaaaccggcgaactcgccgccatgtgcgagcaattgtgtttcgactttgacgataatccgatggggctcgactgtgtcaaccagtatttgaccgccaatccgcaggtcaccggttttgccgtggcagacaaggccgtggaaggcaaaaccgccgaagccatcgtcatgatgcgtgcagctgtggaacaagggaccgatcccatcgcgttgatcggcgcgttgggcatgaagctccgtaccattgccaaagcctcggcggtccgggccggcacgatttcacaggccgaagcgaaaaccaatccgtgggtgctgaagaatgcgatgcgccaacttggcggctggacttcggcaggactcgcgcattgcatccgtatgctcgcctgggcggatgagcaaagcaaaacgaacggcggcgacccggtatatgcgctggaacgctgcattgaagacatcagtcataaaggtcggtaaaagtcgataaaggggtatttatgagcgaacacactattgcggctcccaccagcgaggccatgcaggagctcggccgccgcgtggccggaatggtacacggcggcgatgtattgctgctctcaggccctcttggtgccggcaaaaccacattcgcccaaggcttcggggcggggctggacattaccgaacccatcgtgtctcctacattcaccattgcccgcgaacttgacgggcatttcgccgacggcactccggctcatctggtgcatgtggatgcctaccgtctgggcggctcagcctatgcgccggggcaggacgccatcgggcgtttgttggacgagctggaatcgctgggattggacgaagaacttgaagaccccggcgagaacacggtggtgcttatggagtggggcgaacaaatggccaccgccttggctccagaacgacttgaaatccatatcgatcgacctctcgattcctccgatgtcgcatccgctggatcagacggcgaactcaccagcaacggcactcgtaccgtcgcattcgtcccagtcggcaagcgatgggccgcgttcgacctgcaataagccatgcgcccatagactcctcgatgtacactctctagaggctttacgactaggaggattcatgggttgcacgttggtgattgacacctcattcggttcgacggtcggcattgtggggcgcgagcccattgtggagaccgattcgcgcacccatgtggagaaactgcaggtcaatatcgcgcgcgcggtcgaggaggccggcctgactcctgccgatatcgaggagatcgtcgtgggcatcggcccggcgccattcaccggcctgcgcgccggcatcgtggccgccaaggcgttggccttcgccaccggggccaagctcgtcggacagaacgtactcgacccgcaaggcgagatgatgagcttcgtgctgggtgacagcgccatgtttgacggcatcgatttcctggccgacgtgccgcgcttgagttcgcgccaatcggatggtgacgtcccggacgccgaggccaaggaacacgaactcgaccgccacgtcacgctgtgcgtcaacgatgcgcgccgcaagcagctgtacttctcgctcaaccacggcagcatcagcctgccggacgaggacgccgccgaacgacgctggatcgagatggatatcgactacccggagcatatcgtcgaacgggtgaacgcggcgctcgcggaacacggcgaacgcgacggcgtcagctatgtggtggatgtggccggccacggcgcggccaaatacgcgtccgtctggcagggactgcgtgcgctgggctccgtggtggacggatcggtattggatgccgggaaagccgggctcgccgtctttgcgaccaccgcgttgagctgcgaactgcgcggcgaccaggtcgtgccgatcgaaccgttgtacctgcgccggccggacgccgaagtgccgaacccgctgaagcacgtgctcggccatgccggtgccgataaagcgtgaggcgggttgtgtccgatgattgttgatatcactgctgtgagtcgtgatcttgcggttcgttccattgcacagttggaaggcgaactgttcggccgcggcgcatggaatgcgaacatggtgcgagaggaactggacgcaccggcccgcacgtatctgctggatgtgctgggggaggcggaacaggcggttgtccgcggctacgccggcttctggtatgacggcgaggacgccgagctcatgaccatcggcgtgggcaaggcataccagcggcaaggcatcgccgctgcgttgcttcaggcactggtcgacgaggcgaaacgtcagggcgcctcgcgcatgctgctcgaagtgcgtgtggataacgaccctgcgctggccctatatcagcggttcggattcgaacgcatgggattgcgcaaacgctactaccagcccgaaggcatcgacgcatacaccatgagcttggacctgaagccgagggtcgtgggctttgccgccccgcagacggcatcggcggacattgaagacatcaccagcaagcaaacggagaagaacggagaagcacgatgagcgaaccggttgtactgggtattgaatccacctgcgacgaaaccgcagccgccatcgtacgcggccgcgaactgctctccaacgtcgtggcctcatccatggaggaacacgcgcgatacggcggcgtgatccccgaaatcgcctcccgtgcgcacgccgaggccttcgtgccatgcgtgtccaaggcgctcgccgacgcgaacatgacgttggcggatgtggacgccatcgccgtgtccgccggtcccggactggccggttgcctggccgtgggcgtgtccggcgccaaggcgctggcctgggctgcgaacaagccgatctacggcatcaaccatgtgatcgggcacatcgccgtcactcagctgcagttcggcccgttccccaaggacacgctggcgctgatcgtctccggcggccacacctcgctgctgcacgtggaagacatgccgcgcaaaatcgacgtggttggtaccacgctggatgacgcggcgggggagtgcttcgacaaggtcgcccgcctgctcggcttcccgtatccgggcggcccgcacatcgaccgccacggccagaacggcgacccgcacgccatcaaggtgccgatgggcctgacacaaggcaaggccggtgccgcgcacccgtatgatttcagtttctccggtgtcaagaccgccgtggctcgctgggtggaaagcgagcaggccgccggccatgagattccggtggacgacgtgtgcgcctccctggccgattccgtggccaccgtgctggcccgtaaggccatgcgcggctgccggcagtacgattccaacacgctgatcgtgggcggcggcttctccgccaactcgcagctgcgcgccaaactgctcgaattcggcgagaagtacggcgtcgacgtccgtatcccgcaaatcaagctctgcaccgacaacggtgccatggtcgccatgctcggcgtgaacctggtcgaagccggcgtggcccccagcgcccccgacttcccgattgactccgccatgcccctgaccaaggtttcgatgtaagatttgcgcggtattcccaaactcatactgggaataccgtgcctctcatcggtgaattgacagtgacctgtctgcctgatgtgagtagtggtgaggtcttcgccatggatttcccggttgatgatggggtgtcgtgtctggtcaccaatgcgatgaaaataaaaaagcctcggagaaccgaggctttcgatggctcctgcggctgggcttgaaccagcgaccgtccgattaacagtcggatgctctgccaactgagctacgcaggaatattcaattttcatcccgtccggagttacccgttcaggtgagctcctgcggctgggcttgaaccagcgaccgtccgattaacagtcggatgctctgccaactgagctacgcaggaatattcaattttcatcccgtccggagttacccgttcaggtgagctcctgcggctgggcttgaaccagcgaccgtccgatatacggttctggctcgcagccgtagggctttttgcaacaggagtaaacaatacaccagccttgctgttccttcaaatcggcgtgtcatcgcgcatgttcgccttgcagctggttttccgaagagcatcggccagaaacgcgcaatagtattccttgggaagtgatgaagaagtcacttcccttttctatgcgcttaaggagccccatgaggtattggaacgacaacaggaagagctgcgaacacgtcgagccacgggaggattggaaagaatccattgagaaatggatcgactggatggacgccatcggacgcacgaacgacaccctgcgcacccgctggtaccagatcgttcgattctccaaagccgtcgataaaagcatcaccgacgtgaccgaagacgacctcatattctacctagccggcatgggaaccgaaggcagacgcggagtacgcagctgcgtcaaggtcttctaccaatggagcatgaagcgagggctcgtccgccgcaatccggcggacgaagtgcccaccgtgcccatgacccttccgtccggctgcatctgtcccgaggagaacatcgaacaaggactcgcatcacccgacgagaacgcgcggctggccgtcatgctgggcgcgttctgcggcctgcgccgcatcgaaatgaccagaatcaacctgaagaccgatctggaggagaacgccgagggcatggtgctccacgtccacggcaagggcaacaaggagcggatgcttcccgtgccggcaaagctcgcttcggcattgcggaaacgcaccggcgtatggctgttccccggagacgtgcagggacactgcggcgtcgattacgtggcgaagaggatcaagacggtaaccggatacccgtcgcacagcctgcgccgtaggttcgccacatgcgtctactacaggaacggctgcaacatcgtgcttgtcagccgtatgctggggcacgccaacatcgccaccaccatgcgttacatcggcctcgtgcaggacgaaatgcgcaacgccgtggaatccaccacccgcaccgacatgagactgaccatgcccatgaaccaggtcgtcggaacagccggcagcgtcgccacctattcccttagcaccgcgaggatcggatgaacaaacggtatacgccaacatgcttctttgcgcatattggcgtataccaacaccgctcaccgagtgttcccgagactggaaagcggcaacgcggctatgtctatccccagcgcatcggctgcggagaacaccgcttcaatcggggcttcgccccgctggagcagagcatcggcaaaccggggatcgataccggcctgggaggcaaggtcgtcggcgttccaggaatggttcgcggtctcttcacggaaggcggctgcgatatccgattcggtgcgggcgaaaagagtccggcgttcacgcggcgcttggaaacggctgaggtaacgcgcgtactccaattgcgcctttgtcggctcaggcaagttatagtccagattcgacatcgcagacctccttagcgttcagcgggttggactggagtcgttcgacgcaccgaaaatagggaatccgggaaccgcatcggccgacgatggagtgcctggagtgccgtacaacgtcccgatctgttcgatcgcccatgcgctccaacgtggggattcgaccgtggatgtcatcaggccggcggggaggaaccggcgcatctcgtcggcgaaggcatccgagccgatcacatcggcgacccccgccacgcgatcagcacggtctgcccaaagtccttcttcgccgtaatcagatgatttcaattccgcaagctccatcgcccgtcgggaatcgacgtcgcctctcgacgccaaccagcacatgtcccacaggtcgcgtcgccgcaggtgcgatgcgcaggcataggagagcagcttgtcggcaagaatctcggtggggctttccacatcgaggatgatctgacccgacaaggccgggaacatcggatagttgaccaaggcgggacgatgctgcggctcgtacgcgggaatcgatgccacctccagcttgattgtctggctcggcagatccttgcgctgaccggccgtgcgaatcgctatacgccatctgcgcgtcagcccatcggcgtcgggtctcggctccttgacccggaccgtcacatcatcgcccatccccgagagcgaatcggagatgcaggagccaagccctttaagggtgtccatgtcgaacgaggtgccgccggcaaaatcaaggtcctcgctgtacctcggggacccgtggcacaggcgcagactcgtgccgccctggaacaccagcgaggagaagaaaccctcgcgcatcatggcgtccaggattcgataatgcagaagttccttctcgaccacgggaagcagattgcccatgccctcgcccccggccaagacgatcccggccgccatagccttgtagtcataggtgccgtcagctccagtcatcatcgtcctccaattcgtccatgtccaccagatcgaggttgcgtccgacggccttcaggtcacgatacgcccactgtttcgacgcgagcggcgtcagtccgtcatcgcgggcgatcaggttcggcaggatgcgactccagctgagcttgcagtgcgtgaactcgatcaccccgtacgcggtgcggaactcgccctcacggcccgtggtcatgaacgtgaccctatccaccggaatctggctgatcacgttccagcgcgacagagcgctttcgaggctttcccacaccagctcgccggaacgcaaccgctttgcgacctgatgaagtgtcccctcgccgagatgggaggaatacgcgaacacgtagacgccacgggcggcacggaccaacgccttcgccgataccaggctggacagggttcggttcagtttctgcccctgctcgcccagcacgacggccagttcgttcttgcaatacacgtagcacgagtacttggcatccatctcgcgcagctggtcaatcgcctcgctcctcttcatgcatataagtgtacatgaatatatgtaaaaacgcatattcatgtacacctatcacaatcctgaagcgttccaatcagagggaacgccctcgtgccggaccgtcttcgagaccaatcccgtcgatggcgttttccgagaaagggttctctcttaatctgccgacgatttccgctacggcgcgctcttcctgatcaacgcattggacaagctgggaaatgaacggcttgggatcgccgtcaacctgccatgcttccagacttttcccatagctgcggccggcatcatgtttgattgctacgggccggtagccggcagccatgagcatgagattcagaatctgtcgcccggttcgcccgttgccgtccgtgaatggatggatgttctcgaacatcgcgtggaatccggcagctttgaggatcgggtggtctttggaaccgttcaccgcgtccacgagcgcttccatgtcctcgtagatttcaagtgggtcggcggtcttcactcgggtggcggtgatccttgcctggtagccgtaggggcggaaccgacccctgagcgcgggctgcatgtccaatgcggtgacttcatgcagcttttggatcatctcgacactcagcgtccgctcctcttcagcgaatcgttccgcataggccatgccatccgcaacgccacgggcggcgaagatgtatcttgccggcgagtcggtcggcacgaactcgccctccaacaccagttcggtgtcctcaagcgtcagcgtggatccctcgatcgcgttggagttgtagacatagcgggccatccattccttacggtaatcctcaagcgctgactgctccaccccatccaaaggaaacatctgcctgaaccgttctcgggcagcatcggaacgacgaagcaagtcggacacctccgcgtcccgctccagagagtccaagagaggaggaaggtttcggattttctcagtcagcgctggattcggcatatcggctccttaatcgatgcttccataagtctacaagcgcaggcgcgtcacatggacagtcctggcgtatctctacctccacactgccgtcgtggtggtggccgcgcatcttcaggattccgttctcgtcccagatgtggtcgatctcgcaatccttgaacggggaatcatcgccgttcatcagatcatcgaaggtctcgaacgaggatatgcccgtgcgttcgccgtcccatcggccgatgacgccgaacgcgatcagcgggttgcctcccatcgggttcctgtacgaggagagaaccgactgggatccattgaagaaatcacgtagagcgccggtctccatcctgtaatcggtttgacgggattcgtccgcgaaggcatcgaacgtgatcgacgtgccgctctcctcgtacagccgccacaggctgtcggcgcgggtgctgtgttcacggtaatacgggtccccgtgtcgcgtgtcgtagtcggcggcgttgtagatgggcctcttgaggggttccgggtcgcgtatctcgtccgtccaattcatgtccatcatgtgctccttcgctttatcgtccgtgtgtcgtttccatgccgtcatccaacgcgaggccgagccctgcggtctcaggagacgtttcctgtgggtcggcccagccgacggcgaggtccagcgcgccgcgcaacgcctggccggaaagccggtacgtccaggaatcgtttgcctcgtaagggaaggattcgccggacacgatgccgcgctcgtcatgcaggctcacgtcgaacgttccgggtttggccgtgattagcgcatgacgggcggaaccgggagccgagacctccagcgcctttctgccgtcgggagacccggtggcggtgaatttgatatcggggtggtgcgcgaggctgtaggaagcgttggactcacacgccagcgggaccgtatctcccagcccgctgtctgcggccagctgctgtgggctgtaatccatgccctgcgtgtagtcgatgggctgcgcgtcggtgtagaagcatccgccgccatcgtccgcgtcgatcaggtcgcccacgagccggtccaggcgtgcggggtcgtcccatgcgctcacgagtctggcgggttcggcctggttcttccatgccatgtagcggtcgcgttggtcgccgcagatgccgtcgaatgattcctgggagatgaacgtgccgccgtccaattggtagcattccccgtccgggtccaacgcgcgctccttgaactccttttcggcggcggcgtacaggcgcttgtcgagcggttccatggccgcgtcgatgcccgccatcatctcgtccacgtgttgccgcatgtcgggctggctcgttttccaccatgcctgcaagtcggcgagcacgtcggcggcgttctcccgttcgcacacgtcgagcaggtcatcgtcgtaattttccaccgtccaggagtagaaatcccagtcactcgaaccggtcaggcgttcgatgcccttcatgcggtggaagtccatcaacccgccgccgtgctcgcgcacgatgcccgccaacggcagatcggcctcgtccatcaggcctttccagtattcggggacattcccgttctccatgtcgttctcctttccgaacgccttttcgatcacgagcgggtctcgtgggtcaacagtgcggtcgatccgcagtatctcgggcatgaccgcctcgctttcacggccgatgacgaacgtgccgataccggccttgacgcgatgctcgggaagccttcccgaaccgtcgcacatcaccgccggccggaacagcgaatccccgtaggcgagcgtcaccgtgtcgcccggcctagcgagaacccgttcgacggccatgcgtgagaggccgtgcgcgtcgagacggccggaacgccaatcgttggcctcggctgctgtcagggtgaaggaaacggaacgcccttcctgggccgaggtcacgtcgagcctgactggctgcatggcctcgaaaccgatccagatgccttccggcgtcctgtccggggctttcacgtcaatgtccgtgaacccgtattcggtcagcacgtccgtgaccctgatcctgagcgcgttgtcgggaggcagatcagggcgttcattgggaatcgggagcgaggacgcctcgaaccacacgtcctcgctcggatcggtgtcgaagccgccgtccgcgtcggaatacgccatgtggacgccgaactccaattccttggcatcggcggaagagaccagaatcgcgttccccagcacgagatcgcgcgcgttcctgcgcaggatggattgcatgtcgggcttggcgggattcccggccgcgagcaggtcgcggttcacaccctccatgtcaaaaggcgtcaaggccatctcgctcgccctttctcacttggaaaggccggaaccggccgtatcggtcatattcagcgggtccgaggggtcgcacgcctgcgcgcgttccgcgaacgaggtgacggcaccgggcagcacatatcccagatcaaggtcgatcgggctcacgccgtcgtcttcgccgacggacgctgcgggcattgcgcccatggtctcgcgcagcacgtccacggcgtcgccagtagcggcgcgcgcgtcgatgatccggtgcatcgtgtcctcaagcgcggcatggatatcggtggaaccctcctccacgatgcactggtatgagggggctccccagttcgtgccggtgccggaaatcgtgtagtccgcgatgcgttcgcccggctggacgagcgaggcgaggtcgaacgcggccggcgaaccggtcttcgcgtcgaaatcatccagccattcgacctcctcggcgatctcctcgcgcgagtaccggccgtcgatatcgctcggccagtccgcgtcctccagatagccgttgtcgccaagcgacacatcgccgtcgagcttgaggtcccggccgtacatctccatatcgatcagatagccgagccccgtatcgaacatggaccacacggcatccgatgcccacccatggttcacggcggtccaggcatacttcgcctccttcgattcggccgaggacggcgcatcataagagtgataggggatctcgtccgagttcaacgcgaggttcgcgtactgcaacggggtgcgcgggaccgcgtcaagatcgtcgcggaccgtctgcaccttctcgtacacgtccgggtcgtcgtcctcgcgcgcctcgaacgcgcggcacatgaggttcaggtccgtcagcgactcgtattcgccgggattcgccacggtggcgagcagtccttccccgccctcgtagtcgtggatcgcgtactcctcgtaccggccgcccaatcccacctcggtcttcagggtgtcctgcaagcgttcggcgggcatgggcagcgtgatccacgcgccctgcaacacgccctccacgtatttgcccaggttggcgacgtacacgctgatctggtagtccttcaatccggccatgatgatgctccttcgctcgggtcttttatcgtgtggctgcggccgaggcagacgtatcggcaatgctcaacgggtcggccgggttcgcgggatcgtaggtttcggacgtttcggccttctcgccttcgtctttgcgggcgagccggccgtcgtccaccatcgcgtcgatgatctcccatccctcctcgatgctgcggtcccgcaattccctggccgagatcatgtcgcgcatcgcgtccatgttctcgttgttgtcgggccagtcatggtctttcagccagtgccgaaggtcctcctccgtccagcggatctccgcaatcgtttcgttgccttgcccggcgttgctttgaccgggatgaagcaacgcctcagatcggagaccgaaatacgctttgtcttcctggaggccggacaggaagccggagggcgtgaacccgttgcgtgccgcgaactcgcgggaccagcattcgtcgaactcctcgtcggggtcgaagtcgaggagcccgtccgccatggcgcgcctcagccccttctcgtccgcctcggccggcaccgtgaccgtgaccgtggcgtggttgggggcctccagcgtcatgtacagttcgctgtggccggcgtcgcgttggatgaagcattccccgttgccccagtcgagctcgtgctgctcgatcagctccttcgccttgtcggtcagggcccgttcctgggacgtgtattcgtcgggttccatcagcatgatgcgtccttccttcccttggatgatcggtgccgcgccgtccggcgggcatggctccgatcatcagcccatacgggcggtcgcgcggggcatggcgtctacggggcagatgattccgccgagatttgatgctcggtccctttacgtgtcccgctccttagtaccagttgtgggcgagccagaacgtcttggcggcgctggggctgccgtaccggccggcgatgtagttcaatccccatttgatctgggtggcggcgttgtccttccagtcgtctcctgcggaggcgagtttcgaggcgggcaacgcctggggcatgccgtacgcgccgctgctcgggttggtggcattccactgccatcccgattccttgttccacagccatacgagcgcgtcatagtcgccgtctccccagtccttgtacgaggcgatcatcttccgggcgatggcccgggcctgttccggcgtggcgtgggtgccgtcgccgtcgtagtccaccaccacgtccgtggagcccgagtcggaactggagcacgtccatgccgcctccaccggatccgaagaggaggacgagtcggacgatgacgacgaatcggacgattcggaaccggatgacgtggaatccgtgccggcggaaccattggtggacacactgccgttgggcaggatgtagaccgcgccgacgtcgatcctgtgcgtgcggtggttgacgatgcccaggccgccgcgcccgttcatctcgctgatggtcacggtgccggccgtccggtcgaccgcctcgacgacggcgacgtggccgtacagggtgtccgcgtcggccacgccgggcgggtagctgacgatgctgccggccacgggatcggtgcgggtggtcttccatccggcggcggtggcgctggcggcccagtcgccgccgttgccccagtaggagcccacgtccaatccgattttatggcctctcatgcacgcccaccatgtgcattgcccgtccggataggcctggcacacgttgtcgggcccgtcggatccgttgaaccacgccttggtctgcgcgatggtcatgccgtcacgcacctcgccggtcgtgacgcttcccgtgacgcctcccgacgatccgttggagccgccgtccttgcagccgccgaggaccgcgagcacggtcaacggcgtgcatccgccgagcagggacagcaggcacgccgagagcatggccgcgaggatccgatggcggctggcccggctcattgcgtgttcctcagcgaccagaagggcttctgcccgccgaccacgacctccacggtccggcagggatgctggaccgtgccgtatccggtggcggagatcaccgtgtacgcctcgtcgccggccttcacctgatcggggtcgagctcgttggcatccttgtccagcaatgacgcgtcgagcgcggccgggcagtagacggtgacgtgccagttgccgtcgtccatcggcaagagcacggtgttgtacgcctggctgacggtctgctgcggatccgtcgtggatgacggtccgccgccttccgggatcgggaagctggtttccttcgtcgtccagaacggctgggactggatggcatccgtatccgagccctcccatttgccgtcggaggtgcaggtgtaggcgtagttgacgtacttgtcatcgtattggcccgagcatacggatccggcgtggaagcggcgctgggtccaccaccagcgcggcgcgtcggagaccggatggctttccccggcaccgtcgtcgccgagcagcgcgaacacgttgttgcgccattcgtcgtcgctgccgtttggatcgagcagcgcgtccaccgtttccaatgcggtgtcgatcgggccggaaccattgtgcagcgtgatgccgtccgcgttttcggagagcgtgcgggtgccgtccttgtgggtgtcaacggggaacgcggtggtgcgctgagaccagtcgccgggaaccgggattcccgccgcctccaggccggcgtaccgtcgcgggcccgaatccgttttccttttgcccgtggactcctgtttcgcgtccgtcgcggaaccgtggtcgtcgccggccgttgacggctggtggttggcgacgatgacgcccagcgagcacacgaggagcgcggcgacgaacaggcacaggacgcgcagcggtttcggcagcggacgcggttccggccggttcacgattcaccgccttcccaacggttcggctcgcccggcatgccgccttgcgtgttttcttccatggccggatgctcccgctcggggttcacggttcccggatccgcgttttcgggcgacccgtcttccgccgacccgtcttccgtccccgtccaccgcgcgtctatgaggtcgtccgccgttttcagttcggcgctggtgtttcccgcgtccttcgccttcctgcgcagcagggtggccttctcgcgggcctcttccagacgttcctccaatgatttgatgttgacgcgcgccgccacgtactcgtccatcgcatcctgtttcgtcttctggctgtcgcgcaccgccttgaggatgctgcgtttcatgtcgcgcatggtgttctggttgttcgccacgacgatcttcctttcgctcgtttttccgtcaaggcgagtctgccttcccgtcgcgcgttccacggggcatggcgtctacattccccatggcggaaggcggggcgtgtagacgccgtgccccgtggccggccgttttgcggccgagaatcggaagcgtcgttccaatcaggtgaaaggaaaatcaatggaatcgtttctctctatgctcgccggctggttcatgggcctgtggacgtggctggtcgagctcaacgggatgctccaggtggtgctcgtgctgttgtgcgtggtcgcctcgggcgtgtgcgcgatcatcggcaaacgcatgggcagcccgatgatcgtggaatccggcggacagacctggagccgcacgctggtgacggccatcgcgtggatcgccggcgtcatcctcatgctgatcgcggtgctggccatcgccgccgtgttcgcgccgctgctcggcttcgccgcctgaccttggcgacgcctttccatccagggccggccgggaagggattcccgcgccggtcctcgcatgtcggacaagaatcaaggaatcccaaaaaacggaaggaacgcgaacgaagaatgaagctcgtcatcgcggaaaagaaatcggtcgccacggccatcgcgcaggcgttgtgcgccgcgcccgtccaaagggacggatgctatgagtgcggccagctgctcgtgacatgggcgcagggccacctgatcgaccttgccatgcccgaggactacaaggacagggattggaggaaatggagtctggacacgctgcctgtggacccgtccggccattggcggtggaagatcagcgaggagcgcggtgccggctcccgctaccggcagatcgtgcggctgatccgccgaacggatgtggattgcctcgtcaacgcctgcgaccccgaccgcgagggtgaggccatcttccgccgcatcgcggacatggaaggctctcacaagccggaactgcgcctgtgggtggcgagcctggaggcggaggccatccaggccgcgtggcgggcgatgaaacccgaatccgaataccaagggctcgcatggtcggcggagatcaggtcgaaggcggactggctgatcggcatgaacgcgagccgcgcgtactcgctgctctacaacgcacggttcagcgtgggccgcgtgcagacgccgacgctcgccatgatcgcggaacgcgaccggcagatcaggaaccacaaaccggtgccgttctggaccgtgatcgcggacatgggcggatggcggctctccagcgaacggatcgacagcaaggatgcggcgatgctgctgtgcggccaggccgaacacggccgcttccgcatcatgtccgtgaaccggaggcgggtgaacgaccggccgccccgcctgtatgacctgaccggattgcagaaggacatgagccgcatgtacggcatgaccgccgcgcgcacgctcgcggcgttgcagcacctctacgaactcaaactcgccacctatccgcgcaccgacagccggtacatcacgcatgacgacctcgaaacgctcacggcgctcctcgaatccggccgtctcgcccaagggttcgtcacccgcgagggcatacccggacacccgcgcccggagctggccgtcaatgacgcgaaggtggccggccacaccgcgatactgccgaccatgcaattggacgccgggaagctggaaggcctggacgatgacgagcgcaaggtgatgacacgcatcgtgcgccgcatgtgggaggccgtgggcgacgaccatgtgcacatcgtcaccgaggtgaaggcccggctttccgacgacaccgacagggagttctccagtcgttccgacgagaccgtatccgcaggatggaaggccgtcgaaaccggccacgggcccgaaccggaagacgaggaaaccgcgaacccggcgggaggaaggaacgtgatcccatcgaacctcatggaaggcggcgtcattcgcccggtcgggaaggtcacggtcgaggaaggcgagacccggccgcccaaaccgttcaccgaggccacgctgctggccgcgatggagcacgcgagccggtgcgtggaggacaaaaacctcaaggcggcactcgatgacgacgaatcacattccggcggcatcggcacacccgccacccgcgcggacaccatcgaaaagctcgtgcgctccaaactcgtggaacgcaagggccggcaattgcacgccaccacggaaggcgaacgcctcaccgacgtggtggagccacgactgaaggacgtgctgctcaccgcacggatggaacaggcgttgtccgacgtggaacacggcaaacgaggcccgtctgaggtgatggacatgttccaccgggaggcattgcgaatccccgccgacgcgaccgcgaacctcaaggccgatgccgtcacacgaaccgcgaacaccgacgcgcaggattggggcgactgcccgcgctgcggccagccggtcaggaaaaccggccggatgtggcaatgctccacgaacaagaccgagaagaccaaggacggcaagtgggccacgaccgcaggctgcggatggaagatgttcgcgcgcatcgcgggcaagaccatcaccgaccagaccgcgcgcaggctcctcgcgggacaatccgtcaccctgaagggcttcacatccaaatccgggaagaagttcgacgcggccatccgcatcgacaaggaacgcggcacggcgttcgatttcgaccgctgaccaaacgccaaccatccgtgcccgacgcaccatgccgcgccgggcacggcaacgaccaaggagacgatgaaaccatgcgacgatacagccacgccttccgggtcctcatggaccaggagctgttcaatctgcttgccgaggcctccaccaagacgggcatacccaaatcccgtttcgtgagatacgccatccagccgttcagctacacggaactcgcccccggcaccaccgattggaacgacgtgtaccgcaccgaccccgaccccgaacatccgctgaagcggggacgccagctcaatgtcatgctcaccggcgacgaatacgagatgctgtgccgggccgcattcaagctgggcatcgcgcgcagcgcctgggtgcgggaacgggtgtacgcgctcctctgccgctcctatgcggacgagctctccccgctcacggacgcgagcatccgcgacaacgcgacgatgctgctcaaggagctcaagacgaaggatgcgggaagatgacattccaaaaaaaggaagagccccttcccattcgtggaagaaggcatcaccccgaacgatcatccaccctcatgcgttttcctatgcgctcatatggatatgtccatggatacccacatggacacgtccatagacatccacatggatatgtccatggacatccacatggagatgcccatcaaatcgaaggtaagcaagctagacggttcatgtacatgaaccgaacgcagcacctcccgcgcccgtcggcgcaggagcaacaacccgagtgccgaaggccgatggaggagaagaaagaataatgcgtaaaagaagcagcaaaggcggcggcgcgcagcgctccatccaagtgcatctcatggtgaacgaagaggaagccgcgatgatccgcgccgccgcgaggaaacggaaccagacggtatccctcaccatcatcgaagcggtaaagctgttggagggaagcctgtacgtcgaggaggaggaacatgattcgcccaccgtccaggcgctcagggagatcgaataccagctgcgccgcatcggccgcaacgtcaaccagatcgcgcacaacgcgaacagggagatgaacgcgaccatcgaggacgaggcatcggcgtcctacgccgtccggcaatgccgggagctgatagaccatctcgatgccgtcatcgggcagtccgggggagtgcctgatgacgcgaaccggtcagaggagggtcaggctttgcggacggtccgcttgtagtccttggatttcttcgatgaaccgggagaacgtcatggtttctccctggatcaggtcgtcataggattccttgactaccttgggcatgaccaggtggatgtgcagttcatcgagttgggcgagcttgggatgggtcacgtcgccgggagtcagggtgaacaggtgtttgtccctgatccggttggcttcgtcggcgacctggcggaaacgatccttgatggaggttttcgaggcgagcatacgcagctgttcctcggggaacgccggatcctcgtaggcggcttgcgagggaaacatgtcgccgctcgcgcacacggtgcggcagcgccggaaacttataggccggctcgaagtcatcatcacgcaagccgaccgtaaataatcccatggagttcgggagcacccccggacgccacgaccgtcacctcagtaagccggaacctccatcgaggccgtcgaggggaacaccgggcacgatgcccatcccgttcacggcatcattcgtcttttccgcgaccccagacgattgggccaaagtcagcccgccgggcacatggccgacggcgttctgtgagagccaatcggagagccgggagtagtcgcccgtctcgtagtagcgcaggagcatagagacgaactgtgccttgtcttcgggagggatcgagaagacgccgatgccgtcgtgtatgagctggtggttggcaaccatcagcgcggtgcgcttgttgccgtccgaaaaccattgtccccgcgtgaccgcgccgaacagcagcatcgcagtgtcctccccttctgactcctccaggatgccgcgaaccctttcctgtggggattcgacggtggggatttccggcacccatcccgtgccgccgatcctcacgccgtattcacgcaagcggccggcgtcgcgcacgcggccttcgccgatgatgcggttgtattcgcggatgtactgccaatcgactggatagtcgatgttcccgagcaggaatccccacgcgcgcttgatgttattcaccgtgactatatcgtccacgctcataccctcgggggcgcgcccgtcgaagatttcctgcgtgtcggggaaggtgacgccatcaacctcgatcttggcggtgcgccagatcaaatcgaccagcagccgcttcgccagttccacggccgtgcgcctatccgtcgtcgtatcgttcctcaccggttccatcaaagccccttatccgtttccgataattctatcgaagtggccgtgccggcaaagggcgcatatctctcatagacgccatgcgccgccgtgccgggcgcgcgggcggagaatcatcgtatgataccgaatatcgtcaggggttcggacccggccggcctggtgcgctacctgttcggcaagggacggcgcaatgaacacaccgaccagcatctcgtgtgcgcgagcggcgacatgtttccctcgtttgacatggatggcaagccggcggcgtcgtatgcggagataggccgcaggttcgaccgacgctaccgcgtcagggaacgcaaggacgatccgttcccgcccgacatgaggggcaagaacaaccccgaacgagagcatggcaggaagcgcgtgtggcactgctcgcttgccatcaaggccgggcagggaatcctgaccgaccaggaatgggaggccgtcatccgtgattatctgacgcgcatgaacatcatcgacggcgacgacgatcagggcgtcacatggctcgcggtccgtcacggactgtccgccaacggcaacgaccacgtgcacatcatggtgcagctcgccgccgacgacgggtggataaacccgtaccacgaccggatcaacgcgcagaaatcatgcaggcggatggaaaagacgcgccccgaactggtcgagctcgcacgttccgataccggcacgcgcgtcagctggcagtatgggcaatggcgtcaatgggccgaatggaaggcgcgaaacgagtacggcgacgacgagggatgggatgcgttggacggcaacgagagaagccggctcgtcacggcggtcgccgcctcaacgatgccacgccaatacatcgcccgaatcgtggaggcgtgcgccaaggcatcgcacagcgaggacgagttcatacgccgcgcgcgcagggaaggcttctccatcgaccccaggctgcgcaagggaaccgccaaagactcgttcaccgaccccggccaggtggtcggctacaggatcacgtggcgcagcacggacgggtggacggaacggttcaacgccttcgagctcggcgacgacatgcgattgaaacgactgcgcgacgactgggcggacgatgccagaagccgcagcctcgccgtgcaggaatggcgcgccgcgatggagaaccgcccgcccttcctcgatgatggacgcgaacggcacctggagaacctgtccacgcacgacatggaacgcctcgtatccgaagcgttctgcatcgccgccagcctcaacaacgcggcggacgacgacgaataccgggcagcgatgcgcgagggcctgcacacgttcgacatgctgcgcgaacgctacggaatcgcgccggaatacggtctatggagcatggtcgcctctgacgaggagaaccggccccgccgttaggacgcttcccggaaaaagctcagatggtacggcccgaggaaggaaaaccgagcgaatcgggcaaagccgatgctggatcgagagagttcgccggctcgtctcccggcatgatcggctcgatggactcgttcgtcttcgtccagcacgcgttcaggcgatcggccatccgcgcgtccaggccctcgcaggattcggatatgccggcgaggaccttccccgccatacgccgggccatatccgccaccctcgaaccatcgagaccgtgacgtgtcgccagatcctcccaatcctggggcgtggtgtgctccgcgaaggcgtgatcctcgttcaacggcatggtgagttcccaattgaactcgggccaatacctggtggcgaccgcatcatactggggagacaggcgtatccccgatgcgggatcgaggatcagggaatagttcttcgcatgtgcgtcgctgttggcggacgacgtgttgaaggccagcctttcgagccaccggtaggacagggaacccgacgcatcgatgcgttgcaggagatccaggcagtcatcggccgacggatcgtatttgtcgcgggtcggcaatcccaacgcttgcaggaagtcctcttgccgcagtcggacgattcggccttcctccaggcgacggtcgaaccgttccacgatataggccgtcttgcgctgcgccgtgatctcgccgcgtgccggtgtgtcgatgccgcacagttccgacaatcgcatcgtcgccagttccaccttggtcgcctcgggaaggtcatggggcttcggtttgacgatgtgggtggagggcagcatcatatccggccaataccacttgccgtccacgcgggacagtgtgaacttgccctgcgcccctcccaaggagaaccggcagtggctgtcctcgtcccaccagtagttcctggtccgctcgatgcggtcgatttcgttggctatctgggaatcggagatcagacgaagcgtcggcgatgggattggaggttccggggagagggagaacaccagtccgccggtggcgtcaacccggtccagcagatcgaagacgccggccgaggaggcattcaggtgctcacgcatggcctggcggacgttcggattgtcgggcaatagattgtccaggaagttacgcggtgcctggtctctccatccgccggttctgggcaggctcagactgatcggcagaccctcgttcgcgtcgtacgcgaacgatatgcgctcctcgtcgtcttccgagaacacgcccacatgatgcccgttctcccaggcgtgcagttccctcacagcagtctccccgcgtaggcggacggcagcgtttcggtgcggatgtgcagcaggtcgaacatcctgtacacgtagcggatggaggtcagaccggtctccacgagctcttcggcgcttgagagggggaccccggctctcctggcgagttcggcggcgtcgagacccatgacggacatgcgttcgcgcacgcaacggcggaccgacgaggtgtcggggaagaaccgcgccgggttctcctccttctcgtcgggaagacccttgtaggcggtcagggcatcatatttcgacagatccaacgtcacgtgtgccatgctcgtcctttccggttccgaaagccgttgacaccatgatacggccatccgatgccggcgcaccccacgaacctcatggcaaggggtgcgccggcatcggcgtcagcgtgcgttgccgttggtctcgggttgcaggatctgcggcgtcgagacgttggcctggtcgggtatcggctggtccgtggggttcatggaggattccatggcgggactgtattcgccgaacgggtcgggcccgttccattcctcgggttcgttcaggtcgagtggcatctcctcgtatccgtcgggctccccggtcgtcaggtcgccgcctcccgtggtctcgggctcgggtccggatgccggtttgcgttcatcggcggcgggcttcgtatgctcccgcacgggtgtgggggtttcgacgattggcgcggcgtcagcgttctcggtgcgttcgacctcgcttatggtgctgggctcgtctcctgtggccttgttgtccgcgtgcgaggattccggcaggccctggtccttgaggaagctgattcgggaggcggcgtcgtccacgccgttgaccggcgcgcacatcacggcgtcaacgatcctgtcgtggtcgtagcccgtccattggccggtgagccgcgagtccacgaagaacgtggcgtcgtcgccgtgcgcggcctggaacgcctgcgcgtcctccacccgttgcaggtccacgggcacgccggccgtgttgaaggcgttcagggtggcctgcaacgcgggcgactggtcggtgtaggtgatgttcacgtggttggtcaattggtcggctgcggcgtcgatgtgcgtttccgggtggcgtttcgaccattcgtccttcagccgggccttcgcctcgatgatctgcctgcggtagccggggtcgttgccctccagttggtcggcgaccatccatccttgcaagagggacgagtcgcgcatcttcctccagccgtcgccgtcggcaagcacggtcgcgttcagggtggactcgaaccccttgttgaggcgttccctgttgtccatctcccattgttcgaggcggatggattgctgctgccgtctggtctgctcgtagcgttcgttctggacggcgcgttcggcgcgttccctgcgtcgcgcgcggtcgccgctcagctcgttgtgcagggtgcgcagctgctgggcgacgctgttccagctctggaccatgatctggtcgaagccgtcctcgggatcagtttgagccattgtttctcctccttgttggcgtgatggtggtttccttgttttccttgccgcctgcggcggggaccgacaacgtttccaggatcggttcgcgccatgcccggttcgggcgttcgcagggcagcggttcgcccttcctggtgagattctgcttgcagtcgaggctggcgacgatgccacggtccttgtcgaaaacgcggtcgagcatcgacgccgcctggatgtagaagatcatcatctggccgggtgccttgcgcgcgttctcgtaggcgcgccacatggcgtcgagcgggaacacgagcgccggatagcgccaccagtcgctcacccattgcatgttcacgctcgcgctctggtggtagcagaacacgttggccacgaacctttccacgaacgcggcgaggttcggatagtaggtctcgctgcgccgcattcgcgcgccgaactggccggacacgtcccttgcccgcgcgggatcgaggtcgccggattcgtctcggccgagatccgtcttcccctccggcgcgggcagtatacgggtgtcggattcctccgcaccggcctttggaggggtgtcgtcacggtccgttgcgtcttccggcgggttctcgtagccgttgccggtttccccggcatcggccggaatcccggatcggatgggttccgccgcgtgccggcctgccggcacctcgggtgcggtcggcgtcggctcgccttggcccggcatggtttcctcttcgatctccttgtcctcggggatgtgcggcgcttcggggttgggcagtcccttgccgtaaggcacgcccttctcctccaggatggcgcgggtgaacagttccagccatccgcagtccgatgacagcagggtcctggcggcaccgaccgcgcgctcccattcctccccatcagggccggacgtggtgttcgaggtgtgttcgctcattatgcggcctttctctgctcttctcgggctttcgccttggcttgcgtcagggcgtcggcccattgcctgttgcccgtccatggcagggtcttgacgatctgcgcccgggattgggatgcgagcagcagcgcgcggccgacgggccattcggtcaggtcggaaacgtcgaggatgttctccttctggatcgagttgttcacgctgcgccggccggtgccgtcgatgttgacgctgcctcgcacgatctccctctggcccaccagctggctgatctcgccgaggaatttcgcgtccttgatgccgccaaggtagacggtgatgttcgcgttgttgaacagcgagccgaagttcgtctcgccgaacgcggccctgccctggtcggggttctgccagatcgtcatgatcgggatgcccgccgaaccgaaatacgagtacacgtcggccagttcgggccagcggcagatgttcgcggcctcgtccagcacgcagcacaacgggaccggcagacggcggttgttgccggtgaactcggattgggcgcgttggaacgcggtgaacgccaccaccgccgtcaggctggcggtcaacgcggtggagggacggccctgggcggaaagcaggtacagggtgtcctcgctcgtggcgaactcgtaggggtcgaacaggccgcgccgctcgtcgatgttcccattcgtatcccggtgcgggtcgatccagtcgatgatctcggggtccgcgaggaacgcgaccatggtctgaaggctgccgaacacgccgcttcgggtttccggcgtcagcgcgatcacgctggacacgcgcgaggcgatgcccgcgtagcgcgggtattcgctcaggatgtcggccggcgacgtgtcgcgctcgttggagcaccacctgaacacgtcggacacggaacggcctcccagatgcgcggcgaacaggtagtcggcgagctgctgggcggcggtgccggggaagaagtcgtcgccgccggtctgcggctggcccgaggcgtaacgccagcagtcggcgatgcgtttcgcgtcggcgatggactgcaccgaggcgatcaggtcccacacccacggcgcgctcttccggttcgggtccgcgatgcgttcggggtcgaacgtccatatttcgccgttcggatggtcgagcctgcggatcggggcggtcacgtcgaggatatcgcccttgttcgaggtcgccaggcacgggcccggtgccgagagcacggccgggatcgcgtagcacagggacttgccggaacgtgggcccgccagaacgatagccatgtcctcccagctggtgtacatcgacgtgttgtccacgatgttgagccccagcggatatcccggcgacatgcccttgcgccagtggtccgcttctatgagccttgacgccatggcctcggcgcgctggcgcgtcaccttctccacggcctcgccatggcccatggcaggcgcgtacacgtccacgcgggtgcgtgccttggcgccggttgcccacggcacggccttgctggcgatcagccacgcgcccacgccgcacgccacggccagtacgacgagcacggccacggccagcgcccactggcctgcggtcagcgaccattggccggagaccaggtacatgagcgcgaagatctggaagggatgccccgcatgggagcacacgagggcgaacgtcgtgaggatcagggacaccgcgacgatgatcgccagttcgatcttgcggctgggacggaccgtgccgcccagatccttcactcggttcgattgcagtttcggatcgacgtcggccaagattcatttctcctttcaagcatgacggcggaaccgatggaagcggtcccgccgtcgatgcgccagggcttgcgtcatggctagcgggcgttgcccgtcgtgaaatcggatggggtggaaaggaaatccggtgccgcagggtccgccggagcgggagccgcgcccggtgtcggatagcccgacagcggttcgaagggctcgccgttgaaagtgcggggaacgccgtcgccaacgtattcgccgcgcgaggcgtcaacctggtccgtccatggatccgttcgcccggcatcggccacggcaccggcctgttccttgttctggcgtttgcgttcgcgggcgagctggatgcgctgggacacgatggaatcgatctgcatggaatcgccgatcacgaccgggcgtgcgtatgccttaccgtccttctggctgatgaaggcgtcgggatcgcccatgcggccggtcgccaccacggcgtcaccctggcggaaatccatgccgtgcaggagctcggcagcctggccccagaatttcacggtggttctcaccgggccgagcggattgtccgtatagctgccgtccttctgacggactcgcgggcggtcctcatacacggtggcgcgcaggtacgccgagctcgtggtgccgtccgcgttggttttcgccggccagtaatcggggttcgcggcgaggagaccgcgaaccacttgcattgactgtggcatgatgatggtcctttcattcggggaataccagcgccttcaatggcggcggcgactcccatcatccggccggaccggtggcatcgcggggtacggcgtctacgtcagcgccccaaatgcccgccgttctcccacacgttcgccgcctccgtggcgggatcggtttccggcagacggtcgagcacgcttgacgcgaaccggtccgaggcgtcgtagccgatggcctgttcggcgagttcccgcgccttctcaccgtcgcccatggcgaggctgagcatggccttcaggccgatgatccggtagcaggcgtccgtcggcgcgttggcctccaacgggccgaggatccccatcgccatgtcgatgcgcgccggatcgggcgtggtgccgttgtcgatcagccgggaaaacagcaggtcggtgttcaccatgccgtccggcgtattgatgcgttcgcgcaatgccggaagggataggggagcgttctcggccagtatgtcgctggcgatcatcatgcatgttgattcgggcgcgaactgcatcatcacgcccaatacggcgagccggttcgcgtcggacgaccattcgcccgtggagcgtggttcggccatgagcttcgaccagtcgtaggcggcggcgttgcgccaggtggtgcgcacatgttccgagaatccgtcgtaggtcatgcctgagtccagatattcgtgtgtggctgcggtgatcagctcgtccaacggcggttcgtccgtatcggcggctgtggcctcgctctccacgatgaacgggatgcggggttcttcggaggccaggccgtccgtttcttccggctgctccccgttgatgcggtccgcttccatgcggtccacttcgccggcgaaccattcggagcccgcgaaataggtgccgtccatcgaggagagcaccggctggaggatggatgccagttcgtcgtacacggcatcggggttccgcaacgcctcgatggtttcagtcgccgcgttgtattcgatgatgcggttcgccagccgcatggcaccgtcatcgggtcgcacgtcgtcatacgattcgccccaatgctcgatccatccgatcatcgtttcccgtgtgatccgctcttcggcatcggtgttctccaaaggcatgttcggctccttgacaatcctcggcggcaacccgctgttcccgccatgaccccgatcatcagtccaaggccatggcggggtggggcatggcgtctacagggttcttacaggtttcgtcccgtgcggccggtcaggtcgtccacgaggccgaggagttccggttcgggccagatggagttggcgaaaaggtagtcgtccgtcaggggccggtccttgaatatggttcgcgcgtcctcccggatcgaggccagcgagccgtcggcgatcatgccggtgaggtcctgtgtgcagtacaggtcgtatggcgtgaaccctttgccgttccaatcgatgtgatgggtgatcgaatactcgtattcgttccagtgctccatccatggaagggcgtggtcgccttcacgggtgacgaccgagtagcggaaccagccctcgggaacctgtatggcatcgtcgtcatacgggtccgtcagggaatcgaggtagccggcgacgatggattcgccggcatggaattccgtgtaccatgcgaggtcgggattgcgcagcgcggcgtgcagcgagtcgagcagtgcggcgtcgttcatcgtggtcctttcaccggttttccgtttccggcaggatgccggtgttgtcgtatattctgaacgtttcgacggcgtgcgcgacccgcgccctcgattcgccataggtggcggaatcgaccgtctcacgccatacgggttcacgggtttccgcattgccgtacggcttgggctcggtgggggttatcgacatttcgaagtcccatgaggatgcgccgtgctcggcggggcggaagtcgagagtgctgcggttgcccgtcagccgcagcagccgggatcgctcgccgagccggtcgaagagggatgcggagcgtgccacggcgcggatcatgcgtttcatgccggtggcgaggtggtctgtcatcgcagggttcccttctaggcgtgccatttgaggttcgtatcgttgaacccgcttttttcgagcgggcacatctccacgttgatggggattccgggcagtcctcccaatttgatcaggaaacggcccagacccttgtgcgaggcatcggaaccgaagttgaccggggtggcccaatcctccagcatgtcctcctcgcgccgggatacgggcagtccgcattcgccgcgcaggtagcggtccacctcgatgcggctcaaagcgcccagcaccttgatctcgctgcgttccacgaagccgcgcgccttggtgttctgcgccggggtctccatgcacatcaggtccttgaacgtgtgcgtgatcatgatctggcctacgccccactgcctgttcagacgggtgagcaggtcgagcttttcgaccatgagggggctggcgcgcaaagcgcggtgcatctcgtccatgatgatcacgtggttgcgccggggctgcaatccctcctcggcgagcacgtcggcggcgttcttcgcggcgaacgcgctcgtccatgtggtcgccagcacggcggcgaccacatcgtcgcccgactgggccagggcgctgatatcgaagtccacgggcctggacaggtcgatgcgcgcggtggtctggtcgccgaacagacggccgaacttcgtcatgcggttcgagaacccgtgcaggtcggccagaaggccgcgaacctgcgccctgtagagctcgtcgttttccgggtcgtcccagaccgccgccatacgcacctcgtcgggcccttccctcagcaggtctcgcaggtccgcgatgacgggaggctgcggatcgccgccatgccggtcgtggagcacgcgcacggccacggaaaggatatcggattcgcgtgcggtcacgcccctggcaccgcccacgtcgtcggcctcgcggccggtgcgcatgatcgtcaaaagcacctccatgagcgccgccctcgtgtcgttgtagtagtccgtcaggtccttgcgcgccttgccctccaagcgttgcagcgcataatggaggtcgccggggtccaggggattgaccacgccgatgcccgctcccagccggatgacctggccgccgagcatgttgaccagtgaggcgtagtcgggcttcagatcgccggggatgatcgcgttcatgcccagggcgctcagtcccagcacctcgcggcgcacgaacgtgctcttgccgatggccggcaggccgagcaggaacatagagggctgtttgatgatgccggccttgaaccagctgatcgggtcgcagcacacgccggcacccgtcatcaggcttcgcccgaccggcaccccctcggccggcagggccatgtcggtgccgaacggccagaacccgccgcacacctggttcgacgtgccgaagaactcgtctatcgtgggcatcagggccgcatagccgcctccacgcgagcgtttcccccgccacggcatcgggggcacgggctcgtccggtttggccttcaacggaccgagcagcatggattccatgcgtgccacggggtccgtggccgtggcgcttggcatggttcccttccgtttcgacggcttccatggcatcggcatcatgtgtcctccgttcaggacaggagccggccgagggggccggctggagtgtatgatctgacgttcaatccaaggggcaggcttgcggcgaatcccgtgtcctgtgccccgtagcaggggcgcaggtcgatcttcgcgccgcctgcggcctgttccacggcgcgtgacgcggcttcgagtcgttggctttcctgttcgcccctggacacggtgacggtgacgagcatcccgaagaacaccatgaccgcaccctggttcgtttcgacggcctggcggttggccttgcctatctggctcatggacctcaccgtggcgcgtttctcctggctgacctggttggctgccttctgccggttctgttcggccatgaacatggtcttgtcgggcggcagcatccggtagagcacggtgacgcgcttgcggtcgcagtccgccaatgggctgagcagtcgggtgagcgtgtcggcggtcacgttgctttgcggcgggtccaccatctcccatgtgcggctcagcccggaatcgtgcgaataatggctccagccggcctcgtgcatgagcggcccgcaatcctcccatgcgatgtacgggggctcgtcggattcctcgatggtctcctgcgcggccggatcgtaggcgacgcggaccatgcgagtgatctcctccatgcccagggccctcgcggcaccgcctcccgcctgcgctatctgctcgcggatcgagggcagcagcaggcttatgcgacgcgcggcctccccggcctccaggtatttgccgtcacggtcggtgtagcggaaagtcaaggtgagcgtcacgtcgttggaagcgccgccggctgcgtactggtccatgatctgcgccatggcgcgcgccgcgagctcgggagcgtcctccacgatgcgtttgctcagcgtgcggcggaaacgcacgccggaatcgggtgccgtgtccacggtcacggccagttgggtgacgccggtctcggaggcgagcgattccatgagcccggcccacgaggccacgtacgagtcctccacgtcgtcgtcggcgaggctcgcgccctgcggctggcatgacaggagcagcgagtattcgccggtgtgcgcgtgcctgaccaggcagaactcacggcccaagccgtccagcgccgaggtcaggaccaccctggagaggatgcccggcagcatggccttgccgccgtcgatcggcgcgagcaggccggaacggtacaggtttgcgccggtacgctgcgcggccatccacgtgcgtttctccacggcgcggtccaccatgttgcggtgctcgcggtccctgatcgccagcacgaggatgacgcccatgccgaccacgaggatcgcgatggccgcgaccacgctcgccatgctgaccagcagcgtgcaggtcaatacgcccatgcccgctatcgtcaacggtatgccgatgttgcggatgcctcccggcatcggccgcatccaatccccgtatgtcgtgttcgacgccatgattatccgaatctccttaatgcgtcagaatgtcttgcctttgcgcgtggaggaacggtccgcgccgtccggtgcgccctcgcgggcgaacccgccggcatcgttcgttccctgcggcctgttgccgcctgacgggtcgggtggcgcgccatcgggtgccggtggaaccgggcttcccgtgccattgccgttcgttccctgcggtttgccgccgttgcccttgcggttcgctccctgtggctggtcgccggtgttctgtggttcgccgcccgtgggattgccttccagcggcttggcgtgcttgccgccgccgttcgttccctgtggtttgccgtcgccccggccgagtccggaaagcagtccggccaaacctcggccggcaccgggtttggcaccgtccggtgacgcttcgccgccaccgctgtcgccgcctttcctgccgcccttgccgcccatggccttgcgcaggccgccgccggccacggcgactcccatgccgagtatggagggcaggattccgccgccgccaccgccgaccgaggattgcacggcgggcacgatcacgcggatcatggcgggaaggaggatgatgacgctcagggtgagcatcagcgtgatggcctggctgtcgtcgccgggcccggccgtggccatgatcgccgagccggtcgccatgaccagtgcggcgacgggcttgtaggccaggaacgcggccagccagccgatggtcttggcgaaagcctgcttgccggtctccatccagctcatggcggcccacatgggtgccacgcccaccaggatcggcagcatcccggcgcggaagtaggcgaatatcttgctgatcagcccgcagatccacatcacgatggtgagcacgatggcgacgggcgcgccgagattgaagaacgagctcgcggccaggcttttcgattcccaggcgtcgttcatcatgccgcttgcggacctgagcacgtcggcggtccacgtgtcgaatgtggcctggaacgtgttgaccagtccggcaaggcacacggcgctcaggatcgcccacatgaacgccttgcccaacgggatcaggtcacgtccctcctgttgggtgacgagcttccagccggccgcgatcacgccgcacacggccgcgatgataaggaacgggtcaacctgcatacggatgtagtccgacaggaagaacgtggtgccgccgcccggcgtccatgacggcaggtccggattgccgccggacgagcgggagaagaacgtgagcgcgatgctcgcgcacgaggagccgagcagcacgccgagcagtatccagccgatgcggtcgagcagacggccctcgccgccctggccgatgttccacacgatgcgcgcgctcagcacgatcaggctgatcgcggcggctgcgacgagcacgccctgcgcgatgcgcaggtaccggttcaccggtgcgaaccatgaatcgtagttcggcgtggcgttcgcctgcaacgttgataccgtgtcgttcgcggcgaccagcgtgttgcggctggtggacagccattcgatcgtggaatccgattggacctggtacatgttccacagggtcttctccagccaggagagcttgcgctgcttccggcacgaggagtccttgtactcccatttgccctcgtcggacgactcctcctgatacgtgttctccaatgccctgcattgcagttccggagacttcctcagcagatccttcgccgccttcttggtgccgaccgcgaccacgccggtatgggcgggcgggtcgccgtactggtcgatgacccattggatctggctggggccgatcaggtcgccgagcttgccttcgggtatcttcatcacgtaggtggtctgggtgtcgctgatctgcttgtcgccgaacgtgagctccttgctgaacgatccgaagtcgggtccgccgcaggcggcgaggcccatgaggcaggcgagggcgagcggcagcgcgcacaggcgctgccgtatgcgtcgaatccctttcatggctttttctcagcagcttgcggtgacggacaggccgagtgcggcgaggatggcgacagcgcccgcaccgaggaagatgccgatcacccagttgacgagcttgtcgaaggtgtcgtcgcggtctggcacgccgtcgccctgctggcgcaggatgtgcacgccgatgcgcaccagcgcgaccacgccgatcaccaggctcagcgccttcacccagcccagggcggtggataccgggcccgagaatcccggaggcaggcacggggtcgggtcggaaagggtctcggcgaggatcacgcatgtttcatgcagcattgggttgttcctttcgtgttaggttcatgcaccatcgtcagccgacatgggccgtggcgcggggcatggcgtctacgtccttcacgagccgtgagtacgcggccggataacgccggggaaacccgtcgagttcaagccctttgatatggggcagccgccacacgcggacggcggatgacagttggatgcgcgccgccaccaaaggccggggcatacggggcacggggtcggtgatggccgcgcccaacaggatcgatgcgccgaacagtccggccgactggtcggcgagcagcgcgcgcaacgattcgaggccgcgccccgtgcccatggcgcacaggatgatgcgcgagggcatggagggatcctggctcaccggcagcgcgcggccggcgtcggcgaaccgttccggatccgaatggcggatcgtggtgcatccggcaccgccgtgcgcgcccaccagccacacgcggtcggtgacgggtgccgcgaacgacgggatcaacgtggtcagttgtggcatggtgttggtcctttcataggctcgggtcggtgccgggcagttgcgaggggtccgggttcgcgggcaccgaccagcccggagacgcggaaccaccggtcgagccggcggaaccgccggaggaatggtatccgccgccggacgggccggaacccgagcccgaagcggagccggagggcgtgtacgagtactgttgcggtgccggcgtgctctgcgcctgcgccgccgcagccgctgcggcctcctcctgcgctttcctttcctcgtcggccttggtcttcgcgtcgatggaggcgttcaccttgtccatggcgtcggtgatggccttctcgtcgcgcttgtcgatggaggcgcgcagcagggcgcgagaatattcgtcctgcaccttgccttcggaggaggaatacaatcgttcgccctgttcgacggtatgggccagccgtgaggagaacaccgcgcccgccgccttcttcagccgcgagagatttcccgtgtgcttcttttcgatggcttgcagcttggatgtggtggcgttggccgtttccgtgtccgtggcggcacatgcggggattcgctcgccctcggaatattgttcggccagcttgtcgagggtttccagggtttccgggtcggcgagcttgtcggccgtgaccgctttcgcctgtgcgagccggtcgccgtcgagatattcgaccagcttctgttcggctttcttcgccgcagcgtgggcggtggcgcagtccgccgtcgcctgttccagctcgcgtgcggccgtggcggattcatgcgatctccacgcggacatgccggcgaccgtgacgcaggccgcgagcaggatgccgcccgcggtcgtggctatgcgcctccattcgcgcacgggcatggcggcatcccggtcgccgaccggcgtgaggtcgatcgtgtcggcgagatcggccggctccacggcaccgacaacgtgctgcggttccgatgccggggcatcggccgggatatcattccccaccggattcgaggccgatggcagcgggccgatctcccacggatcgacggccgtgttcgcccggtcttcgcttccggcgtcgtccacgcatcgcgcatccggctccagcccgggcccgggctcgggttcgggttcggccggtggccggcgttccggttccggttctcgtgccgtgtcgatggcgacggcggtgccggcggcgattatggggcccatctcccatgggtccgtgctggaggtgttcatcggttcgggaagaggcgctggcgaaggctcgggcggtccggcgcggtggcggccatgccgtcggcggcgtcggcctgccgttcgcgcagctgccgccgttccatgacccatgcgggatgctggccgtgctcgtgcgcgtccatgaggcagcgcgtgacctcgccctcgggcgaaaccgccgcgagccggcccagatggccggtgaacgcggcctcgggatcgccctgcatgaagctcatgtacgcggccgcctcaagcatgccctcccttcgcgcggaatccgggatgctgttggacagccgccacagcagtgcgggtatgtcctggtggaactcgctgttggcgatctcgcgcacgttgtagtcggcctggtaccacggtttgacctggcccgaggcgaacaggggcaaggcgcgcggatcatgctcggcgaccatgaggaaacgggcgcgctccaggcccggcgatatcagcttcgcgcacacggcgtcgcgcagccccgtgtcgccggacagcgacgccagcagtcccgccgtggcatggtccttttccgcgtccgcgccgatgcggtattgtccggcgcgcagcgagtcgagaaaatcgaatacggccaatgcggtttgcctgtcagccatgtgcaacctccagaggaatgatgatggtgcgaacaatgtcagagtcgatgatgcgccgggtcgcgggccgctgcggggcgcaccgtctacaggccccatcgggagcacggttccacgggtctgcggctccacggttccacgggttcacgggttccgggcatggaaaaggcccttcgccgggggagaggctggcgaagggcctgggggttcacacgccgtccggggcacgggattcggaaagctttatgcccctttccggcatgtgaagtcaatggagggcgtcccggccgtcatcggacgacgaggccggaacgccacggggtcacttgcccgcgttcacggccgtgtggcggccggaaccctgtgcgtagtggcgcttgcggaacacgagcagggagccgcccgcgagcagcaccgccagagcgccgccggcaaggccgagcacggccgtgccggtggaggccaacggcttggcacggtagccgttccagtcgtcggtgttgctggcggtctgggtgtcggcgcacagctgcttgccgtcgatctcggtcacgtcgccggtggagtattccggatcggtgtcttcgccgccgtcggtcttgtcgttgaacgggtcgccgttggacggcgcgcattccacgagcggggttccggtgacgatggcgcggtccgtgtgggtctcgccttccttgacgcccttgagcgtgccggtcacgctgaccgattcgcccggcttgagcaccagggtgtcccagtcggcgggataggtgagcgaatccatgtccacgtgcgcgtcgccgacgatggtggagtcgtcgaggttcaggtcgcttgccttgaaccatgcgccgtcgccggtggccgggtcggtcttggaggtgttggtgatgatgaacgtgatgccgatgttgtcggcgtccatcttcagcgcctgcttcgggtcgtcgcggtccgcctgctcctggccgtcctgcttgagggtcggggtatcgaccttttcgaggtggatgctcggggtcatgtccggggtcttggtgacgaccttgttggattcgcgcggctggccgttgatggtctcggtccacgtgttgggcacctcgtcggccacggcgatgcgcttgcactggaggtagagcacccagccggcctcgtgctcgttgtcggcgctcacgaggtcgaggtaggcctgggtcgcgtcggccgtgaccttgccgttctcgtcggcgtccacggtgaacaggttgccgccgaacttcgaggagtcgaagccgctgcccgcgatcttctcgcccttggccgcgagcatctggccgtccctgtacaggtcgcggctggcgtagacggcccagttgcccaggtactggtcgtactcggtgttcagctggtccgtgccgccccagtccgtgacggtctggtaggcgcggtccgggggcaggatgctggaatccaggcggtagaggaacgtgtggttcagatacacgctcttgccgtcgatgctgtcgccgccgacctgcacggtcacgtccttcttcgggttgatctccttcagcgggttggtgacggtgttggtcttgtcgcgcttgtcgttcgtgacctgcgtggcggtgttctccaccgtgtggccgtccttgaccttggtgacggtcatcggcatgaccacctggtaggtgtggcccagcagcgactggtcgatgctcgggtccttcagcgggtcgtaatccttgtcggttttctcgctgtaggccttcaggtcgtcgggttgcgggtcgccgggaacggtctcgccggtcgcggggatctgggtgtccacggttttggcgaaggcgtagagcaccccgtccttgtcctggatgttgaactcgccggtgcggtccctgccggtctcgtcaaggatctccacgtgcttcgcgtcgagggtcaggtactcctggtcgtagtcgtccgtcatgcccagtcgccataccttgtaggcggtgtcggtgagcctggaggcgtcgatgttgacgcggtagtacaccttgtcgcccagcagcgcggtcttgccgtcgatgttgatggtcgggtccttctgcgtgtcctgcttggagggcttgatgaccggcggctcgttctcgaccttgttggacggggtgacgccgttgttgacggtcagcgcggccttgttgtcgacggtcttgtcggtgggcgcgtcctcgttcaccttggcctcgaagcgcagcagcacgcgcgggttggagccggccttccagttggcggcaacccagtccttggtgaacgtggcctcgaacgagtggttggcttcgtcccactgcaccttgtaggcgctcttcgggatgatgccgccggttcccaggtcggtgatctccagggtctgcttgttcgcggtggtgtactcggaataggtgtcgctcagcttgatggcggtcaccgaatatgcctggtccgcggggatctgcgggtccacgcgcacggtgtattccacggtctggccggggaacacggtcttggtgtcgatgctggactggtcgccgccctgggaggattcggcgatgacctgcttgtggatcgggggcacggtcacgcagatcttcggcgtgttggtgtccaccgtgctgccgccgaccgtctggccgcccttgttgtcgaggtcgtcgcccttcgggtccgcgcacgtgttgagctcgtcgccctccgccttgccgtaggattcgagcagcttcacggtgtcgaagttcacgtcgaaggggatcacgacgctgatctgcttcgcggtcttcaggtccttctgcgcggcctcgtaggagtccttcgcgctgaccgtgaccttggtgccctcggcggtgatgtcgaactggtcggtcacgtccctgccggtcttgttcaggtcgttgacgctggcgttggcctcgtcggtggtgtcctgctcgtagaccttgatgttggaggtgtccttcaggtcgaggatgctatcgacgttggcgaagtcgtcggtccacgcgatctcgggcacgcggcccaatcctgtgggcagggtgccggagatgaccgccgccacctcgtcgccgagacggtagtacttgtcgtcgccgcccaccttgtcgcttttggtcggatcgacggtcagctgccacttgccgtcaaccttcatggcccacgccttgttggggttgggcgtccacacgaacaccggcggctcgttggtcggtcgggtctcgttgttccacttctcgtacgccttgttggtcagctggatcttcttgccctcggtggcaccctttttgatggtgcccgtcaggtagaacctgaccttgctcgcgctgttcctgaacatcgtcttcgcgatgtaggcggacttcgcggtggcggtcgcggtcccggccttccggtcgatcgcgatggtgaagttcgcggtctcgtccttgccgtcgacgaacaccttgccggacttccagtcgatccactggttcgaaccggtcagatcatcggtgatggaataggatgccagcgggttgagcaggtgcgcggggatgctgccgttgaccacgacgcccacctggtcgcccacgaggaacgtcttctgatcgacgccctgctggttggtccattgcttgtcctcggccacgagagcgccggactcgtccagcacccacaccttgtccggggtcggcgtgaccttgcccacgctgtcgttgttgccggtctggcagtcggccaggctgccggtgccgttgtctccgttccagcacgccacggaaccgtcgttgatcttgtagtcgccgccggtgggtttggccgactgtggcacgttcagcgtgtagaggccggaatgcggggcggtggcgtgcgccttgaccacgcgcttgccatcgatggaatcgtcgatggaaatgtccgccggcacgatgttgccgttcgcgtcggtcacggtcaccttgctcacgtcgtcctgctcggtgccgccgatcaccacgtccctggtgtcgatcgtgtcgtagatccagaacttgccggaggcgttggaatgcgccttgatgtgcgccgtgtacagcgagccggaggcgatggagtcgttgccgtcccgcaccgtgtcgccggcctcgttggtcagccatttctcgggcggggtggtggtcttctcgccggactccttgccgtcgttctctcccttgtgggagaccgcctcggccatgttgccctgcttcgccacgtcaacgtcccaccagcgcttgcccgcaggccacgactcccacgaggcgtccatgtccttgaaggacgcgctcactgtggcgctgcccttgttggatgcggtgaaccgcttcgccaccgtcttctcggtgccgtcgatgccacgccagtgcagggtcgcggtgccgttcacgttctcggtcttcgacccgtcgctggacagggtgatcgtgtccgaagcgtccttggtgtcgcccgactggcccgacatctccgcagcctgcgtgctcacgctcaagtgatagttcggctgcaccggctcgtattggttcaacatgatgacgatcgcaaccgggctgttattccactgggaggccgcgatcgagtccaccgaacgctcaggagcatcagagaaaccgtcattagtgtcataagacgcaccattattgtggtatttaaccggtgcgatgtttttgttccatgcgtcgctccaataggaggcggtggcgaagccttcgccggaataggagtgcgtggtgggcgtggcgaccacgccgacggcgaccatgcggcagttcgcggtctcgcccggatgcttgtcgttgaaacgggccacgcattcattgttggccatcgtgatcgcggtgttcgccttctcatcggccccgccgttgtagttgttataggtcgcgcccatcttcgccacggccttcttgaacgcgtcaagggtagcgccgccgaaaccgccgttgttgttgtcctcataggcccagccgatcaccgagccgccgacactgccagccgagccgggagcccagccgccgccgccgtcggccatcgcggtggccgcgaccatgccgccgcctgccagcgtcgccaccgcagtcaaagcggccactgccacgcgcagccccttcccgttgcgggcatcagcccgtttcctctcgttgaaaaccatagggtttcctcctgttagattcttgtttccgaccggcctaaaagccggtagccggagtccggaaaacttcggccacaaaccattagaaccccatttcggccggtccagtttggacattttttccgatcagttacgcgagatattgaccacgaggaggggaaacgcctaaaacgcatgattcggggtatttaccgaaataccgaaaccggtaaaatcggtgcataccgaagcgaatgataaaaaaactcgcccgaacgaatcggacgagtttcatgcctgcatgtcagcaagtcagacgccgcacacgctctccgggcaagttccgcccggagtagcagctccatagccgctgctgtagccgaagctcccgccgtaggaggaaccggcggagccgcctgtggaacctcccgtggtgccgcttccgccaccagtggagcctccgccgtaggggtatgagggtgtccaggattgctggggctgagactgctgatagttgtactgctgttgttgcgtctgggcgttcgcagcggcggcggctttcgcatcggcctcggcctgggccttggctttcgcctcctcgtcggccttctgcttcgccgcgatggaatcgttcaccgccttggatgccttggctatcgcggcctcgtccttggcttcgatggccttggacagttcctcgcgcgtcttgtcatcctgcacgttgccgttgctggactccaacagggttttcgccgtgtcgatggtcttcgccagcttcgagtcgttcaccgcgtccaccgccttcttcaggctcccggcgtgcttctcgtaccatgcggccgcatcgtccagttcgtcgatcgccgtttcaagcccgtccttgccgtcggccacgcagccctcgtattccggcgcttccacgtccagcgcggttttcagcgcgtcgatggtcttcgcgtccttcacctgatcggccttgacctccagcaagtcggccgcgtcgccgttgacgagcgtgttccagtcgttcatcgcgccgcgcgccgcgtcggaggccgtggcgcacgcggccttcgcctcggccagtcggcggtccgaccatattttccatccgatgccgccggccaccacaagcgccagcgcgcacaggcccgcgaccagcggcaccagccacttcggccgaacacgcctcgactcctcgacggcggcggtttctccgttcgtgggcggcggggtgttggtttccgtttcctgttccgttttcattcgtgtcctttcatcgttcgtttcggtatgcaccgattttaccggtttcggtatttcggtcattctctgtcggagccggggttgccggtttccgcgcgttcatgccgccgccggtggcgctctgcaccgttccggttcgggcacctgcttgtttcgcacggcgtctcgcgtcatgcgagataggcttcgagcgcgaggtcgatgacctcctggatgcgcatgtcgtgcgcggcggcgtaggtcttgagccgccgccgcgtttcgggcctcatgctcacgctggtcttggaccattcccccgtctgatcggagcggaagacgtcggccatgccggagacgctgcgggtgcgggctgcgggcctgaaagccatgtcgaggttcctcatgcgcgcgcccccatcgcttcgacgatctcgccgagcacctgggggtactcgtggagcttgtcgggggagtgccccatgccggccttgatgtcctgccgcttgcacacaacggcgtcgaaacggggcgtgccggcctcgtcaagagcggcgacggtcgcctggaaggctcgggtgcggggttcggcgcgcacgatgagcaccgcaccgggcttgccatcgggaatcgcgttcatcgtcgcccacgcctgctgcagatcaatgggcgaatcggaggtgggcacgaccacgaagtcggcggccttgacgctttcctcgaacagccggccctgcggcggcgcgtccaccacagcgaagccgccatgcccggcacgggccagccgctggagcgtgctcaggttcgccggcatcacatcggtgcctgcgggccacccgccgttttcctcggccatgtccctccacaggctcgcgctggactgcggatccgcatcgagcaccgtggccccctcctcgaagcgccgcgcgtatgcggcggcgagatagatggcgcttgtggtcttggcgacgcctcccttggcgtttgcgatggtcacgatcatggttgtttctcctatcggtatttcggtgttggattcgtatcggtattccggtttttcggtattccggtttttcggtattccggtaattctggcgtggtcaaaacaggacgccttggatggccggcggaaccggcgtcgcgtcggtgaagctcggcgcgacagacaggcgttcacgtttgcgacgttgcaggcgcttgcgctgccgccagtcgctggagtccgccagtctggttcggtcggcccagtccggatgcctttcaagccagtcgctcacccgttgcgcgggcatgtcgtgcagctggcgcgccgtgatgccgaggtctcggcagaccagtttcgagagtactgtgcgacgcctgtagtcaagacctcctatgaggttgcggtccttccatccgccgacgagactgtcggcgatgcaggtggttcgcagggggcacgtctcgcacaccctgcgcccgagcgcgcgcttctcggcatcgacgacctcacggcctcccaccgtaatggtcgcccacatgcgatccgcgaggtccgggtcttgccgcgcgatcttcgcgcagggagcctgggccgtcatgatcccgccctcgccccggcgaacatgtgcccgccgttcgccttgcgtatgtcggagagccggcgctccatctcctcgcatcttgagcagcttgaccggtttccgatagtccgtgagggtcgatgccagcatgttcctcgtggtcatcggcttgttgatctccatgattcctcctcggcgggcgcggcgacggtgaaccggctgacgaccttcaccccgaagggcagtgggcggccggccgatagggccttgtgcgcccacagggtcgccgcgccggacgggtcggcgtcgcgcgccgtcacggtatggcccagtcgggcgagtgcttcggcggtgccgatggcgctggtgttcttgccgaccccgcccttgaggttgacgaaggccaccgttttcgtgttcgtggtcattgggatcgttcctttcattcgggtttccggcttcccgtgtccacgggtgcacggttccacggtttgccgcgtatacgggtttccggaatggttcgtccttatggggccggaccggttatctgtatcggattgtcttcagaagagggtgtcctgcaagggcggggtgtgtgtggcggcggccggggccttcgccttgccggtcgagcgtgtggtggcgcgccatcgttgctggcgtgcgttgcgctgctcggtcttgcggcgcttgcattcgcgttcgcgtgccgccgccacgatctcggggtttgcgcggatgtaccgggcgagccgccgttcggcggtcgggtcgtcggggtcgaaccggaatccggcctcccgcgcggtcttcagcacctggcgtcgggccctcaacggcagtccgccgtagatgccgtactggtcccggaccatgatgccgaacgcgaggcattcggccctgaccgggcaggcctcgcagatccgcaccgccgcgcggcgcagctcgtattgggttcgctggttgggcaggtcgtcgggcccccacatgcggtccgaccacgagtcggggaaatccgcgcattctcccttcaggaacatgccggcacctccttcggcccacggccgccgatgaaaccgacacgtccggatgccggcccggtctcggccggcttccgctgccgaccgtcgtcctcctccctggataccgcgtccaggaaggcgcggcccgcccgcaatgcctccagcacggcattgcgttcgccttctgcgtcgttcgcggggacgcgcttcaacagccggcgcagggtgcgcggtgcctcgaacccgtcattgcccgcatcgaagtcgtaagggtcgagcagtttccacacgcgccggtccaggttgtcggggatcccgtagttcggcaccttcggcgtggattccgcgctcggcggctgcgccgtttcgcccttgtcggcgaggatgccgtgttcggcgagcaggcgacgcccgtgggggtcgtcggccatctggaggcatacctggtcccagtgccgtgcgagggagcgggggccggtgagcgtgcgacgccagaaaccgtcatacggtttgccggaagcgtcgcccttgtcggtcttggaaggcggcagcgacacccattcggccacggccagcaccagtggcatgccgtggcgggcgatcagccgtcgggcggcgtcgagttcgcgtttgccgggccgggccaacggttcgggcaccggcatcggcggcatggcgcgcagcccgtccgccatcgtgcggcacaccgcctccgcgtcggaaccggcctcggcggattcgctgctcgggggttcggctccggcggcgtcggcccatgaaccgtcctcgcggattccgtcatcgtccggggaggtctctccgcttgcggggagatgccccgtaggggcagaggggttattacgtactagggacgtactgtagctcaccaggtgagctgggggtggggtcacagctgtgaaccgtggttcacccgtgagctggggttttcccgtgtccccgtcgccataaccacggtccacatgtgagccggggtttcccctcgccctgttttccgtggaaggccgtccgcctcgggtcgagtcgatgtcgttcgagtcgaagaagtcggggtcgagctccagacggttccccaggcacagatcccacacgacgggccggtgccactcgctgaaatgcccggcctggcgctggtcgccgcgacggatcagcccgttcgcttccagccatgacaggtggcgtttgaccgtgctcacgctgcacttgcaccacgcggccagcttcctgtgcgtcggatgcgcgttgcgcccctcgtcgtcggccacgttcgccagacacatcagcacgcgagcggcaccgttgtgcctggcgtccacgggcgcgaacctgagcgcccaatcgaccgcgttcacgctcatgcggcaccccctcggcgggagtcttgcagacgtgcgcgcagcatgggcacgcgcggcacgggaacgtcgagcatcatcgacaggtagaagtcgtggctgccgtccgacgggcaggccgccaacaggcccgaagcgaacccatggggcgggaagccgccatgacgcgcggcacgctcatgcgtttcatgcgctctcatggctctcctcactcacggaaccggccgactcctcacgccaacgggcctcgagcatgtcgcggcgcgtggccgcgcggcacagggcgaacgtcagcagataggacgcggcgagaatgatgacgacggcgatcacgagtatgaggtgcatcatcggcccgcccccattgatcgcgcgagggaggccagcagacggaccgcgagaagcacgatgccgactgccagacgcaggaacggcagcagcaggccgaaacaggccactgcgagcaccacgaacagcaggatcaccaattccaccactcatcacccccgctcaccgaaggatgcctgagcatcgagaacaccgcgtcatcgccgctgagggcctccacgtcgcgcatcaacgcgtcgatctcgtcggacaccatgcccgcaccggccctcgtagccgcggttgaacacgcaatccgacggaccgccatggatcagacgacggttcaccgtccgagccggcgacgaagcgttccgcacgtcacgaagcgcgtcatgccggccgatcagataggcgaccgccatgacctccctcacggtcatcgacgcatccacggacagggacaacagggacatgtagtcccggaaattcgagcgctcctcgttatcgagggaacgcgcgccaacggtcatggtcattgcctcacctccgcgtgaagggaccagaaagcgaaatcccaggcatcgcgcgagttacggtcgcaccagcaacccacacaagccaggccgcaggccaccggcaccaaagcgaatcccggcagaagcagattcctcgcggcaagcagaatcgccagaaaaaccacgcacgacaacgcggccagcatccaggagacaagtcccagcagctcgtagcgccgggcagaacgtcgccaatacaaagattcggaaaatgtagacgccatgtcccgcgaaccattcgcgggggcgttaccatcaaaatcagaagtcggcacagcgacttcggttacactagacatttgtgcagcctccataatctaaaaggcaatgcgaacgattcgaagtttggcgactggggaatcgtccgacattggatgtgttgcatacgcccggtttcgatgtatcagatcgagaccgggcattttcttgaaatgagaaaaaccactaacctcctcttctactgggtccagccatcaagtgattgccttctcgcaagagggcaggttattgatgccaagaacgaaatcagcggaaagtccgtagtggtcataaagaaacagcaagtccttctgctgccagcccaaatgcccgttctctttctgagaaagagtggaagcggattggcccatgtcggcagcaagggcagcctgagtcacatcgtgatccttcctccactgtttcatcggagaagccatatctactcttttcctaaagtctttagcctaactaatgtttttagaatacactttggtttgactaaagtcaaatcgcaaactagagtatcttaatgagataaaggtttattgatagaataggattagaatatgcgtacattattatccgcagatcaggcgaatcaggcaccccccgataccttgggcgaatacacagaacgtgtgctcaactacaatgtggacgcccggcgcaagcagctgaagcgaacccagaaatcactgatgcagccgatgggggttacaagcgaaggggctgtatctcaacgactcaaaggcattactcattggtctctgattagcgcggtcaatgttgcccagagcctcgatacaagtattgaaaaactacttgatgacagtgccatgaagatggagatcgaacgccaagcggtcgcactgcgcgttcaactggatcaaataaatcagatgacgggaaacaagaaagccaccgacgacacgccggtggcttcaggtgagctcctgcggctgggcttgaaccagcgaccgtccgattaacagtcggatgctctgccaactgagctacgcaggaatgtctgctgtgtttgagatttctctcgcgcacaagtcacatatcttacatgcctgccacgaaaaagcaaattacatgcgtgtagggcatgtcgcgctgaattccgcagaatcggactcatcggatactatctcatacagccaaaaaccgaacgcggatatacactagcgactaacggtagaggagctggtgtctgcttggcaaatactggaatcggtgaaacggaacaaccgtctgagtatgcgaacccagtgggaacaatcacaagagttctgatgttccgctgtcactgcatggcagcggttgtgacatggatcggccgcggctgaaggtcgaacaacatgacgatgcggcgatactgtcacgcgaaatttcattgtggataacttcggaagctagaaccacataggtcgttttggctggacatcctgtttcggacccctcaaggtgggtatcaccggcaaagaagccggaatcacatcacactcacactatggggaggaatctcatgaatgcaccactgttgtttgattggcgtcgcgacgaagcccgacgtgccagccggcggcgtcagcaggcgcgtcagcgggctcaggaacggcaacggcgtatggatgccataatcgcgttggccgccgttatcggcctgctgcttgccttgggagtagggctggcatccacgcctcagcatgttgcgcatgcggatactgcggtgaccggagatgcggcatacacggtggaggatttcaccgatatgtctgatttggcgtggcgcaatggcaatcagtgcgaatcccgattcgactggccggtcgacgatccacaggtcgaacaacagttcgagcggccgatcaacccgtgggcaccaggtcatcgtggagtggatcttgttgcggagcaaggtaccgtaattctgtcaccacaggcagggaccgtgagttttgctggcaaagtagctggcaaagatgtggtgagtgtacggcatcgtggaggtgtcacgtcgacattcgaaccggccgttaccgagctctcagtgggggatacgatctcccgcagacagcccgtaggcatcgttgaaggcagctcggaccattgcgaagaccgttgcctgcattggggcctcaagcgaggaacggccgattatcttgatccacagcaatatgcggggagtcgaaaaatcgtactgaaaccgtcatgatttaacggtgattgtcggccggaacagggccgtacggaagagacatcgcaggcggctagcggcgtgacgagtatgaatcacagaccggcatcggccaaggaaatatatccggggtcgatcagcgcggacttgagattgctggcgctgacagccagcaacggttcgctgatggtcgggatcttcttcacgccgcctacctcggagttcctgattgaaggcatggaattcagcgcttcgtccttgttgagcttggcgcaggcctgagcgatatccgtggcgatggtctgtctgtcttccatgccggtcatccattgcttgccattgacgatggatgggatgttcgagacatacgcgccgtatccggttactagaggccactgcgagtcacggtccttgtcggaagcggaggtgtcctcgtccgcatcgtcatcggaactggatgagtcgtttgcgttgtcgttttcaggggatttgatcgggtccggcacggcgtcgcggctgagatccttcttgccggtgatattgccgacaatgcccgagatggtgatctgcggattgatatcggcggcagagccggtgtatcccagatcgtccaattccttgacgacctcggaggcgatgtagtcgttcatcgtgatgatgccgtcaatacgggtgagtgtggactgtccgtcggtttttgccagacgcttgtcaagcactttcgcagtggagccttccttagcggcatcgtaggccacggcttgccaatcgttttccgtggatttgccgtccaaggtgcctgaagggctttccacaacgcccttctgatagtaggagcccagtacctgccagataccacggaacgcctcttgggcgaacgtggaatcgttggcgttgcctttttcgtccacggcggtgtatggcagcagcacctcaatgtatttggggttgtctttactggccttatccaacttgagtttggacaccatcttttccgcctgtagcttgccgatggtctgggcgtccgagaacttgacgaaggcgtccggcttatatccctcgatactgttgccgagcaataccacatgcatgccggattccttggccagcttgagcgatgagaccagccggtccacggcctgcgcctgctcgtccgatgcagtgctgtcgctctcagtgttggacgaatcgtctttggacgagtcgtcttcggaagattcaccgtcagaagtagcttccccatccgtggcatcgttggtgctcaggttctggctcacgtaatcgccgtattggcgagtggaagcgtcggcctcgactactggagccacgagcaatgtcatgttgtcgggcgcgatggcaatgccggaatcgtccgtggtgttattcgaaagatgatcgaccacaaagtcttggatggcgcggctttgcttggccaacgagtcggacgtcgtatgatcgatatcgcctttcttgaaaccggcgtcggccagagccttggctaggtcaggcaccagcttcgcccatttgttcagtggcgtctgctggttcagcgtaatgccgtccgaaggtgtgaacacggccacgccgccggcagaattggacgtcaccgtggtttgaccatctacaacggtcttattgtctgaggtgcacgcggtcagtgacagcaccatcgcgcaggatgcgataatggcggcgagcagggtggttgagcggcgtgcgaacaccataagcggcgaaacctcctcaagcgggcgtgaaaacaagctgaatcacgattctagtaggccgtatacgaaaaagtcccggaccagtggacaaatcgccacatatccgggaacaattagaggtattacgtgcgtgcatcgaacaactgtcatgattatcgtgctgaggaacattccagatgaagcacgacaatcatgacagtttgcgacatgacatgacccatgtaggtccgcacgatgtgttcgatgatttactcggccagagccttggccaggttctcgtccagcgcgttcatgaagccgtcggtgtcgagccacggttcgtccgggccgatgagcatggccagatccttggtcatctgaccgccttcaacggtgtcgacgatgaccttctccagcgtcttggcgaagtgacggacttcgggcgtgccgtccagatcggcgcggtgcttaaggccgccggtccacgcgaagatggatgcgattgggttggtggaggtcttctcgcccttctgccagcggcggtagtgacgggtcacggtgccgtgcgccgcttcggcctcgacggtctggccgtccggggtcatgagcacggaggtcatgaggcccagcgaaccgaagccctgggccacggagtcggactgcacatcgccatcgtagttcttgcaggcccagatgtaaccgccgtgccacttcagggagctggccaccatgtcgtcgatcaggcggtgctcgtaagtcaggccggcctcggcgtacctgtccttgtattcggtctcgaacacctcggcaaagatgtccttgaactggccgtcgtaggccttcaaaatcgtgttcttggtggacaagtacaccgggtaatgacgcatcaggccgtagttgaagcaggcgcgagcgaaaccgcggatcgaatcgttgacgttgtactgcacctgggccacgccgccgtcttcgccgtagttgtagaccacgtgctgaatcggctcggagccatcgtccggagtgaaggtgacggtcagctggccggctcccggaaccttgaaatcggtggccttgtactggtcgccgaatgcgtgacgggctacgacgatcggcttggtccagccgggcaccagacgaggcacgttgctcatcacaatcggctcgcggaagatcgtgccgcccaggatgttgcggatggtgccgttgggggacttccacatcttcttgagaccgaattccttgactcgggcctcatcgggggtgatggtggcgcacttgacaccgacatggtgcttctggatggcgtgggcggcgtcgatggtcacctggtcatcggtctcgtcgcggcgctcgatgcccagatcgtagtagtcgaggttcacgtcgaggtacggcaggatcagacgatccttgatgtccttccagatcacgcgggtcatctcgtcgccgtcgagttcgacgacagtgccttcgaccttgattttggccatgcttcctcctgatagatggtgtgaagatgatttagtcatagcgcatgtttgtaacgacttgaagcaatcgtccggtccgtgggaaacggccttgttggcgtcccacccgggcaataggctggaaaccatgtctcaggaaattgaaatcggtttgggcaaaaaaggccgtctcggctacgcactcgacgatgtggcaatcgtcccctcccgtcgcacccgcgaccccgaggacgtctccacctcttggcagatcgacgcctatgagttcgatgtgccggtgatcggcgcccccatggattcggtgaccagcccggccaccgccatcgccatgggcaagatgggtgcgctcggcgtgctcgatctggaaggtctgtggacccgttacgaggatccgaccccgctgttggacgaaatcgccggactgccggccgatcaggccaccgagcgtatccagcagatctatgccgagccggtcaagccggagctcatcacgcaacgtctgcacgagattcgcgccgccggtgtcaccgtggccggcgcgctctccccgcagcgcacccagcagttctactccaccgtggtggacgcgggcgtggacctgttcgtgatccgcggcactgtggtctccgccgagcacgtctcctccggccaggaaccgctgaacctcaagaagttcatctacgaccttgacgtgcctgtcatcgtcggcggcgcatccaactacaccgctgccctgcacctgatgcgcaccggcgcggccggcgtgctcgtcggcttcggcggcggcgcggtctccgccacccgccagaccatcggcgtgcaggccccgatggccaccgccatcgccgacgtggccgaggcccgccgcgactacatggacgaatccggcggccgctacgtgcaggtcatcgccgacggcggcatgggcgactccggcagcttcgtcaaggccctggccctcggcgccgacgcggtcatgctcggcgcgccgctggcccgcgccaccgaggcccccggcaagggcacccactggggttctgaagcccgccaccagacgctgccgcgtggctaccgcaccacggtcggcacggtcggcccgctcgaacaggtgctgttcggaccgagccaccaggcggacggcaagaccaacttcatcggcgccctcaagcgcgcgatggcctccaccggctacgtcgacgtgaagaacttccagcgttgcggcatggtggtcaacccgtattccgcacgataatcccgattgccccctgaaaatgggggtttgccctccatgcaggaggcttaacttgcccgaaggcgcgctcaagtagtttgacttggcgcgcctttcgtgatgttgtagtacagacgctcgccgatgatggtgagttgcaagggggcttgaagggggtcatcatggagtattcgggatttttccacggcacatatcagtacgggccgttgccgagttatgacggattcatcgttgtggagctgtcggatcgcccggtgcggtatcacatccaacccacattcataggcgggctgaatgcgaaggaatgtcattccatggccatggctgcatgccgcatcgcctgcacatcggcggacgcgatacgtggcaaactcagcgtcgcacatctcaacagagccatgacaaaaccatgcctggaccggctgcaaaccatgcaatacctgctcggcatccacatggtcactcatccggagctcaaagcgaaattctgctatctgcccactgtccccacattgatcgacggcatgatcaccggcaaggacacgctggaaatggcggtattcatgaccatcggccaggaaaatctgcgagtcaacctcaaactgaagtacatcggttctcgatggatgtgcatctatgccgatttgggctgaccagacggccccgcccgcacaccgattcctacgctggtagcggaagacggttctgccgtgtcataggctggttcgcctatagtagtgaccatgcgtgaacatgtagaagaacccagatatgtcaccaccgatgacgacaccgtctactcgctgctgtccaaacgagcagctcgcacgccggatgacatcatcgcggaatggcaggatgacaacacccaccaatggcgcagcgccacagctactgaaatgctgtcccgcgtacgcgaggtggccaagggcctgttgggacttggcgtcaaagccggcaccatggtgctgatttactcgcctacctgctatgagtggggtgtggctgatttcgcttgcgcggcaatcggcgctgtggttgtgcccgtctatgagaccgattccgcccgtcagaccgcgggcatcgtcgaggaagtcgatcccgccatcgcctttgccggcgacttccagcgcgcacagacgcttgagcagatccgtgtcaatcatccgggcatgaaatacgtgttcaatttcaaggccgatggccttgacgctgtcgttgacttcgggcatggcgtatccgatgagacgttggatgcggctatcgctcgtatcaaagccgatgatctgctcaccgtggtctacacctccggttccaccggcaagcccaagggcgcgatgctctccaaccgcaattacacgcacatcgtgcttaacggctacgagattctgcgtggcatgctgtacgacgacaaccgtctgctgctgttcctgccgctggcgcactgcttcgcccgctacatccagtacgtgtgcatcggtggctgcggcgtggtcggatacattcccgacgccaagcgactgctcgccgatatccgcagcttcaagcccacctacctgctgggcgtgccacgtgtgttcgagaaggtgtataacgcggcctcgcagaaggctggtgccggcatccaggggcatatcttcgcccagtcggtcaagcacttcgtcaagtggagcaaggatgagcaggccggtcgcggccattcgttcatcgagcgcatgcgccattcgttctacatggccacggtgggcaaatccattcgttccgctctcggaccgaacctcaaatggctggcctgcggtggtgcgccgctcaacgtggatttggcccactttttcaacggcatgaatgacatcaccttcatccagggttatggcatgaccgaaaccgccgctccgatgctcgtcaattgggaggacgacaacgagatcggttcggtcggcaagcctgggcctggcatgggcgtgcgtcttggcgaagacgatgaaattgagctgaccggcccgaacgtgttccttggctactacaagcagcccgaactcaccgcacagacgatgactgccgacggctggatcaaaaccggcgatctgggtcgtatcgacgaccgcggcttcaccttcattaccggacgcaagaaggacatcatcatcaccgccggcggcaagaacatcagccccgccccgatggaggatgtcatcgacacctgcccgatcgtggctcatgcagtagtagtcggcgacggcaagccgttcgtgtccgcacttatcgagctcgaccccgaaatgctgcattcctggctggaaggtcagggcctcaatgccgacatgacactcgccgaggccagcgacaacgacgcggtgcgcgcctttatccagcagtacatcgaccaggccaacgccaatgtctcccgcgctgagtccgtgcgcaaattcgcggtgctggatgaggaattcagtcaggagcacggcacactcaccccgagcatgaaagtggtgcgtcccaaggtattgcagcgctacgccaccgtcatcgaggaggatctgtacgcgcccaagccatccaacaagccgctgcccgccactgccaagatcatcgacagcacgctggagaccgtcaagaaatcctccgaatcggtcaagcaggcgtccgaacaggtcaaacaggcctcggaacagatgaaaaccagcgtgtctgattcgattgctagcgtgtcggagaagatcaagaagtcgaaggccgaacccgaagagggcgagaccggcgattccgctgacaatgccgctgacaccggcagcaagccggaccagccggctgacgagaagaatgaggagtaacgagaagtggccatccgtgagatcagggtcgtgcccgacccagtcctgcgcaccccctgcgatgagatcaaggaaatcaccccggccgtgcgccgcctggttgacgacctgttggaaaccgtggacgatccgggccgagcgggcctgtccgccaaccagatcggcgtgagcctgagggccttctcctacaacatcgacggcaaggtcggctacgttctgaaccccgtactcgaggagaagtccggcgagcagtatggcgatgaaggttgtctgtccgtgcccggcttgtggtacaagacccgtcgtgccgactacgctcgcgtgcgtggcatcgacttggacggcaacgaggtcgtgctcgagggctccgggctgatgggccgtatgcttcagcacgaatgcgaccacctcgatggccacgtgtatttggatcgcctggaaaaggaagaacgccgcgaagccctgcgctacatgcgcaatcgtcaggcgaagtagtccatactcggctcccactggctggagccgtcgaacgtagtgagactgagggtggttctgccggtaccgcccgtgactcccctcagtcgcctacggcgacagctcccctcagagaggggagcctgtttttttttagtaccggctccgtgctattctcgaaactcgtgtgccacccggcaacggacgcagtcgctggcgtccagagccacccaatattgtcaaccggcacacaacaaattcgcgtcatgctcgcgacggcttgtgtcggtcggctgcacaactcgtgaaaccgggggagcagctgcacgcaggtgcgcatggccaggcaagaaccgacaatgaaaggtagtaataccatggctcagatcactatgagcgatatgctgaaggctggcctgcacttcggccaccagacccgtcgttggaacccgaagatgaagcagttcatcctcacccagcgcaacggcatccacatcatcaacctgttcaagtcgctcgacatgatcgacaaggcgtacgacttcatcaagaccaccgtggctcacaacggcaccgtgctcttcgtcggcaccaagaagcaggctcaggaagctatcgccaaccaggccacccgcgtgaacatgccctacgtctccgagcgttggctcggcggcatgctgaccaacttccagaccgtctccaagcgcgtcaaccgcctcaaggaacttgaggaaatggacttcaccgacgtgcacggttccggcctgaccaagaaggagctcctcctgctcgagcgcgagaaggacaagctcaacaagcagctgggcggtatccgcaacatgaaccgcaccccgtccgcgatgttcgtcgtcgacatcaccaaggaagccctggctgttgaggaagctcacaagctgggtatcccggttgtcgccatcgtcgacaccaacgccgacccggacaccgttgagtacccgatcccggccaacgatgacgccatccgcggcatcgaactgctgaccagcctgatggctgacgccgtcgccgaaggtctgctggagcgctccggcgccaacaaggccgagggtgaagccgccgagcagccgatggccgcttgggagaaggaactcctgaccaacgaggctcctgccgaggcttccgctgaagccgccgctccggctgccgccgagggcgaaaccgccgaggcccccaaggccgagtgatgctctacgatgggaagtgcctgaatgagcgcttcccatcgttcatgggtaagcaaaatttctcaaggagaataatcaatggcagcaattaccgccgcactgatcaagcaggttcgtgaagacaccggcgccggcatgctcgacgtcaagaaggctctgaccgaagccgaaggcgacgtcgcccgcgccaaggaaatcatccgcgccaagggtatcgccgcagccggcaagcgtgaaggccgcaaggctcaggaaggcaccatcgcctccaaggtcgtcgagaccgccaatggcgagaccggctacgccgtcgagctgaactccgagaccgacttcgtggccaagaccccgaagttcgtcgagttcaccgaggaagttctcggctacgccgtggacgccgacgccaactccgctgacgagctgctcgaggccaaggctggcgacaccaccgtcaagctggctgtcgaagaggccgccgccctgttcggtgagcacgtcaaggtcggccagttcgccaagatctccggcgagcacgtcgaagtctacgctcacaagaagtccgccgagatgccgccgagcatcgtcgccatgatcgccaccgacaaggccggcgccgccgtggctcacgaagctgctctgcagatctccgccatgggcgccaagtggctgacccgcgaggacgttccggccgatgtggtcgagtccgagcgtcgcgtggccaccgagaagtccctggccgagggcaagccggagaagatcgttccgaagatcgtcgaaggccgtctcaacgctttcttcaaggaagtcgtgctgcttgagcagccgttcgtcaaggacccgtccaagaccgtcggcgacctgttcaaggaagtcggtggcaacgccaccgcattcgctcgtgtcgaggtcggcaagggcgaagaggagtgagcctaaggcttactccacgcgcttagcgtaatttcaacgaaacgccatccggttattcaataatcggatggcgtttcgctattccaagggtgtcgttgctagggggtgtcgtcgtaaaccgatacgcttgtctacggataatttcgcactttcggttttgagaaaggcacaatatgactgatagcgacaatccgcgcagagttctgctcaagctgtccggcgaagcattcggtggtggcaaggtcggcatcgatacccaggtgattcgtcgcattgccgaggagatcgttccggccgtacaacagggtgtgcaggtggccatcgtggtcggcggcggcaacttcttccgcggtgccgaactgcagcaggccggtatcgatcgttcccgtggcgactacatgggtatgctcggcacggtgatgaactgcctcgctctacaggactttctggagcaggaggggcaggccacccgcgtgcagaccgccatcaccatgggacaggtcgccgagccgtatattccgctcaaggccatccgtcaccttgaaaagggtcgcgtggtgattttcggtgccggtgccggcatgccgtacttctccaccgacacggtttccatccagcgttccctcgaaatccactgcgacgaggtacttatgggtaagaacggcgtcgacggcgtctacaccgccgacccgcgcaaggacgagaacgccaagcgttttgaaaccctgagctacaatcgcgccctcgtggacaatctggccgtcatggacgcctccgcactgtccatggcccgcgacaacaagaagcgcatccgcgtcttcggcctcgaagagccgggcaacgtgacccgcgccctcgtcggcgatgaaatcggcacgctggtctccaccgccgaatcgcgcgtggccgagtaagccgcaaacgcccacaatcgaatcaagcgttcatagacgaacaacactgacgaacaccaacacacaaggagtgaatatgtcttttatcgaccaggccaaggaacagatggccaagaccgtggaaaacaccaaggaaaacttctccggcatccgcaccggtcgcgcaaacccggccctgctcaacggcatcaccgtggactactatggtgcccccaccccgattaaggccgtcgcctccatcggcgttcccgaaccgcgcaccctgtccgtcaccccgtttgacgcttcccaggccggtgccgtcgaaaaggccctgcgcaactccgatctcggcatcagcccgaaccgtgatggcaacgtcatccgtctgaccatgccggaactcaccgaggaacgtcgtaaggaatacgtcaagctcgccaagggcaaggccgaggatggcaaggtcgccgtgcgcaacattcgccgtaagaccaaggaaaccatcgacaaggccgtcaaggacggcgagatgggtgaggacgaaggcgatcgcctgctgaaggatcttgacaaggtcaccaagtccgttaccgacgagatcgatactctgctggagaccaagcagaaggagatcatggaggtctgattcagaccaggtccggagaattatggaacgcaacgaacaaccccatgaagaggccgaggagacgctcgaccagatcaacaagaagaccggccgcaacatgccgcaggccatcgccacaggcgcggcactggtcatccttattgtcgcgtgcctgctgctcagcgtcgacctcttcgtgctgctggtagtcgtgttcatgattctggcgctgtgggagctcagggtggacttcgccaccgtgggcctgcacctcccggtgtttatgctgtggctgtgctcgtccttcaccctcattgccacctactattccccgtaccatctcatcacgatgtcgctgagtatcatcgtgtcgattattctggtcgccatcgcggccagcgcaaaaatcagcgtcggcaaccgcctatctctggcggttgccggcaaactgtccaacacggatgccagcgcgcgcctcgaatcctcgtttaatcatgagggcggggaacagcatcattcccggctcagccatgtggctgtgtccgtgcttaccgtgttgtatattccgttgttggccagctgcgtcatcatctcactgacttttaatgggcatccgattgcacacgccatcatgctggtgttcctacccgccctatccgatacgggcggtttgtttgccggtgcctggctcggcaaacacaagctcagcccgcgcatctcgccgaagaagtccgttgagggccttgtcggctcgatgctcttcgccatggctggcgcatttgccgtattcgcatgcacgtatgatgcctcgaaatgggccactcgttggtgggtgccgatcgtggcgggtattctcatcggtgccgtgggcacgttcggtgatttgtgtgcttccatgctcaagcgcgatatcggtatcaaagacatgggccatctgctcaaggggcacggcggtgtgatggatcgtgtggattccattttgatgagtgcaccgttcacctgcgccttgctgtggatcaccggactgtgattcgcatgtctcgtgcatgaacaatgtggcatcgtgtgtatatcgcacggtgccacatgccatatatggggaaatcatcgttcaatatgcgttcgctatgggctaagacatgggccatctgattcgtatgcggcacgccgtatggtggattttgatattactattgcatgtttgactattttctgatattgagagcgaagcgaacccatcatgaccacacagcatcctgacactccggaaaccggcattactcccggcggcacatcaggtgccttccgtgacgtgctatccaaggaccatgcccgccgtggtaagccgccgctgcactttgtggatatgacgcccgagcagcgcatcgagaaagcggccgaactcggattgccgaagttccgagtcaagcagctcgccaaccattactttggccatttcgatgtgaatgccgccgaattcactgattttccggcagccaagcgcagcgaggccgccgccgcgttcttcccgcagctcatcaccgaggtgacccgccaagtggcggacgaaggcaccaccatcaagaccttgtggaagctgttcgacggctccctcatcgaatcggtgcttatgcgatacccgacccgcaccacgctgtgcatctcctcgcaggtcggctgcggcatggactgcccgttctgcgccaccggcaagcttggcctgacccgtaacatgtccaccggtgaaataatcgaacaggtgcgtgtggccgccaagatgatgcgcgacggcgaagtggccgggggagagggccgcctgagcaacatcgtgttcatgggcatgggcgagccgatgggcaactacaactccgtgctgtccgccgtacgacagatttccgccatgcctcccgaaggcttcggcatttccgcgcgcaacatcaccgtatccacggtgggcgtggtccccggcatcaagaagctcactgccgaaggcattcccgtgcgtctggccgtttccctgcatgcccccagcgacgaactgcgtgacgagctggtgccgatgaacaagcgtttcaataccaagcaggtgttggatgccgcgcacgattattggctggcctccaagcgccgcgtcagtatcgaatacgcgttgatgcgcggcatcaacgaccaggccgagcatgcgcagttgctggccaagaggcttaaccattacggcgacaactgggcccacgtcaacccgattccgctcaaccccatcgagggctcgaagtggaccgcctccaagccggaagacgaacagcggttcctggagatcctgcaccgcgcgggcatcaccgccacactgcgtgacacccgcggtcaggatattgacggcgcctgcggccagctcgctgccaaggagcggtagctacttcagcgcatccttgattgcgcccacgaagtagtccagatcgtcgggcttgcgggacgtgatgagcttgaagccgttggcgtcgtccacgtgcagctgctcgtcgacgtaatggccgcccgcgttctcgatatcagcggcgatatagcggcagggcgcggcggtcttgccagccaccagacccgcgttgaccagcagccacgcgccatggcagatcgcggcgatcggcttaccttcgtgcgcgaactcctgcgccagcgtgatcgcatcctcattgacgcggatacgatccacattgcaggtgccgccgggcaccaccagcaggtcgtagtcggcagcctgcacgtcggacaggcgcgcgtccggggtcagcgtttcaccttcgtagcggtcgtgctgcaccgtctcacacgggtccaaggtagtggcggcaagcgtcaccttggcgccggcggccttgagatcgcgcagcgggcgcgtcagctcggtctcctcgataccccagttgttgacgatgatcagtaccgtgctgttttcgacagccatgccaatctccttgattcggcggacaacttccacgagccattctctcacgccgagcggctgccatgtcggtgctcaatatgatgattctcatattccagaaacaggtgcggcgcatgtaacgggcggtaggtagtctgaaggattgtaatgcaaagccgaacaggggagtgaagcatgtcgttggcggtacgagtcatcccgtgcctggacgttgacgccggtcgcgtggtgaagggtgtgcatttcgagaacctcaaggacgcgggtgacccggtggagctggcggccgaatactaccgtcagggagccgacgagatcaccttcctggatgtgaccgcatccagctcccaccgcaacacgatgattgacgtggtctcctgcaccgccgaacaggtgttcatcccaatgactgtgggcggcggcgtacgcacgcccgaggacgtcgactcgctgctgcgctgcggtgcagacaaggtcggtgtcaacacggcggccatcaacgacccgtcgcttatcagccgtgtggccgatcgtttcggcaaccaggtgctggtgctctccgtggatgcccgccgcgaaaagggtgagcagcatacgcagtccggttttgaggtcaccacgatgggcggccgcaaatccaccggtattgatgccatctggtgggtcaagcgcgccgagcagcttggcgccggcgagattctgcttaactcgatggacgccgacggcaccaaggaaggctttgacctcgagatgattcgcgccgtgcgcaaggaagtcaagattccgatcatcgcctccggcggtgccggcaaggtcgaggacttcccgcccgccatcgaagcaggtgccgacgcggtgctggctgcatccgtgttccattacggcatcctgactatcgccgatgtcaaggcggaactcaagaagcacggctacaccgttcgctaaacgaatacaccttgctcccgctgggcgaacaatccagtgaattgttcgtggcaatgcgctatgcgcacgtcgcacataatccgggagctgtcagcgaagctgactgagggtagtccacaaaaagaagataggtatgacagacactacatacgacaattccactgaactcgatccccgtattgccgcacgcctgaagcgtgacgccaaggggctggtcgccgccgtcatccagcagtacgacacacgcgaggtgctgatggtcggctacatgaacgacgaggcattacgccgtacgctgaccaccggccgcgtgaccttctggtcccggtcccgtcaggaatactggcgcaagggtgatacctccggccatgtgcaatacgtcaagggcgtgtccctggattgcgacggcgacgcactgctcgtcgaagtcgaccaagtcggtgccgcctgccacaccggcaagcgcagctgcttcctcgaaggcggccccctgcccgtggtcgaaggccatcgcccggccgagcagtagaacgggctttcctgactgagggaagccgagcgaccgcgtactatgaaacaagacatcgagttgtaagcaaaggagcgaatatgagcgaatgcagcgtcaaacacctgaagtggggcgccacctggcccagtcgcgaacagttccacgaactggccgacgccggataccgtgtgattccgattgtgcgccgtctgctcgccgactcgctcaccccggtcggcttctacgagcgtctcgccggcggccgatccggcaccttcatcctcgaatcggcggaatacggcggcacgtggagccgttacagttttatcggcgtcaactcgatggcccagctgcgctccaacaacggtcaggccgactggctgggcaaggtcccggtcggcgtgcccgtcaccggtgacgtagtcgaagtcgctcacgccacgttgaagactctgaaggccccgcatgtggaaggcctgccgaacctgaccagcggtctggtcggcacggtcggctgggatgccatccgccactgggaaccgaccctgcgcgccgaagctccggacgagaccggccagcctgagaccgtgcttgccctggccaccgatatcgccgtggtcgaccacgtatccggttcggtatggctcatcgccaatgcggtgaatgtggatgataaatccactcgcgccgacgctgcctacaacgaggccgtcgctcgactcgaccagatgcagcgcgatgccgccaccccggctccggacgagtcccgcgtcaacatcctggacgaaacggtcgcccaacccgagctgcgcttccgcaccgagaagagccactacgagcaggccgtcgaacgagccaagcagtacatcgtcgacggcgacgtgttccaggtggtcatctcccagcgcctcgacatcgattcgcctgctgacccgttcgacgtgtaccgtgtgttgcgcacgctgaacccgagcccgtacatgtatttcatggcgttgaccgacgctcagggccgcgacttcaacgtgatcggctccagcccggaaaccctcatcaaggtggacaacggccacgcgatgaccttcccgattgctggatcccgccctcgcggcgccacccctgaggaagacgagaaattcgccaaggagctgcttgccgatccgaaggaatgcagcgagcacatcatgctcgtcgacctgtctcgcaacgacctgagtaaggtgtgcgtgccgcagtccgtggaagtcgtgcagctcatggacatcaagcgtttcagccacatcatgcacatctgctcgacggtcaccggcaaggtcgacccctcgctgaccgcattcgatgtgttcaagtccgcgttcccggccggcacgctgtctggtgcgcctaagccgcgcgcagtcgaaatcatcgatgagttggaaccggccgaccgcggcatctacggcggcaccgtcggctacttcgatttctccggcaacatggacatggccatcgccatccgcaccgcgttcctgcgcgaccatgaggcgagcgtgcaggccggtgccggcattgtgctcgactccgtgcccgccaccgaatggcaggagacgcgcaacaaggccgaggccagcgtcgaatccatccagatcgccgcccagttgcgcgaactgtaacgttcaacgcatagcgatgcccccgctgacagaagttgtcggcgggggcatcgctgtctgtacgttagtgggtttcgcccatgatgtcggtggcgtcggtttcggtgctcacagcggcttcgatggcagcttcgataccgtgcgccatggtcgcgatcaccataccgggcgtcgcattcttcaccttgccgatcagttgcgcggctgcgtatggacgcatgagcgtcggctgagcccggtcggcatggtgttcgctatgatggacagtcggactttggtaagagacagtattcgtaacaggcaagtaggttattcatggctattgaggtgcagggacttgaaattcagatcggcgcgcgcacgctgcttcaccccaccaacttccatgtggccaagggagacaagatcggtctggtgggccgcaacggcgccggcaagaccacgctgacccgcgtgatcaccggcgacatgctgcccaccgccggcaaggtgcgcgtctccggcaagctcggctacctgccgcaggacacgcatgcctccgatcccacacagaccgcgctcgaccgcatgatgagcgcgcgcgacatcgccaccatcatcaaccgcatccgcaaggccgaaaaggatatgaccgacccggatccggacgtgatgagcaaggccatgacccggtacgacaaggccatgcaggacttcgacaaggccggcggctacgcggcccagtccgaggcgatctccatggccgcctcgctcggcctgccgcaggaggtcatggagcagcagctcggcacgctctccggtggccagcgccgccgcatcgagctggcgcgcatcctgttctccaatgccgacaccctgatcctcgacgagccgaccaaccacttggatgccgattccatcgaatggctgcgcggctacttgaagaagtacgagggcggcttcctggtcatctcccactccaccgaactgctggacgaagtggtgaacaaggtctggcatctggacgcgcagctcggccagatcgacatgtattcgcttggctggaaggcctacctgcaccagcgcgtggtggacgaggagcgccgccgccgcgaacgcgaagtggccgagaagaaggccgaccgtctcatgaagcaaggcattcgactgcacgccaaggccaccaaggccgtggcggcgcagaacatgatgcgccgtgccgaaaagctgctggaaaacacctccgaggcgcagaaggccgagaaggtggcggacatccgtttccccgagcccgcgccctgcggccgcacgccgatcatggccaaggatatttccaaggcctacggttccaacatcgtgttcgccggcgtgaacctggccatcgacaagggctcgcgtgtggtgatcctcggctacaacggtgccggcaagaccaccacgctgcgcctgctggcccacatcgaggagccggacaccggttccgtggaatacggtcacggctgcaagatcggctacttcgcgcaggagcacgacaccttggatctgaacgccaccgtgttggagaacctgcagcatgtggcgcccgagctcgataacacgcaggcccgttcgattctcggctcgttcctgttctccggtgacgacgcgatgaaaccggctcacgtgctttccggcggtgagaagacccgtctggctctggccacgctggtcacctcgcgagccaacgtgctgctgctcgacgagcccaccaacaacctcgaccccgcttcccgtgaggagattctgaaggccattgccaagtatgagggcgccatcgtgctcgtcacccacgatgagggcgccgtcgaggcgctcaaccccgagcgcgtgctcctcatgcccgacggcgacgaagacctctggaatgattcgtatctcgaactcgtagctgaagaatagtagtaaactcgtagccgaagaatagtagtaggagaggtctgccatgccaaccacaacaggtaagaaaatcgccatcgtcaccggcagcgcgctgggcttgggctacgagctcgccagccagctcatcgccaacggctggctggtggccggtgtcgacttcaatgccgaacgtcaggccgaactgaccgcgcagtggcccgatgactcctaccgcgcctacgtcggcgacatcaccgacgaagcgttcgtgaaggaatccgtggcggatatcgccacgctcggccacatcgatttgctcatcaacaacgccggccagccttcgttcaaggtgcccaccgcctacgaggccgccgacgtcgacaaatgtctcaagggactcaaaggcatgattctgtggacggtggaaaccctcaaggcctgcggcgagcagaacgtgaaaatcgcccagattatgagcaccgccgccacacgcggcaacgcgaacgaaagcgtgtactgcgccaccaagtggggtgagaaaggctacaccaagagcctgcaggccgcatacaagggcaccagtgtcaaggtggtcgccgtctatccgggcggcattgataccgctttctaccgtgacagtcgcgactacgtctccgaggccaagcagcacaccttcatgcagcccggcccgctggccgaagtcatcctcttcaacctgatcaacgaggccaacctcaccgtcaccgacatcgagatcaaccgcaacagctgagcctgctagtctgagatttcagcgccttggtacatacttggtgccaaggcatttcgcgtgtggagagcgaatgcacatcagtgacgatgagtttgaacgggccattgaacaggtgttggatgatttgcctgaacggtttgcgcgggtgctggagaatgtcggcatcgtcgttgcggacgaacccaatgagcgcgaactggctacaatgagcaatccgtgcggtgagctgctcggactgtatgagggcatacccgtcacgaagcgaactacgggctacagcggcgtgatgccggacgtcatcaccctgttcaaggggccgcatgaacgcgtatgctcaacgcaggccgagctgcgccaacggatccgcaaaaccgtgttgcacgagatcggccattttttcggcttcgatgacgagtatctgcactcgcacggctactgaagcgatgctagtttcactagtggggagccgtcactgccgtatgttgccaggtctactgcaagtggtgcaacgcgcggatgatggcgcaacggtcctcgacggttccctcgttggcgcacatggtggcgtaccaacgcggattgcgcaaggtctcgacgccggtggcctcatccgtggcgacgagcgtgtgcagatcgttggcgtactggaaatgcaggtggctgagcagcccgccctcggcgaacgccttgcgcgaaggcagcggattgatggcaagtagccagcggaacgggctgtcttcggcggccggatcggtggtgtggaacacgaaggtgggggagccttcgagaccgtgctcgatgacatggtcgatggtgtattcgtaggtgtcgaggctggtgtcgtcctcggcgaaccattcgatggcgagcgcggcatcgtccgtggagccggattcggcggccggctcgttcacacgccagtagccgatatggatgatgttctccgggctggtggtggagcaagccatcgaccagaacgtcctgatgccgcgcgcggccatcggggccatcttcgggttggcgagcaccgcctgctcggcggcttcccaggtctgctggatggcggcgtcatccgaatcaatgtaatgctcgaagctttcccattcaccgagccagtcggtgatgtcgaaggccgtggaatccgtggtgttgctggcggtcattgcgcgttcctttcatgggtggatgcggtggcgaaattggtagaggcattagggttggggctgctggcatctgggttactggcatgcgagccgttgttcccggaatcgtcggcgccaagattgacaatgcggtcgcaccagccggcggcgagctcctcatcgtgggtgaccacgagaatcgccttgccttggctcgccagttgccgcagcagttcgccgacctgctccatgtggtagcggtcgagtccgctggtgggctcgtcaaggatgatgaggtccttgccgcacatcaatgccgagccgatggcaacccgctgcttctgcccgccggacaggctcatcggatgccgttcgacgaacgctgcaaggtcaagatcggccatgacctgattggcttgagcggtgatgccggcatccgtctcgtcgagtccgatgagcagttcctcgcgcacgctgtcggagaacagttggtagttgacatcttgcatgaccaggaatccggcgcgggtcaggtcgcgcggtttcgcgggcacgccgttgagctcgatgcggcccgaaacaggcttgatgagtccggtcaacgtgcgcacgagcgtggtcttgccgcagccgttgttgcccatgagcccggtgatttcgccggcacggaaccgcaggtccgggatggcgcgggtgaagccgtccttgcctttgtatccgatggtgaggttatgggtgccgagcaatgccgaagtgcactcatccgcggccgggcttgaagccagcgtcgcaatccggtgccgatacggttgcaggtccaacgcccgcaatcccatggcggccacgcagccgggggagagggacaggaattcatcggcctcgtaatcctgcacgatatgcccgccgtcgaataccacgtaccggtcggccacgccgttgagccatgcgagtcggtgttcggcgattacgatggtgagcccttcgtccttcatctgctcgatcatggcgcgcatgtccgcgatggcgttcgcgtcgagattgctggtcggctcatccaataccacgagcctgggccccagcatggtggccgccgccacggcgatgcgctgcttttggccgcctgacaggtggaagatgctgcgatgcagcagatgcccaatgccaaagcgctcagccacggccgtgatacgacgattgatgtcctcggccggcagccctatgttttcggccgggaaggcgagctcgtcggtgacgttcgcgttgaaatactgggttttcgggttttggaacacgctgccgaccagcggggtgagccggtcgatcggcacggtctccacatccagcccgcacgtggtctggttgccggcgaacgcaccatggaagaatgaggggatgagcccgttggcaacgcgcgtatagctggttttgccgcagccgctcgccccgcacagcacgatgcactcgcctgcgggcacggtcaacgtgatgtcgcgcaatgccggctctgcggcatggtcataggtaaaggagatgccacgggaggcgatggttcccgcagacgtgtcgagtgggccacccttgccggtcccaataatggcagttgcattcggctgcgattggttgccacccatcagatcacccccgcgatatcgagcgcgagcggcaaagtgaccacaatcatgaccagccagtcgaccacggtcatacggatcagcgtgcgcgaggtgtgctcgccctcacgcccgagccccttggtcagtgccgccaccgacaggtcctgtgccacattggtggcgttcatcagcagcggaatcagaatgtattccaacgattgggccgggtgacgaaccagcccccagccgccggaggcgatgccgcgcaacgccatcgcattgcgaatctgccggtaatcctcggcgatggtcgggaagaagcggatgaccaccacacagggaatcaccacggcctcaggcacgcgcatacgccgcatcgcgcagatgaacgcgctcgcggacgtggtggtgaacgtatacgcgccggtgatgaaacagggcagcatcatcgtgacgcccacggccagcgcggagaccacatgcagccacggcagtcccagggcatcggggtcgagcattcccagcgcggtgagtactgcataggtcacgccgaagttcaacgcggttcgccatcgggcggccgccagcaggggcagcaggaacagcacgaccatgacgatttgcgtggcgagccctacgtggaagaacagcatgaggttcgccaccagcagaaggtagagtttcgcgcgcggatcgagcgtccggcgggcaggattcatcaggcgataccggccttgatgaagtgcttcttcatcatgcgctggccgaaccagccgccgagaaccgcgcacaccagaatcgcgatcatcgagatgaagaacgtgccggtgttgatgttgacgaatacgccgtcgatgtaggctgcgtccttgccgcgcgcctgcaggctcgccacgtaggcgtccttcatgaaccacaggggcaggatcgggccggtcaggccgtaggagaacaccacgtagctgacgagcagtagcgccttgctcttatacttgccggcgcgcgcgatgaggtcggccgccaccgggaacacgatgctggcgatgaacgaaagcacgaaatgcccggagatgaacaggaacagtccgatgatcacgcccatgacggtgatgccgccgaatttgccgaggcgtgcggccagcagcatgtacacgcagccggagatgagggccgtgatggcgggcaggaagatggagccgaagccgccggtgaacagggtgctcaccagtgtggcgatgcacaccatcacgaagtacagggccgcaaacacgccgatggtgatgaggtcggagacctccagtttgccggatttggcgggcttgttgagctggtcagaggtttcggcgggcgtgttcggtgcggtcacgatgttttccgtttcgtatgcattgacaatattcctctcgccaatctaacgatgatttcccgcaaaggcaatagtctgtctgtgatttttagcatggcttggcgcccctccctgtggggggcgaaggacgtggcgcgggcggggtgtggttcgcggctatcggctagtatggtgcggtcacgacagagggaggcatgctgtggccgatgtgatgcgggagctggaacggctgcgaccggtgtatgagacgggcgtcctgcggttgctgttgcgccagaacgcgatgctgtacgtgtcgctgctgcgttccacgttcgacccgctcaccggcgagctgccgcgcgagaccgtggaggagcggttcgcgcaaagtctgaacgctctggccgacgccggcgaatatgcgccgcgcgaggaccagaccttcgccgaggccgctcatcagatcctcgccgacctgacccgtgaaggcgaaggcgactacgcctggctcgccaactcgcatgatgcggcctcacaccgattcctctaccgtttgacggcccgcgcccaccgcgccatcgaggcgctgagcaggctcgaagacgaatcacgcgccctgtccggcgcgcaggccaacagcatcatcatggaaatcgagcacgcgcgcatgcagctgaccgccgaccccggcgagcgcatcaaactcctcaaccgtgaaatcaaggaacgcaagcacgagatcaaacgcatccaacagggcaagcagcatgccacgctgagcgaagcccaggtggaggacgtgatcgccgtgatccacaacacgctgcgcggcgtgcccatcgacctgcgcgaactcgtgctcgacgagcgggacaacggcgacgccttgcgccggcgcatgcaggccggcgacatcagcgtggacgagaacctgacccgctaccacgatgaataccgccgctcgttccgcgaatcagacagcggccgccgcttcgaggacgccttccaggtgatcatcaccgacgagggccgccagcaaatcgacgaagccctgcgcgctatcgccaaaaccccgtatctggccggcgaatccggcgtgctgctcggccagatccgcgacgaactggcccgcatctacgacggcatcgaagccgtgcgccgccagatgcgcgtctccgacgaggcgatcagccggctcgtgcgccagcaaaccgacactcgctaccgtacgatgctcacccgcttgaaccgactgtacgcgcgcctcaacgcggatgcgaaaacccatatgggagacgcctcgcgcccgtacgacacggccacctcggacgcgctgttcgcgccattgccgatgcgcccggccaaatccatgacccgcgccaccgcacccggcctgagcgacctcgccgccgaagccccgcagtcgactccggtggccgatctgcgggacatggtcaacagcggcggcccccgactcctgcgcatggtcagcctcatccggcgcaacccggtgaccgttgacaggtccgatgacaggcccggcgcaaccctcgtggacatcgccgccagcttcaaccggctgcccgaaagcgaacgccgcgaaagcgagatcgtcggcttcctgggcgggctgggagccgtaagcggcaacgccatcgccgacgagccgtccactgacggcgtcggcgtcggggtcgacagcgacatcgccaccgagccggctccggcgcagcgcggcgatactgcgacctggcattgcgtatcgatcgacggcgagccccggaactggatcactagaccggtgctggccgacatggacgagctgagcatcattgtggaggaaggatgaccgtggccgaggaacacgaggaacacgaggagcatatggacaacgccaacccgtacgccctgttcgaaggcgacatcggcgacatgccggccgaggcacgcatggccgccatcgcccttaaacgcgaccgctatatcagcgggcccacctacgacaccgtgctcgacaaccgcgacgccgtcgtacgctccctgaacaacgacctgctcgacttggtgatcaacgaacgctaccgcatcatgtacgccacgcccgtggccggcgacgacgtgaccctgcgctcgctcaaaacccgtgtcagcctcaaacgcgaggaggccgcgctgctcgccttcctgcgcatccgcgtcctcgaatacgagaacgtgcacgccgaccccgccgactggctcgtcagctttgaggagatccgcgccgcgctcgccaccggcgccggctatctggccgcccgcaacgacgaggaaggcgtggcaaagcagatcggcgccatcgtctccgcgatgatcacctacgggtatttggtgcgcctggacgacgaagccatgtaccagatcacgccgctcgtgcccgtggtgctcgaccgcgaactggccgacacctggctcgacgtcgcggaacacggcgacggcgacacggaagatgacgatgacgacgagaagggagccgaatgatgcaggcgacagacgtgcagatgatcgcggaccggtggatgctggaatcccgccgactcatcaactggggctcctatgagggctaccacgaattccgcccctccacggaccacaagctgccggtgaccctgctcgccggcgccagcgaatccggcaaatccacgctggtcgacgcgcagatctccctgctgtacccaaccggtacgccgttcaacaaggcctcgaactccggccgctccgaacgcagcgactacacctacctgcgcggcatggtcggcgtgggcagcaccgaaaccggcgacgagccgctctacctgcgcggccgcgacgagaacggcgcaccgcaacccgtgtggggcgccatcgtggacacctatcgcaaccagaccaccggccaggtgctctcctgcgccaaattcctctacctgatgcccggcgacggccgcggcgacgtgcgccgacagtacgtggtctggggcaagcccgtggaccccaggcgcatggaccaataccgtgacgccccgttcacgccggcccagctcaaagccacctaccccgactgcctcacattccccagcgccgaagcgttccacacacacatctggagcgcaatgggcctgagcgaggccgcctgtcgactgctgcacaagatccagtccgccgacgcgccctcccggctcgacgacatcttcaaacaaggcgtgctcggcgtgcccgaagccctggacctggcccgcaccacggtcgaggactacgaacgttacgacgagaacttccacgccatggacgagaagacccgccgcatggacacgctgcgcggcatccaacaggcctacggcgaatacgccgccgcacgcggcaaggcccgcgccttcgaaccggtcaagccggccgtcgacggcacggtaccggccgtgctgcgcgactgggcattggcccgcatgcgcggcgaagtcgccgtccaactgcccgccgaccgcgccgaacaacagaacagcgaggcggaagccaagctgctgcgccgccgaaccgaagacctgcgcacccgtctcgacatgatccgcggccagatgcagggtctggacggcggcaacctgacccgactcgaactcgaactcgaccaggcccgccgcaccctcgaagacgtgcaagccaaccgaacacgaatcgaacaaacgttcgcatccatcggcgagacgctgcccggcgacgaacaggcctggaacgaacgccgcatcaacgccgtgaacttcaaacgcgaatacaacaaacgagacggcgaatgcgaggaagccctcaccgccgccatcaacgcgtgggccggcgcacgcggcgacctcgaacgactgcaacgcgacttcgaccggcaacgctcccagcgcacccgcatctcccagcagatggacgaaacccgcgccatgctctgccgcgccaccggactcacccccgccgaactgccgtacgtggccgaactcatggacgtgaacgaacacgaggaagactggcgtctcgccatgaacgtcgcctacgcgcccatcgcccagaccatcctcgtcgacaagcgccacgaacagggcttcgccgccaaagtcagcaccatcgacccgcgcaccatgccccgacgcacctggcagttcgtggacaccgcacgccactacgacgacaccggcgcgcacgcgaacatactcaccggagaacaggacggcgactggctgtccggcaaactgcgctaccgcgacgactcgcccttcgccgactggctgcgctcgcagacccaggacgaacgattcgacgccctatgcgtcaccgccatcgacgacaccgaccgcaccaaccgtcaggtgcaggccgacggtcagatcaaatccggcgcacgcggccagcacggcaccaaagaccgcgcccaggtcatcggattcgtcaacgaaacctacctcaacgcgctcgcagcgcaggtcgacgccgcccgcaacgcgctcagccaagccgacaccgactacacggccgccaaaacacagtccgataacctccaccgcgaactcgaactggccaaccagctcgtctacacgtcctgggagcgcatcgacatcgccggcgcgcaacggaccatcacggacacgcaggacgccatcgcatccatcaaaaacgatcccaagctcgccgaactcgccaaacagcgcgacgaactgaacgccgaactcgaccgtgtggaacgccagcgcatcgaatccgaccaggccgcggcccgcgccggcagcgccgtcgaagcggcgctcatctggctgcgcgaccatgccgacaccggcacgacggacgccgccggtgccaccgccgacaatgacgatgacgccgcgtccggcccgctgccggacgaagtcacggcggcgctcgccgaatcctacgacaaccgattcgccggactggcggacgccgccatgcgcgcgcacatgatcatcggcgcgggcgcggcaggaacgcaggcaccgggggagagcttccccgaacgcaccatcgccggcatcggcaaggacatggcctcccgcatcaacctgctgaacggccaggccgatgccgcacgcaccggcgtcgaatcgaaaatgagcacctacatcgcgctctacgcggccgacgatgattcgctgaccgccagcgtggaggactaccggtactatctcgacgaactcgccagcctcacccagctggccgcggtcgccgccaccgacgccgaataccggcgctgcctcgaacagctgctcaggagcttcctgaccatcaaacgcgccatcgacacggatgccagcgacatccacgaccagcttgaccgcatcaacgccatgctcaaaggccagcagttcggtcccaagcacggcagcctgtccctgcacgcggacgtgcgccgtcccgagcgcaccttctgggcgcagctcatccgcgtcatcggcaccctgaacgattggaaatccgccgacgtcaacgattccgacgcctcgcgcaaggctttcgcggcctgcgcgccgatggtcgggctgctgcgcgccgaactcgcgcaggtcaaggacgcgaacggcgtgaaaagctacggcgcccgcaacctcgacccgcgttgccgctcgtccttctacgccatcgtgcatcatgccgacggcccggatgaacgcatcacctccaccggcggccgttcgggcggcgccttgcaggagcttacctcattcgtatacggcgcggcgctcatctacctgctcggcggcggcctgaccagcgagccctcgtacaccacgctgttcctcgacgaggcgctcatcaaggccgacggccgttacacgcagcgcgccctcacggtgctgccgcgcctcggattccaggtcatcgtctccgccccggaaagcaagaccggcgaaatcctcgaggtctccaccaaggcctacgtgacctacaaggaccccgacaccggcctcacctccctgcgcgaggccgtgctgcatcagaatgacatggacgatgaatcatcgtcggatatattgaaggatgacggggttgccgaatgagcagtcctggcgtcgccggtattaagacgattcggttcgactcgacgatgttcgaaagcaggtgatgggaactatggccggcatgaaagacatcgctgcgatcaccacatgcgtgaagaaacatatgcgttcacatatgtacgacatcgaaccggcatggccatttcccgtgccggtgggattgccggaccaagcatttttggaaaccaatgcgattgcggtgcatgacaacaacaatgagatacggcaatgggcaagcaagaatggttgcgaaatcataaccaagcatcgcaccataggcacctctgtcgagctgatctccaaagtcgtcgttcctgacgaatcaatagccatgcgtgtggttggtcgtacgctggcggcggaatgtcgcgaagcgcgccgccgcatagcatgtctggttgctgcttgtgacgttgctccggaaacaatcgaatcggccgctcgcatgacaggccatgaacagcctgacgacttcgatctgcttgtcagcgcagttcgatatttcaggcatcatgacgtgaccggtatgacgccgcgacagattccactgacaggattcagcggcaaatggctgaatgagtcaaaaaccaatcgtcgtaaggccatttgccgactgctcggtgtcgaaacgttgggtctgtcaaaacggccgaccgaactgcggttccgttatctcgatccggtccgcgacgatgctgagctcgaacgcatcatatggtgtccgtgggaaggcgaagcgttatccggcattaaatatgctgtcatcgttgagaacaaagacacgtatcagactatgccgccgattgcgcagggcatctgcatatggggttctggtcgcgctgtaagcgatgctgtacctgcggttcctgcactgcgtgacatgcgtatcgtgtattggggtgatatggatgcggatggactggaaatactttcgacattacgtgaatcaggtatcgaatgcgactccatcctgatggattgcgatgcatacgatcggtaccacagatttggtaccgatcgtactgaacgcagcgcgaagattgctatgcgggagcctaagccgacgcccggccttcaatcggcggagcgacgtctttatgaacgactgtgtgctgacaaaacaatcgcttatcggcgtatcgaacaggaacgcattcccatgcgtgatgcagttgacgaattacgcaagcttggcatccccgtggagtccattgaaaatcaggatttgccgatttaggctgagtgattggggatgttgccaagagctagaacggcttagctttttctcgtctcacattatgccttccgattaataatgcaacggcattgcatagctgcaaggtccggcactgctatccgatactatcgaactgttgttttgcgttgcgcgagaagggacaaacatggcaaccgcttggggtgacgagagtgtgcggaaaaccggagttccctcgcctatgtacttgatgggcgcatgcgtatgtgatgatacggaaaccgaaacaaggcaaagattggcgttgcttaagcccaaaggagcaaggaaattgcactggcgagacatgcggccatcattgcgtggcaaagtcgttgatgccatggctgcaatggacattgatcatgtcattgtggctgcggtaccaatgagccagtggaataccgccgaacgcgctcgccgtaaatgtttggaacgtcttctgcctctgctggaaacagaatacaacgtggacacgcttgtgcttgaacggcgcgagatttcacaggacaggaacgatatccgtttcatcgatggattgagaagccgcagatttatcgggccaattcgtgtcgaactctgtgcaggggagactgatgcaaggctatggctccctgatcagctgctaggagcgtacggtgatgcccaggccggtactggaagatacgatgaattcctcggccatgttcgaacagtgttcatcgacagtgattgatgtcctaaaaccgtgtatacttcatggtaagccaaccccgctggggaaatggaagtgagagccggacgccccgagtatcttgggggccggctcttgcgtttcggtccactgatggtccggaattttgcatactctggttcagttttccggcctgacacgccatcgaacaagcgttcgaatttggtcgtgtgttcgggtatccttgggacagatttggcgcgcgcatgaccgtgcgcgcgggaacggtgagatggaaggtggggtgtggctgtggcggcaatgcagactggcgcaaggcgcgcaacaagcgcaacgggcgcgaaaaccggcaagggcaagaacggtgaggtcatcgtcgaaaaggtgatgaccagcgactccttcctgagccgggagatcaaaaaggcgccgctgattgaacacgatggttcgctggtagctgatatctcgcacatcccgaacgatctcaagatcacgattcaaggtgcgcgcgaacacaacctcaagaacgtcgacctggcgattccgcgcaatcgcatggtcgtgttcacaggcctgtccggttcgggcaaatcctcgctcgcgtttgacaccctgttcgccgaaggccagcgacgctacgtcgaatccctatccgcctacgcccgccagttcctgggtcagatggacaagcccgacgttgacttcatcgagggcctgagcccggccgtctccatcgaccagaagaccaccaaccgcaacccgcgttctaccgtcggcaccatcaccgaaatctacgattacctgcgactgctcttcgcccgcaccggcatccctcactgccctgaatgcggcgagcccgtcgcctcccagaccccgcagcagatcgtcgacacactgctcggctacccggagcgcacgcgattccagattctcgcgcccgtggtcaagggccgcaagggcgagttcgtggatatgatcgagctgctgcgctccgacggctacgcccgcgcgctcatcgacggcgagatgacgcagctgtccgacgacatcaaactcaccaagcagaagaagcacaccatcgaggtcgtggtcgaccgactcgtggtcaaggacggcatccgccaacgcctgaccgactcggtggaaaccgccctcaagctcgccaacggcagcatcgtcatcgacttcgtggacgaggaggaaggcagcccggcccgccgccagccgttctccgaacaccgcagctgcccgaacgggcacacgctcgaactcgacgaggtcgagccgcgcaccttctccttcaacgccccctacggtgcctgccccgcctgcaccggtctcggcttcaaactggaaatcgacccggatctcatcatctccgacccggacaagtcactggccgacggcgtcatcgaaccgtggagcggcaccaagatgacctcccagtactacggccacatcctcgaaggtctggccaaggaaatgggcttctccatgaagaccccttggaagggcctgccggacgacgtcaagcacgacatcctctacggccacgacttcaaggtcaacgtctcctaccgcaatcgctggggacgcctgcgcgaatactccaccggcttcgaaggcgtgatccgcacgctcatgcgacgccacgacgaaaccgattcgcagtccatgcgcgaatactacgagtcgtacatgcgcgaagtgccctgccaggtctgccacggacgccgtctgaagcccgaagtgctcgctgtcactgtggacggaaaatccatcttcgacgtgtgcgacatgcccgtcgtacgcgaactcgcctggatcaacggcctgaaactcgaaggctcggcacagctgatcgccggcgaagtgctcaaggagatcaaggcccgactcggcttcctgaacgacgtcggcctcgactacctgaccctctcgcgcgcggccgccaccctgtccggcggagaagcgcagcgcatccgactcgccacgcagatcggctccggtctggtcggcgtcatgtacgtgctcgacgagccgtccatcggcctgcaccagcgtgacaacgaacgcctcatcgaaaccctgcaccacctgcgcgatctcggcaacacgctgattgtcgtcgaacacgacgaggacacgatacgccgcgccgactgggtggtcgacatcggccccggcgccggcgaacacggcggcgaagtcatctactccggccccgccaagcacctcatagaagccaagcgctccatcaccggcgactacatcgcccaccggcgagagatcgccgtgcccgccaagcgccgcaagatccacaagacccaggtgctcaaagtcgtgggtgcccgcgagaacaacctcaagaacatcgacgtgagcttcccgctcggcgtgctcaccgtggtcaccggcgtctccggctccggcaaatcctcgctggtcaacacgatcctctacccggtgctcgccgacaagctcaacggtgcacgcatcgtacccggccgccacacgcgcgtggaaggcgtggaccaggtgcgcaaggtgatccacgtcgaccagaacccgatcggccgcacgccgcgatccaaccccgccacctacaccggtgtgtgggacaagatccgcaccctgttcgccaagactcccgaagcccaggtgcgcggctacggccccggccgcttcagtttcaacgtcaaaggcggccgatgtgaggcctgccacggtgacggcacgctgaagatcgaaatgaacttcctgcccgacgtctacgtggactgcgaggtctgccacggcaaacgatacaaccgcgagaccctcgaagtcacgtacaacggcaagaccgtggccgacatcctcaacatgcccatcgaggaggccgccgacttcttcaaggcgtacaccggcatctcccgatacctgaagaccctcgtggacgtcggcctcggctacatccgactcggccagcccgcacccaccctgtccggcggtgaatcgcagcgcgtcaagcttgccaccgagctgcagcgccgatccgacggcaaaaccgtgtacatcctcgacgagccgaccaccggcctgcacttcgaagacgtgaacaagctgctcaaggtgctgcagtccctggtggacaagggcaatacggtcatcgtcatcgaacataatctggatgtgatcaaggaggccgactggctgatcgatctcggtccggagggcggcgacggaggcggcaccatcgtcacgcagggcacgcccgaacaggttgccgaatgcgaagcctcatggaccggcaagttcctgaaacccatgctttagccttccattgcagctgacctcgggtgggttggggtgtgtgttgctggacacgctccgggccgctcaggccaagtctttacggtccagcaacacacaccccaacccacccaatccctgatgattggcttaatagcgaggaggattatgacgaacgatattgagcggcatagtccggatgagtggcggaagactgcggcggcgttaatgtcggaaagcgtagctgtgggtgccggggaaacgacggcgaaggtgaatgcgaatggggcacctttgctgggggattctcgcgacctgttccgacccaagacctcggatattcccgccaaacccggtgtgtacaaatggcgcgacggggaagggcgcgtcatttatgtgggcaaggcaaagaacctgcgcaacaggctcaccaattatttccagccgctgtatctgctgcatccgcgcacgcagaccatggtgctgaccgcacgcagtctggagtggacggtcgtcgccaccgaactggaatcactgacgttggaatacacgtggatcaaggaattcgacccacggttcaacgtgcagttccgcgacgacaagacctatccgtatctcgcggtcagcacgggggagcgaattccgcgcgtgtgggtcacgcggtcgcgcaaacggcgggatacccggtatttcggcccctatgccaaagtgtgggaattgcggcacagtcttgaccggttgctgcgcacgttcccggtacgcacctgcaccaccaacgtgttccataaggcgcaactgaccggacggccatgcctgttcgcttccatcggcaaatgctccgcaccctgcgtgaaccgcattgaagcggacgaacaccggcggctgtgcgaacagctggtcggcgtgatgaccggacgactcggacggccatacatcgcccagttgacccgcgacatgaaagaggccagcgccgaactcgaattcgagaaagccgcccgactgcgcgaccagatccaaatgctggaaaccgtggtgcaacagaacgccgtcgtcttcgaccaggatgtggacgctgacgtgttcggcttcgccagcgacgagctcgaagcctccgtgcacgctttttatgtgcgcgccggctcgattcgcggcgaacgcaactggagcgtcgaacgagttgaggacatcgatgacgccgacttgatggccgaccttctggtgcaggtgtattcggacgccgccggggataatcacccccagtcggccgcgaccatctccaccaatcgcgaggccatcggctccacgcaaaccatcacggccacggacgctgtggcacgcgcccaggccacccgagaacgcaacacccgtcaggagaccaccgggcgcgcggacctgctggcacccatcgcaccggtaccgcgcgaaatcatcgtgcccgtcgaaccggcccgccgtgaggaactcgaaggctggctgaccaatctgcgcgggggagcggtgaccatccgtgtggcctcgcgaggcgacaagaagcagcttatggaccgcgccaacgagaacgccagccaagcactgcaacgcagcaagatgagccgcatctccgacatgggcgcacgcacccaggccatgaacgatgtggccaaggcattgggactcgcggaagccccgctgcgcatcgaatgctacgacatttcgaacactgtgggtggtgccttccaggtggcctccatggtggtgttcgaagacgcgatcgccaagaaatccgaataccgacgcttcgccatccgaggcaaggacggcaaaggcgcggtggatgatctgtccgcgctttacgagacgctcacccgccgcttcaagcacggcaacatcgccggcgactccggcgaaagcatcgacgcggaacagcgtgtggcctcggccgccggcaagatgaccactgccgtggcggcggagacaatcgctgcgaacggtaacgacaatggtgagggcggttccgacatcagtggcaaggggcacgcggtgccggtcggagtgcagaacgatgcgcgggagtccccgcccgacatcgtccagcagaacacaaaccggcatcactttgcctacaagccgaacctggtggtggtcgatggcggcaagccgcaggtcatggccgccgccaaggcgcttgaggactgtggcgtgaacgacgtggccgtctgcggactggccaaacgcttggaagaggtgtgggtgccggacgacgactatccgatcatcctcaaacgccagtccgaaggcatgtatctgctgcagcgtgtgcgcgacgaatcccaccgcttcgccatcacctaccaccgccagcagcggcgcaaaggcgccctgcgcagcgcgctcgacgagattcccggcatcggcgaaagctaccagaagcggctgctcaaccacttcggctcggtcaaagccatgcgcgaagccagtgtcgaggacttcgagaaggtcaaaggcatcggccacgccaaagccgaagcgctgtacaccgcgctgcacgagcagtgagccggcccggtccagcagcccagagtaaattttcggttgcggggcctgtggttgacatattcgaagcaaagtgtcggctagcatgggaacagacatcaaggaggggatatggccaatcatcgttgcgctgtactcggcaaacccgtcgcacactcattgtcacccgtgctccacaacgcggcctaccgttcgctgaaactcgacgattggctgtacgacaagcacgaggtgggggaagacgacctcgacgctttcctcaaaggccttgactcgacgtgggctggcctgagcctgaccatgccgttgaagaagaccatccaaccgtacggtgttccggaaaatttgtgggccaaggaactgaaggtggcgaataccgcggtattcgactggagcgtggctgccgatgattccgcttggccgaacggcaagccgggcatcaagctatacaacaccgatgtcatcggcatccaactcgccttcgaccatgccaatcgcgaactcggcgaacaccacaccgcgtcgagaagcggcaccgcgctgatcatcggcaatggcaacaccgccacttcggcgttggccgcatgctgcatgatgcccgaaatcggccatatcgtcgtcgccgcccgtcaccccggaaaaaacaccgggcttaaaccagtggccgaaaagttcgtcaacgtgcataacccgtacaacgaaatcgaattaggcgacgatcaggccctgcttgaggcagcccgcaacgccacctatgtcatcaacacgattcccggacacgcggccgacaacgtcgcggatgccctcgccaatgccggaaccgagccattctccggactgctgttggacgtgatctacgatccacgccccaccaagctcatggaagcctggcgcgctcatggcggtcacgccatcggcggcgaagaaatgctgctgtaccaagctctcgtacaggtattgctgatgaccggtatctgggatgacgacccgcccagcgatgccgaccagcgtctgcaggacaccaccaccgaagacgaccagctggagatcgcgatgcgcaaagctcttgaggaggcgctgtaatgaatcaacagacaacgaaccgcgataccggcgaggcggccgccacgaatgcgccggcgaattccgcgacatccacatcgactccggacaaccagccgaccccgcttgatgccttcgaagtgctgctcatcaccggtatgtccggcgcaggccgctctcatgccgctgactgcgtggaagacatgggatggtatgtggtcgacaacctgcctcccaaactgcttatcccgcttgtcgacatgatgaccacctccggttccggatcggagtcaggcgtccacaagcttgccgccgtcatcgacgtgcgctccagctatttcgacgagctggccgccgtgctcggccatctggatgatctcggcgtcaaaacccgtattctgttcctcgacgccagcaacgaagtgctcatcaagcgctatgaatccgtgcgccgcccgcacccgctgcagcacggcaaccgactgatcgacggcatccttgaggaacgtcacctgctggaagacctcaaggaacgagccgactgggtcatcgacaccagctccctgagcatccaccagctgtccaccaaactctacgaggcgatgctcggctccggccccaccaccgtggcagtacacatcttcagcttcggcttcaaatacggtatgcccatcgacgccgatttcgtggccgacgtgcgttttctgcccaacccgttctgggtgcccaacctgcgcgagcttaccgggcacgacaagccggtcgccgactacgtgctttccagcaagggagccaaggaatttctcgacgcttatgagaaagctatcgagattgcgttggaaggatacgcccaggaagacaagcactacgtaaccatcgccgtcggctgcaccggtggtcagcaccggtcggtggcgatgagcgaagagctggctcgccgcttacgcgcacatgggctcaacgtaaccgtttccgcgagagaacagcacaagcgtcactcatcgtaagcaggcgtcgagcggtcatcgggcaagtgttcggtgaccacactgcgagaaagcagggcccataatacgtatcaaacgggttcgcttgtccaccagattaggtatcacagaaagccgatggcttccgaccgtgtgacagcagatgacggcacgaagcgcctgaagcattgagaagaacgggactgtaggaggtagatcttggctcttctggacgatgtcaaaagcgagttggcagcctttgaaggcgattcgccagccgcgatcaaggcccaagctgcggccatgatccgttttggcggcggtcttcgaccggtacagaatacatacgttatccaagccgtattcacctcgcttgacgttgcagaatggctgaagaacacgttgaggaacacgttcgggcacgaagccgaggtcaatcacctcacacgtcagaccccgaacggccctgtcgagacctacgtggtgctcgtcacccgcaacgtagtggccttggctttgcagaccggactggtcgaccgccgcaagcagcaggtccgtggactgccgtctgaagtggtcaacggatccatcgcccaaatcaaagcggcatggcgcggcgccttcatggcccgtggcttcctgtccgatcccggtaaggccagcttcctggaaatcgcttgccccacggaagaggccgccatggccctgtgtggcgtggcccgtcgtctaggcatccaggccaagcatcgcacgctgcgtagctccgagcgcgtgacactcaaggatcccgacgccatcgaacgcatgctcaagctcatgggcgccacccgttcggctcgcgaatggaccggcaagcgttccgatggcgaggcccgcggcaaggccaaccgtctggccaacttcgatgacgccaatatgcgccgttccgccaaggccgccgccgaagccagcgaaaaagtgcagcatgctttcgaagtactcggcgataacattccggacaacctccgtcaggccggccagctgcgcatcgatcacgtggacaagagcctcgaggagctcggcaagatcgccgaaccgcaaatcaccaaggatgcgattgccggccgaattcgccgactgcttcaacttgccgagaagacggagaaggctcgcgcagccgaaggcaagtaacccgacaatccgatttgccatgcctattcggcaaaacgcgacaacgatgtgacaaaacaccgcattcagtcagtagacgaatgcggtgttttgttccggaatgcctgtaatatgcaaagtggcaaaattggccactttgacgtgcgattcgtcaaggaaaggatattcatgaagacactcaaggaccttggagatctcaagggcaagcgcgttctggttcgcgctgatttcaatgttccgctggacggcaccaccatcaccgatgacggtcgaatcaaggctgctctgccgaccatcaagaccctgcgcgaagaaggcgccaaggtcatcctcatggcccaccttggccgcccgaagggcaaggtcgttcctgagctgagcctggccccggttgccgcccgcctcggcgagctgctcggcgccaacgtgccgctggccaaggacacctacggcgaggacgctcaggccaaggtcgccgccatgaacgatggcgacgttgtgctgcttgagaacgttcgtttcaacccggaggagacctctaaggacgccgacgaacgcgccgcttacgccaagaagatcgccgccctcggcgaggccttcgtttccgatggcttcggcgtggtccaccgcgctcagggctccaactacgacgttgccgccgatctgccggccgccgcaggcctgctggtcgagaaggaagtcaaggccttgtccaaggccaccgagaacccggagcgtccgttcaccgtggtgcttggcggttccaaggtctccgacaagctcggcgtcatcgagaacctgctcgacaaggccaaccgtctggtcatcggcggtggcatggtgttcaccttcctcaaggccaagggctacgaggtcggcacctccctgcttgaagaggaccagcttgagaaggtcaagggctacatcgagaccgccgagaagaacggcgttgagctcgtgctgccgaccgacgtcgtcgtgaacgccggcttcccggccggtgacaccccggttgctccggaagtcgttgccgccgacgccatcccggccgacaagatgggtctggacatcggcccggagtcccagaagctcttccacgacaagatcgtcgactccaagaccgtcgtgtggaacggcccgatgggcgtgttcgaggttcctgagttcgccgccggcaccaaggccgtggcccagggtctggtcgacgccaccgcagccggtgcgttcaccatcgtcggtggcggcgactccgcctccgccgtgcgcaacctcggcttcccggaggacggcttctcccacatctccaccggtggtggcgcttccctcgagttcctcgaaggcaaggagctccctggcctgaaggtgcttgagtaatccattttctagctcccctccttgaggggagctacgtttttttttagaagggaaacatatggcgtccaaacgcattccgttggtggccggcaactggaagatgaatttcgaccatcttgaagccacttacttcgtgcagaagctggtatggctgttgcgtgacgctcacttcgactttaaacgctgcgaagtcgcgcttttcccctcgttcacgtcattgcgcagcgtgcaggtgctggtcgaagccgacaagctccatgtcgcctacggcgcacaatccgtttccgtgaccacccaaggtgccttcaccggcgatgtgtccgcggacatgatcgcccatcttggctgctcatacgtcatcgtcggccactccgaacgccgcaaataccatcctgaagatgacgccaatatcgtcgatcaggtacgtgccgtgctcgccgccggcatgcagccgattttgtgcgtcggcgaaagcttcgaggaacgacgtcaaggcattgaactcgatttcgccgtgggccaggtacgagacgtcacccgcgatctcaacgaagaacaagccgccaaactcatcgtggcctacgaacctgtctgggccattggcaccggcatggtggccactccgcaatccgcccaggatgccgcaaacgccatccgcaacgatttgaagaccacttttggcacgaaggtatccgatagcgtacgtatcctgtacggcggatcggtcacctcgaaaaatgcggcggaactcatttcccagcccgacgttgacggcttcctgatcggaggggcggccctggacgttgaggaactcgccaaaatcgctcgactggcactgaaatccacgaaatcacggaactaataccacggttttcccgtgtgtgcgctatgctggtcaacagtccaatcaatccggaggtaccctgtgaccgctcttaagatcacgctgcaagtcatcgtcgtgctgctcagcttcgtgctgaccctgctcatccttatgcacaagggcaagggcggcggtttgtccgacatgttcggcggcggtctgacccagaacgccggtacttccggtgtcgccgaaaagaacctgaaccgttggaccgttatcatcgctctggtgtgggtggccttgatcatcggcctcgacatgatgaccaagttcaacctcggctgatcggcttgcacgccatatagacttgtcgctcgcgacccatgaccgttaccgtcggtcatgggtcgtatgcgttctatcgagtattacgaaaggacatcaccatggtcactatgaaccgcaacaaagtcgttatcgtcggcaccggccgggtcggtgccaccgccgccttcggcatcgtcacgcacggcctgtgcaatgagcttgtgctcatcgactgttccgccgccaaggccctgggggaggcccgcgacctcgatgatggcagcgaattccaggaccgccacgtcaaggtgcgcgccggcgactacgccgactgcaaggatgcggacatcgtcgtcatcaccgtgggccgcaagccgccggccaactccaaccgcatggccgaactcggcttcaccgtgggtcttgtgggcgaagtggtcgacaacgtcatggcctccggttttgacggcgtgatcgtcatggtctccaacccggtcgacgtgatggcttggtatgcctggaaacgttccggtctgcctcgcacccaggtgctcggtaccggcaccgcgctcgacacctcgcgtctcaagaccatcatcggcgaagagaccggccttgacccgcgcaacgtgggcggcttcgtgatgggcgagcacggcgactcccagttcaccgcatggtccaccgtctcgctcggcggcaagccattcgcccgcttcctggccgacaaccaagaccgtttcgcctccgtgtccaccaccgaaatcgaagagaagacccgcacccgtggcaatgagatcgtcgcggccaagggcggcaccaacttcggcatcgcctccaccgtggccggcatcgtacagaccatcctgtgggacgaacgccgcatcgtgcccgtctccaccctgctggacggcgaatacggcgaacatgacgtgttcctcggcgtccccactgaactgcgcgccaatggtgccaacgagatcgtcgaactcgatctgagcgaggacgagcgggccaaactgcaccattccgccgaactcgtgcgtgaacactgtgaggggctgctgtgattctcgacgccatcacgccgaaacaaccccgactgctggtcgccgacctcgacggcacgttgctgcacgacgccgaggtattcgaggaccggttcattacccagcgcagcatcgacaccatcaaccgcgcgcacgatgccggaatgcaattcgccatcgccaccgcgcggccggtgagtaccggtctccagttcgccgaaaaactgccggtggacgccgtaatctatctgaacggcgccctcatcgatttcgacccggcccactccgacttcgacctgctcacctcaggtgccacgccggccgatgagaaccatttgatcaagattggcttctcctcacggcgtgcctgcgaagtctgtctgttcctgctcgatcgcatgcccggcctgaagctcggcatcgtgatgaacgacgtgcgctacaccaacttcgatgtgcgcgtgtattggaaaactcaggccttccaatacacgaacttccacgacgtgcccgaaggcgtggcggacaagatcaccatcttccccgagcctgaacagtggaacgagctgcgtgcgctgattccgccggacttcgacatctccatcagcgaaggcgtgatgtggatgctcatgaacccgcaggccaacaaggagcacgcgctgcacctgctgtgcgagcgactggacgtgccgcttgaacagacagccgccttcggcgacgacctcatcgatatcaacatgatgagcgaatccggccggggcgtggccgtggccaacgcgaaccccaaggtgttgtccatcgccgacgagatctgcccgtccaacaacgaggacggcgtcgcccaatggattgaagcgcagttgggctgaaccggtcgagactcgagaacacgccaaaattgaacttgtgttgaaccgggggtatgctttgaaccgttgttcaaaagataaattgaactcccggttggaggcataaggatatgagcgtatcggtgtttgcggaacgtctgcgcaatgcgatgaacagcaggggactgaagcaggtcgatttggtgcacgccgccgaacatcgtggtgtaaagatgggcaagagccacatcagccaatacgtggccggcaagaccatgccccgcgaggacgtgctcgaattcctggccagcgaactggacgtcgacatgaactggctgcgcggcgaggaatccaccacgcaattgaactcggacgcctccaacagcgtcacggacggcgaacacgccgccacaccgcttgccacgggtgcctccaagccccagacggacagcgagattcccgtgggccgccgccgcaccttcggcaaatcgcacaagctcgacaacgtgctctacgacgtgcgcggcccggtcgccgacgaggcgatgcgcatggaggccaacggcacccacatcctgaaattgaacatcggcaacccggcacccttcggcttccgcacgccggacgaagtcgtctacgacatggcccaccagctcaccgacaccgaaggctactcgccgtccaagggcctgttctccgcgcgcaaggccatcatgcagtacgcgcagctgaagaacatcccgaacgtcaccatcgacgacatctacaccggcaacggcgtcagcgagctcatcaacctgtccatgtccgcgctactcgacaccggcgacgaagtgctcgtgccatccccggactacccgctgtggaccgcctgcgtgaacctggccggcggcaccgccgtgcactacctgtgcgacgaacagtccgaatggtatccggacatcgacgacatccgctccaagatcaccagcaacaccaaggcgattgtcatcatcaacccgaacaaccccaccggcgcactttacccaaaggaagtgctccagcagatcgtcgacatcgcgcgcgagcaccagctcatcatcttctccgacgaaatctacgatcgcctcgtcatggacggcctgcagcacatctccatcgcctcgatggccccggacctgttctgcgtgaccttctccggcctgtcgaaatcgcacatgatcgccggctaccgcatcggctggatgatcctgtccggcaacaagcgcatcgccaaggactacatcgagggcctcaacatgctcgccaacatgcgcatgtgttcgaacgtgcccgcccagtccgtggtgcagaccgcgctcggcggccaccagagcgtcaacgactacatcgtgccgggcggccgcgtgcacgaccagcgcgacctcgtctacgacatgctcaaccagatccccggcatcaccgccgtcaagccgaaggccgcgttctacatcttcccgaagatcgacgtcaaacgcttcaacatccactcggacgagcagttcgcgctcgacctgctgcatgacaagcacatcctcatcagccacggcggcgcgttcaactggcatcgccccgaccacttccgcgtggtgtacctgccgcgcatgggcatgctgcgcgaaaccatgggggagatctccgacttcttcagctactactggcagagctgatccttggcgcaaacgaacacgctcgattgtttcgtgatatgaaggagatcttatgccggtggtgtcgcgtcgtgcgcaggaagcgctgtatcccagcgatcgcgcgaaccgcggcatggtggtccgcgctatgccaaggtgaaggcgatgacgaaggccgtggcggacagtgcggttgccaggagcagatagcacacggcggctgaatttcgagagccatcggcattggcagcgttaccgccgttatttgcgttgcgtgcagccaacgtgatggccgtaatcgccgaaagcagggagaacaatggcagcacgcacaacacgacggtcagcagtcccaaagcttcatggccgatgcaataagcgacaagacctgcattgtcagttgccgatagcgctgggcagaaatcggtgtgtctaccagtgttgtagctgtaggtaaagaacgtgatacctgaccagaacagggcaacgggaacagagcaattgcgtatggcggatgcgttgatgctgatggtgtggaacaggtcgtgcaaggaggtagcccgtataccactgcgttctggcgtgattcgattactgttgttttgcgagtcgatggtaagagaggcgcattgcaccagcgcatatgccgcaagtccaagtccgcaagcgatggttgcgccgccgctgaagttgacctcgtcggatactgaatattcggtgacgaataccggcatcacgccaatctgccatacgaacaacagtcgcgcgattcgtatccaaccgttgctcagatatgaggtgactatggcgtgcaccagccacgtcaccgcatacatcgcccacaacgttacaatcttggtattcgcactcaacaccaatatgatcgcaacagccactgccgcaataagaacactaaacaccgaacagagccgatggcgcgaaaagccctgtactcccgcaacagtcagacagagaatcgcgacaacactcagcgcagtcaccgtcataaaccacagtggtgaggtgacgcaggctccataatcgtcagttgcttggcccgagagatagtaggtcattctgccaatcgccggacaattcggatgcaacatcatgccgccccaaatgcgctcatataatggcgcgaacgatacaccggcaccactgagcgtcgcaacaaccgccatcaccatggccggaatcagcccaagctcgcgattccggccggtttccgctatctgtctatcactggtgtccatgactcaccccaccttatgccgttatcgccgtcgtcgatgatgctagtataactatggcagatgggcggagaccagcggcatacaggaattctgtatgccgctttataggagggatactgcggcagccgccatcaccgaccgaccgccagactccggcacagaccgggaagaactaccgtcgcggagcatcggcgataccaatggcaacaccgaggatagccgggaccacccagccgagctggtattgctgcaaaggcagcatagccagcgccgcgtccagccagccgatggaaccgccgaagacggcgaccaaactggagatgcaggtggcgaaggatgcgatgcccaccagcagcacggtccagaagtagacgcgcgggaatcgcgcgccgagcgacttgtgggtcagcgtcagcagtaccagcacgatggcgatcggatacagtgcggacaacaccggcacggaaaccttgatgatcgcgcttagcccggcattggacacgatgaaactgaacacggtgaagatgacctgccaggtgcggtagctcaacgttcggccggcgacggtccggaaccgagtatggaagtaggtggcgcaggtgccgatcagtccggtgcatacgttgaggcaggcgatgacgaacacgatgccaaggaacgcggtaccgaacgtgccgaacagggatgaggtgaggttggtgagcacggtcgcgcccgtgtctttggtggggtcgatggtggcgatggcgccggacaccacgcccacgtagcttagcgcgccgtaaatcacgatcagcagtacgccggtgccgagcccggcatacgcggtctccttctgcacttgcgattcgtcatcgacttgttgggcgcggatattcgcagagatcacgatgccgaagtagagcgcggcgagcaggtccatggtctggtagccgtcgaggaagccgcgtgcgatctggtttgtggagtagtcgcccatcgggttggccggggtgccgatgccgtggatcaggcaggcgatgaacaggacagcaatgagcaccagcagcaacggtcccatgaatcggccgagcactttggagagtttctcgggatgctgggcaaacaggaacgccagcgtgaagaacacgagcgagtagatgagttgggccagccagccataggaggacggtacgaaaggagccaccatcatttcgaatgaggtggtcgccgtacgcggaatcgcaaagcacgggccgatggtgagcatgatcgccacgccgaggaacaaggcgaatttgggggagacccggctggcgagtttgtcgaaaccgccggcgaaggtgaccgccagcacgccgagaatcggcaggccgactgcggagacgatgaaaccgatggccgccggtatggtcgcggaaccggcctgcgcgccgacgaacggcggaaaaatcagattgcccgctccgaagaacatcgaaaagaaggtgaaggtcatcaccaaccgctggcgtgcgacaagtttgttcattacgattcggcctttctctcatatgctcgtaccactgtagcaacaaacgaaagaagccccgaccgttggggtcggggcttctgtgagctaatcaactagtgcgctaaacacgcatcagtcgtcaaatctcaggcgttcacgcggtcgatgccggactggacgtcagacagcacggaatcccaggacttgatgaaggcagcgacaccgtcggcctccagcttgtcggtgacgtccttgaggttgatgccgagctcagccagcttgttgatgatggcgtgggactcttcgtaggtgccctcgatggacggagcgccgttgccgtggtcggccagagcgttcagggtcttctccggcatggtgttgacgatgtgcttggcaacgagctcgtcaacgtacttgcagtcggagtaggcggcgttcttggtgccggtggaagcccacagcggacgctgaaccttggcgcccttggcagccaggtcggcccaacgcggatcctcggcgaacttcttctcgaagagttcgtaagccaggcgagcgttggccacagcggccttgccctccagagccttggcctcgtcggagccgttggcttccagcagcttgtcgacagcggtgtccacgcgggacacgaagaaggaagcgacggagccgatgtgcttcaggtcgtggccgttggcggcagcctgagcgatgccctcgatgtaagcgtcgatgacctgctcgtagcgctcgagcgagaagatcagggtgacgttcacggagatacccttggccagggtggcggtgatggccggcaggccttcgagggttgccggaatcttgatcatggcgttcgggcggttgaccttctcccagagttccacagcctgcttggcggtgttctcggtgtcgtgggccagacgcgggtcgacctcgatggagacgcggccgtcgacgaagtcggtagcctcagcgatctcgcggaagatgtcggtggcgttgcgcacgtcggtggtggtgagctcgcggacagcggtctcaacgtcaaccttgccgagctccttgagctgagcgtcgtacgggccgacctggctcagggccttctggaagatggacgggttggtggtcacaccgacgacgttcttgttggcgatgaggtcctgcagggagccggactcgatgcgggagcgggacaggtcgtccagccagatggaaacgccgttgtcagacgtacgctgagttgcttcagtcatttatttttctccttatattccgtattggaacaaatctttaagtagaccccctctaacgagagggccgatcaggtggagtcttgagtacaagcctccctcgtcagagggaggttaggggactcacttggcggcttcgacttcggcgatggagtccttggcggcttccaccacgtgctcggcggtgatgccgaggtcgatcatgttctgagcgccgtcgccctgcaggccgaactgctcgatggagacgggcttgccgtaggagccgaggtacttgtaccacggcatggcaacgccggcctcgacggagacacgagccttgacagcggccggaagcacggcctccttgtactcggcgtcctgctcctcgaaccattccatggacggcacggacacgacgcgagccttgacgccctcgccggccagggtcttggcggcagccacagcccactggacctcggaaccggaagccatgaggatgacgtccggagtgccctcggtgtcgaccagaacgtaagcgcccttcttgacaccgtccttggccttggcggcggtctcggcaagaaccgggacaccctgacgggtcagaaccatggcaccaggcagggtgttcttcttctcgaagaagtaacggtaagcctcggcggtctcgaaggcgtcggccgggcgaatgacctcaagctgaggaatcgcgcggaaggaagcaaggtgctcaaccggctggtgggtcgggccatcctcgccgacggcgacggagtcgtgggaccagatgtacaggttcggaatctccatgagggcggccagacgaacggcggaacgctcgtagtcggagaacatgaagaaggtgccgccgaacggacgggtgtgggagcccagcaggatgccgttggtgatgcagcccatggtgaactcgcgcacgccgaagtgcagctggcgaccgaactcgttgcagttcggccactgcttggtggcgcactcggccggggcgaaggtggcagcgcctttgagatcggtcttgttggagccaccgaggtcggcggagccgccccagagttccggcatgacagcggcgatggcgttgagcacggagccggaggcgccacgagtggcgacacccttgccgacttcgaaggtggcctcaaggtcgtcaagagccttgtcgaagccttccggcagttcaccggccttcagacggtcgtacagggcagccttgtccgggttggccttgcgccaagcgtcgaacttctcgtcccattccttgtgggcttcgagaccgcgctcggcaaccttgcgagcgtgagccagagcctcttcgtcaacgtggaagttctcttccggatcgtagccgagggcttccttgaggccggcaacagcctcggtacccagcttggaaccgtgggaggacgggtcgttggtcttgcccggggtcggccaagcgatcagggagtgaaccttgatgagcttcggctggtccggagcggccttctcggccttggcgatgacgtcagccaggccctcgatgtcctccttgtaggagccgtcgggctggatgaagctgaactcgtcggtgtaccagccgtaggcctggaagcgcttgagcacgtcctcggccagcaccaggttggtgtcgccttcgatctggatgcggttggcgtcgaagatcacggtcaggttgccgagcttctggttggcggccagggaagcggcctcgccggagatgccctcctcgatgtcgccttcaccgcagatggcccagatcttgtggtagaacggggaatcttccttcggggtctccgggtcaagcagaccgcgctggaaacgctcgccgtaggcaaagccgatggcggaggcgaagccttggcccagagggccggtggtcatttcgatgcccggggtcaggccgtactccgggtggcccggggtgcgggtggcagcgccgccacggaagttcttaaggtcgtccaaggtcacgccgtagccggagaagtacagctggacgtactgggtgagggaggcgtggccaccggaaaggatgaagcgatcgcggccttcccagttgggatcattcggatcgtgcttgatgaagtgctggtacagcgtgtaggcgacgggcgccagggagatgggggagccggggtggccggagcctgccttctcaaccgcgtcagccgaaaggaccttcgccatcttgatggcgcgctcgtcgagctcggtctccttgaattcggtcatggattactttccttccaattggtcgggccgcgtatccggcttgtgccgggcgcttgacgccctcacattgcgattaccatgctagcgtcggtttgcgacgttgtggtgcagttttggcgtgttttggtagtttgtgttctgttagcgttcacagtgaacattgctacgctgcaaacgaacgcattagcactcaagcctaaggagtgctaatacaatgttctagggtgaagtgcgccacctgcacgtggcggagccaagaaagaggcaatatttctgggttcccgcgtgtcgcggcgtggcgaaccgaccgtcggggtacgccctgagtgaaccgtgactgatatgaatatgtatgtatgtataaggaggcgcgcatgacgcaatcaaggcgcatgttggtgctgcgcgccgtggtggaggattacatccgttctcaggagcccgtgggctccacttcgctgacgcgtgaccatgatctcggcgtcagttcggccaccatccgtaacgacatggccgccctggaggacgaaggctatctgattcagccgcacacttcggccggtcgtgtgcccaccgaaaagggctatcgatactttgtggaccgacttgctaccgtggtgccgctcagcgaggcgcaacgccgcggtatcaacagcttcctatccggatcggtgagtctcaaggatgcgttgcaacgttcggcacgactgttgtccgaaatcaccggtcaagtggctgtagtcgcctcgccatcgctggccaaggccacattgcggcacgtggagatggtgcccgttgccatgaccacgttgctcgccgtggtgattaccgacaccggccgcgtggctcagcacggcctgaccatcgcatccatgcccgccgtggacgagatcaaccggctctccaacaccgtcaacgaacaatgcgacgggctgtccctatcgaaatccgcggagaccgtgcgatccatcgccgccagcgccggctacgagtcggtgcgtggcgtggccgacacgctggccgacgccttcgaatcgatggcattggacgaacatgcgaacgaactgtacatgtccggcacctcgcacctggcccactcccggtccctggccaatctggccccgctcttcgacgcgctggaagaacaggtcgtgctgatgaagctcatgagcaacctgagcgaggagacgaatgcatccggcgtgggcgtggccatcggctccgaaatgcacacccccggactactgcatgcttccgtggtcagcagtggctatgggcgcagcggagcggcgggcgaaccggcggggaacgatcccgtagacgaactcgaaaccgaatccgagacggagagccagacgaacgatacggaacccatcgccttcgttggctccatagggccgacccacatggactacgcggccactatggccgccgtcagggccgtagccagatatttgaccgccttcctctccgagggccggacccaagactgaccgccgtctgtggcacaatgacccgcagaccaaacgaacacaaaggatcaatcaagtggcagattattacgagacgctgggtgtggaacgcggcgccagtgacgacgagatcaagaaggcataccgcaagctcagccgtaagtaccaccccgacatcgcgggccccgaattcgaggacaagttcaaggaagtgaacaacgcctacgatgtgctgtccaatccggacaagcgtcgtatgtatgattcgggcgtcgacccgaacgatccgaacgccggtgccggcggcttctccggggcgggcttcggcgatatgagcgacgtgttctccacgttcttcggttccgcgttcggcggtggctcacagggcccggtgccgcgtacccagcccggccgcgacgccttggcctcggcgtccatcgatttgaagacggcggtgttcggcggcaccgcgcatgtcaagatcaatacgttctccctgtgtcaggagtgcggtggctccggtgcccagggcggcgcacagccggtcacctgccccgactgccacggacagggattcatgcagaaggtcgtgcgcaccatgctcggccagatgatgacctccgccccctgtgaacgttgcgaggggcacggtaccatcatccagaacccgtgccccagctgcatgggccacggccgtgtgcgcaccacgcgtaccgtgggcgttaccgtgcccgccggcatcaacgacaacgcgcgtctgcggttggccaaccagggcgaagtgggtgagggcggcggcgctgccggcgacctgtacatcgacatccgcatcaaggcggataagcagttcacccgtgatggcgacgacctgcactgctggattcaggtgccgatgagctgggccgtgctcggccacgatctgtccattgacacgttcgatggtgagaagaccgtgtccatcccggccggctgccagcctgaggatacggtgacgctgaagggactgggcgtcacgaacatccgcaacaaggacgagcgtggcaatctcatcgcccacgtcaatgtacttatccccaccaagctcaacgaaaccgagcgtggcctcatcgaacagttcgccgcctcgcacgattcaggcgccacgcacgtctcccaggcatcccgtccacaggccggtcaaaagaaaggtttcttcagcaagttgaaggacgcactgagctgagagcggatgcgttcttggctcccctcagagagggagccaagtctgttacttcagcatggagcggcacatggagcggtattcgttgacgtagccgccgccgaagaagacacagtggccggcgatggggtagagctgccagagcgtgatacgctcctgccatccggccttcaacggatgcacggactggtagccctcggtgatttcgctcagatagctcatgccgaacaggtgcagcatagccagatcctcctcgcgatgaccgccatgtgccgccgggtcgatgagcacagcctcgggctgcccggaatcggcggtccacatcacattgccgctccacagatcaccgtggatgcgcgccggcttgtcggacgcggctcggcccatcagatccggcaacgcttcaatcacgcgctcggtcagttcgacatcgcgcttatccagctcgccacgcctcacaccaaggttgaccatcgggcgcagacgtccatcagcgaaatagctgatcgggtcggtccactcgccggtatccattttcactgggtcctgcaatggtccgaaatagcatgtgccgttatatccgtcaggcgcagacccgaaatattcggcacccacatcatgcatatgggccagagccgcaccaaaagctcgtgccgcctgaggcgtgggggacgcgctgcccacacgttcgatatccagataatccttgccccagccgtatacctgcaccacgcgcgggccgccctgcgcatgagccgctcccaaccattcgagtcctcgaccctcgcattcgaagaatccttccggcgcgaatgccctgcttttgcgatacgtggccataatgctcccttcgtcgcttacgtactatatccactttcattgtagaagccgtggatgttaccgattcttagtgttgttctacacccccttggatagggtgttcatcgtcataacacatcaaatacttagaaatcacgaggggtcatgaattttttccaagcgatcattctcggcatcgttcaggcgctgaccgagtatctcccggtatcctccagcgcgcatatccgtattttcggcgatttgatgctgggctctgatcccggtgcggcgtttaccgccatcatccaaatcggcaccgaacttgcggtgattctgtatttccgtcacgacatcatcaatatccttactcactggttcagctgcctgttcggcaagaacggcaaggattggaaggcccgcatgggccgcggcgacaattacgccacactcggctggaacattatcgtcggctcgattccgattatcatcctcggcttcactctgcagaacgtcatcgagacctcgttgcgcaacctgtggattacggtaaccgtgctgttggtattcggcattctgctgtggatggtggatgccaaggctcgccagaacaaaaccatgaatgatatgacgtatcgtgatgcgttcctcttcggtttgggccagtccatggcgctgattcctggtgtgtcccgctccggcggcaccatcaccgtcggtcgcgcactgggctacacgcgtgaggccgctgtacgtctgagcttcctgatggccatccccgcggtgttcggctcaggtttgctcgaagccatcaaggccgtgaagaactacaaaaccgatgcgatgttccccggctgggggccgaccctcgtagccatggtcatcagcttcgtactcggctacatcgtgatcatcggattcctgaagttcgtatcgaacttctcctataaggccttcgccatctaccgcatcggtttggctgtggtcgtcgccttgctgctgattgtgggcgtgctgccggccatcgatccctccgtggtggctgcggcataagacgggtcgataggcgactcaatattaatggtgctcccgccggcgggagctgtcagcgaagctgactgagggtggtcactggaatatgccagcagaaccaccctcagtctcgctacgcgagccagctcccgtcagcgggatattgtgtatatagggctaattgcccatctggcgtagaaacgcttccgcttctttgactagttgttcagcctggggcgctcccaatgaagcctccgcctcggctttctgctgcaagtcgtagtcgtgctccaaatgctccacataatcatgaagctggtcattgcaacgaaccagtatcgatgcctgcgccttccactgttcggctttctgcttcaggtctgccgtatcgaagatgaagccgatatacttgcccaacgcatccagcaatcgtatagtgccggcagagcattcgtcgctgcccaaatattgggggatggacacccacatcgaggaatgagcaaatccttgttgtgcggcagctacatccagaacagtaggaatgcccaccgggccgttatacgaccggtctccttcgcattgacagtctccgtcgctgacggcgatgggcaacggacgggtatgcgggcaatcggagaacatcgaacctaacgtaatgatccgattgacatccagctcatcggcaatggccagactctggctacagtattccttccaccgatagtttggttcgggggcgatctgcgcatagatacgcttgcctgcgtccaacgtgatgtcgtagaacgtggtctgtggccagataagattggtgcgacccgaaacatggcacagcataggacgggcaacctgatagtcatagaaatcatcacatctaatatgacgaatctcgcgggactcatatcgcttgaccagatggcgcaccgcgttcgtcgccgcctgacaggcatcattccatccctcgaatgcggcgatcaatactgcgccggtgtccttcgctgcttcactcatacctctagagtaactggaattcattgcccgaagcgcacgctttagccataagcgagagtatgcaattacaggcgacacgccgcagctggacgaactacacgcatgtgagtatagtaaacactcgtgcttcggtagggagacctcgccaaggaaacacacgcggacatagcttagttggtaaagcgcaaccttgccaaggttgagaccgcgggttcgagtcccgttgtccgctctaggtccgtgagttgacagaccttacggtgggttagccaagcggttaggcagcggcctgcaaagccgtatagacgagttcgactctcgtacccacctctcagaccagcgaagcaattcaatgggatgaaatatgacccgggcggttggcgcagtggtagcgcacttccctgacacggaaggggtcacaagttcgaatcttgtatcgcccacgaaagtcgaagcaattcgactggatataactgaagaaccgagtattcgggcgattggcgcagcggctagcgcacttcgttcacaccgaaggggtcgtaggttcgattcctacatcgcccactggattccgcttctcacggcggattcctttgcggacatagcttagttggtaaagcgcaaccttgccaaggttgagaccgcgggttcgagtcccgttgtccgctccacaacgaaacctcgcttcggcgaggttttttcgtattggttcagatgctggtggtatttgtcgcacgcccaacctatcgtgtcctacgttgattaaccagtccaggcctgcacattagtaccgtgggccccgatagcaaaggacaaatcatggcgcaagctaccatctccataaccgtcaacggcgaagcgaaggaggtggaagcaaccaccaccggcgtagaactgttcgcggaagacaagaacatcatcgcggtcaagatcaacggcgagaaccgtgacctgtacacgccgctgaacgatggcgataccgtcgaccccatcgccctcgactccgaagacggcctcgcaatcatgcgtcactcggccacccacgtcatggcccaggccgtgcaggaagtctacccgaacgccaagctcggcgtcggccccgtcatcaaggacggcttctactacgacttccaggtcgaccagcccttcaccccgaacgacctcaaggacatcgagaagcgcatgcagcgcatcatcaagtcctcccagtccttccgccgtcgttccgtgaccgaggaagaggctctgaaggaagaggccgaccagccctttaagatcgaactgatcgaagacaaggaagcacacctcgacccggccgccgccaccgagatctccgaaaaggagctcagcttctacgacaacgtagaccgtgatggcaatgtggtttggaaggacctgtgccgcggcccgcacctgccgaacacccgctacatcaaggccttcaagatcgagcgttccgccgccgcctactggcgtggttccgagaagaacccgaccatgcagcgcgtctacggcaccgcatgggccaccaaggaagacctcaaggcctaccagacccgcctggaagaagccgccaagcgcgatcaccgcaagctcggcgccgagatggacctgttctccttcccggatgaaattggccccggcctggccgtgttccacccgaagggtgccgccgtgatcaacgctatggaggactactcccgtgagatgcaccgcaagcaccactacagcttcgtgcagaccccgcacatcaccaagggcggcctgtacgagacctccggccacctgcactggtacaaggacggcatgtacccgcccatgcacctcgacgaggagaaggacgcggacggcaacatcaccaagccgggcgccgactactacctcaagccgatgaactgcccgatgcacaacctcatcttcaagtcgcgtcagcgctcctaccgtgagctgccgctgcgcctcttcgagttcggcaccgtgtaccgctacgagaagtccggcgaggtccacggcctgacccgcgtgcgcggcctcacccaggacgactcccacatctactgcacccgcgagcagatgaaggacgagctcaccagcctgctcaccttcgtgctgaacctgctcaaggactttggcctgaccgacttctacctcgagctgtccaccaaggacccgaacaagtacgtcggctccgacgagatctgggaggaggccaccaacacgctcgccgaggtcgccaaggaatccaacctcgagctcgtcgacgatccgtgcggcgccgccttctacggcccgaagatctccgtgcaggcccgcgacgccatcggccgcacctggcaggtctcgaccatccagctcgacttcaacctgccggagcgcttccagctcgagtacatcgcgaaggacggcacccaccagcgcccggtgatgattcaccgcgccctgttcggctccatcgaacgcttcttcgccgtgctgctcgagcactacgcaggtgccttcccggcgtggctggcccccgtgcaggtgctcggcgtgccggttgccgacgagtttgccccgcatctggccggcttcgtcaagtcccttgaagatgagatggtccgttgcgagatcgactactccgacgatcgcttcggcaagaagattcgcaacgcctccaagtccaaggtgccgttcatcctcatcgtcggtgaggaagacatgaacaacaacgcggtcagcttccgcttccgcgacggcagccagctcaacggtgtgccggtggacactgctcgcgagcagattctcaccgtcatcaagaagcgcgtccaggtgaactccgccgacgacttcaacgctgctgtggctgagtgatgtgaatggtactggctcccctctctgaggggagctgacgccgtaggcgactgaggggagtcctgcatggctcgcactcccttcagtccgtttcacggacagctcccctcagagaggggagccaagaaagggtgcgaaaatgactgacgtgcgtgtcgataatccggcggactttccgcctcaggaggacacggtcgaacgactgtggactccgcagcgcatgacctatgtgctgcgcaacagcgaggatcgcccaaccaagcccaagacgaaggaatgcccgttctgcgccggacccaaaaaatccgacgaagacggcctcatcgcctggcgtggcacgcacgtgttcgccatcatgaacctctacccatacaatgtcgggcatctcatgatttgcccgtaccgtcacgtcggattcatcaccgaactcgacgatgccgaactgttcgaattcgagaaggccaccaccctcgccatgaaggtgatggagaccgtctcccgtccggacggatacaacatcggcatcaatcagggcgaggtcgcgggtgccggagtcgccgcgcacctgcaccagcatgtggtgccgcgttggaatggcgatgcgaacttcatgcccatcgtcgcccagacgcgtaccatgccgattctgctgtccgaccagcgagacgcctatgcccaggcattcgaacagctggccccgcagtatcatttgccgcttgcctgaccgggtgcggcacccgcgcaaccggttttatcggtacgcgcaataagacaatcatcggaaacattacgggtatgtctgattaacggcctacaatcgtttcgtttgacatcatccgtttcaataattgctaggagcattatgtcaggtcattccaagtgggcgaccaccaagcacaagaaggccgccatcgacgccaagcgcggcaagctcttcgccaagctcatcaagaacatcgaaatcgccgcccgcctcggcggcggcgacccggacggcaacccgtccctgtacgatgccatctacaaggccaagaaggcctccatgccggccgacaacatcgctcgcgccgtcaagcgtggtgccggtgctgaagatggtgccgccaactacgaagacatcgtctacgagggctacgctcctgccggcgttggcctcatcatcgaatgcctgaccgacaaccgcaaccgtgcggccgccgaagtccgttccaccctgaccaagggcaacggctctctggccacctccggctccgtgtccttcaacttcgagcgcaagggccagattgtggtgccgtccgagggcgtggacttcgacaagctgttcgaaaccgccgccgaagccggtgccgaggacgttaccgatgacggtgaagtgttcaccgttgtgaccggtccgtccgacctgttcaccgtgcgcaaggctctgcaggaagccggcttcgactacgattccgccgaccaggtcatgcagccgaagaacgaggtcgagttgagccttgaggatgcccgcaaggtgtccaagctcatcgacaacctcgatgacctcgacgatgtgcagaacatctactccaactggaccgcttccgacgaggtgatggcccagctcgacgaggagtaatcctcgtgattatccttggcgtcgaccccgggctcacacgttgcggggtcggcgtgatcgaagccggcgagcaccgccggctttcgtttattcacgtggacgtggtgcggtcctcaccggatatcacccaggatctgcgtctactggccatctacaacggcctgtccgagaaaatggaccgattcgcgccggacgcggtatctatcgagcgtgtgttcgcccaatccaaccgcaacaccgtactcggtaccgcacaggccgccggcctcgccatgctcgccgccgcgcaacgcaatattcccgtggcgttgcatacgcctaccgaagccaagctggctatcaccggtaacgggcaggcgcagaagattcaggtggagcgtatggtgacacgtattttgaacctcaccaaaatgccgactcccgccgatgccgccgatgccttggctttggccatttgccatgcgctgcgcccggcaggcgcattgcagggcggcgaacgcgaacaacatctgaccgccgcgcaacgccagtgggctgaggccgcacagaactccacgcgccgccgcatcaaccacgaccgaggcatgtagtatactttcgaacagttgttcgagtcttgaatcctggagcgctgaaggagtacctgtatgatcggcatgctgaccgggcgggttgaatcagtcgaaaccgataccgcattgattgatgttgggggagtgggctacgaagtgcgcatgtccgccaccgacctgagccgtctgcacgccgggcaagacacccgcgtcttcacctatatgaacctctctcaggatgccattaccctgcatggattcctggatcgggacgccaagaaaaccttcctacaactcatcaaggtctccggcattgggcctaaagtggcccaatcgttactctccacactgacgccgagtcagttggcccacgccatcgccgacaacgacgccaccgcgctggccaaggctccggggctgggtaagaagggcgcacagaagatcatcctcgagcttaagggctctattgatttgagtcagatcgagggtgcttccgctcaggcggcaacatccaagtctccggtggataccggtacggaacaggttgtcgaaggactgatttcgcttggctggcgtcagcaggacgcccagcaggccgttgccgaggcttgcgccgaaaacgacattcccacgccgcttgccaccgacgatgtgccgcgtgtgctacgtctggctttggcgctgatggataggggccgctgatgagcgagacaacggattacggagcctccaacaccggtgccaacgaagagtcgctgcgcatggtctcctcccagccgatcggcaacgagccggtcagcgacgaggagctgcgcccccatgttctcggaggctttatcggacagccacggctcaaggcccagctgcaactgttcctggacgcggcccgcaaacgcgatgtgccaccggaccatattctgctcgccggccctcctggcttgggcaaaaccacgttggccatgatcgttgccaatgagcttgaagtgccgattcgcgtgacttccggccctgcggttcagcatgccggtgatcttgcttcgattctgagctccctcgacgtcggcgaagtgctgttcatcgacgagatccatcgtctgccgcgcgccgccgaagagctgctgtatatcgcgatggaggacttccgcgtcgatgtgatggtcggcaaaggcccgggcgcaagctccatcccgctgaccctgccgcgattcaccgtcatcggtgctaccacgcgcgaaggtatgctgccaagcccgttgcgcgcacgcttcggcttcaccgcacatctcgacttctatccgcacgaggagctggaaaagctcatcgaacgttcggccaacgtactgggcgtaaaccttgatacgggttccgctcatgagcttgcgttgcgttcgcgcggcacgccgcgtatcgccaaccgattgctacgccgtgtacgcgactgggccatcgtccacgacctgattgtggtgcggccggacgacgtcaaggaggcgctggccctgtaccagatcgactccgaaggcctcgaccggctggacatcgccgtgctcaatgccatcgtgcgcaacttcaacggtggacccgtgggcctgaacaatctggcggccatggtgggcgaggaatcggaaaccgtggaaaccgtgtgcgagccgtatctcgtgcgcgaaggttttatgattcgcacgcccaaaggccgtgtggctaccgagaaggcatggcagcatttggggattacgcccaaagatgatgtcagcaagctcttctagactttctcctgtttgcacactcggcagcgtttcgtcaatgtcgctcgtttgaaggagttgtttcgtggaacagtacattatgctcatcgtgatcgtcgtcgtgttcggcggcatgatgtggtggcagtccaagaaggccaagcagcaacagcaggagaagcaggacttccgtcgcaatctgcagcccggcaccgaggtcatcaccatcggccaggtgatcggcaaggtcgtcgaagtcgacgagcagtatgaggagatcgtcatcgactccgaaggctccaagctgcgtttcggcttcaatgccatcgcccgtgagtacatccgcccggcctatgtgtccgatgatgaggtcgacgagaacggcaacccgctgcccgacgaagacaccgaggctccggctaacgatgaggctggtcaggttccgatcgaggcgtccgtcgtgtccgaggaagacaccgctgacgagaccggtgacgacaacgaaaccaagacgaagtaagctgttcgattcggtagcaccatccgcgtatcgcatcgcaaaggcataaaaggggcgagcactatggcacagtcggacatcaccatcgacgcattgagcaaggtagggcaacaggacgccgaatatctggtgtccttggtgcgttccgtaccggggtttcccaaggaaggcatcatcttccgtgatttcatgccagtgctcgccgaccccaagggcttgaagattctgctcaaagcacttgaagaggccctgccggtgtccccgagcgaattcgactccattgccggtctcgaatcgcgcgggttcctgttcggcccggccatggccgcccatttgggcaagggtttcatcgccgtgcgtaaggccggcaagttgccgcctgaaaccatcggtgaatcctatgacctcgaatacggcacggccagtgtcgaaatcgaaaccgacgccgtacaggcagggaagcgagtgctcatcgtcgatgacctcatcgccacgggcggcaccgccaaagccgccaccgaccttatcgaaaaggccggtggcaccgtggtgggcttcagtttcgtgatgcggctcgatggcctcgacggtctggataagctcgacggcaagcccagcagctcgctgatcgcgatgccggcctgagatttcgtctcacccaacgtacagtcagttttcaaggtccggcatgtactgtgtacagttacatgccggaccaattacatagtcagggaaggatcgatggatctttacgaataccaggcgcgtcagctgctcgaggaacaggacattcccaccccggacgccatctttgcccagaactcccatgaagtcgctgaagcggcggacaaaatcggctatccctgcgtaatcaaggcgcaggtcaagatcggtcatcgtggtcaggccggcggcgtcaagatcgcccataaccgcgacgaggcgattcttgaatccgagtccatcctgccgatgaccatccacgggcacaaggtttccggcgtgcttgtagccgaagccaagaacatcctgcacgaatactacgtgtccatctccgtggaccgcacctcgcgcgacttcgacgtgctggccaccgctaacggcggcaccgaagtcgaggaaatcgccaaggaacatccggaggccgtcaagcgcctgcacatcgatgcgctcggtgacttcgacctggccgctgccaccgaaatggcacagagcatcggcttctaccacgcggacgtcgatcaggccgcacagattctgctcaagatgtggcgctgcttcaaagacaacgacgccacgctcgtggaaatcaatccgctcgccaagatcggcgacccggatgacgaatccaccaagcagctgagcgccttggacgccaagatctccttggatgacaacgcctccttccgccatgacggctgggcgcgtttcgtggatcccatcgttcccgaccccttcgaacagcgcgcccgcgaacacggcctgcactacgtgcacctgcacggcgaggtcggtgtgatcggcaacggtgcaggactcgtcatgagttccctggatgccgtctccggcgctggcgaggaacagggcaccaacatcaagcccgccaacttcctggacatcggcggcggcgcctccgcagccgtcatggccgaaagcctggagatcgtactgtccgaccctcaggtcgaatccgtgttcatcaatgtctatggcggcatcacctcctgcgtggaagtcgccaacggcatcctcgaagcggtcgccaagctcggcggttccaagccgatcgttgtgcgcttcgatggcaacgccgccgccgagggtctgcatatcctcgcctccgccaataacccgaatatccatgtgtccgaaaccatggaaggcgcggcagccaaggccgcgcagctcgccggtgaggcgacccagtccaaggaggttcgctgatgctgttcatcgaagacggcgctcccgttatcgtccagggcatgaccggccatcagggcatgacccatacggctcgcatgctcaaggccggcaccaatatcgtcggcggcgtgaacccgcgcaaggccggcacatccgtcaccttccccggtgccaagaacggtgccgacgcggacatccccgtgttcgccacctgcggcgaagcacgtgaagccaccggcgccaaggccagcgtggtgttcgtgccgccgaagttcgccaagtccgccgtggtcgaagccgtcgaagccggcatcgaactcatcgtggtcatcactgaaggcattccggtggccgattccgcatacttcgtcgaactggcgctcaagaagggcgtgcgcatcatcggaccgaactgccctggtctcatcacgctcggcaaccccggcgtcaatctgggcatcatccccgacggcatcgtcggccgcggcccgctcggactggtctccaaatccggcaccctcacctaccagctcatgggcgaattgtccgatatcggcttcaccgcatgtctcggcgccggcggcgacccgatcgtcggcacgacgctgctggaagccctgcaggcattcgaagccgaccccgacaccaaggctgtcatgatgatcggcgaaatcggcggcttcgccgaacaggacgccgccgcatgggccaaggagcacatgaccaagccggttgtcgcctacatcgccggtttcaccgcccccgaaggcaagcagatgggccacgccggcgccatcgtctccggaggcaagggcaccgcccaggacaagaagaacgcgctcgaggcggcgggcatccccgtgggcaagaccccgggccaggccgccgaaatcatgcgtgacgtactcgccaaggccaacatcgactgatcggttccaaccaatcgtgatgaaagccgtgattcgccaatgggtgcggggagccatagtcgccctcgcatccatggccatctatgccgttgcattaggctgctatacagcgctgatgttattggtcgtctctatggaagagggcggcgacaatctcaccgtcggcacaacctcgctgacacaggccgttgtgcttctgagtgagggatcgggctttagaaccgattcgttcaccctcaccattacgccattgctgttgaccatactgctgatatggctgatcaatgcactcatcatgcgaatcaaagcatacgggccgcatgcgtatgttgccggattgattgtttggctcgggttgaacgaggcattccggcaatccgtgcacctaggtcttgtcgatgaccagtggctggtgttgctgaaagcagccatcgtattctcgatcggtttcctatgcgcagccgtaccggaatcagccaaaatgcgagcattcagggactggactcgcaagcaggtgccggcggacatacgccactgcctgaaaatcggcgtcgccttggccgtcgcgatactgagcatatatctggcaattggattgattaccgtcatcgtatggtcggtacgcaaccatgccgctgtcgtatcgttgttcgaattgtccgggatggaaaccggttcacgaattctcaccaccgtcgccatgctgatctggctacccaacgtcatgctctgggctgtttcctggctcttcggcggcggattcgccatcggtgatttggccagtttcacattatggctcggccaatccaaagagcttcctgcaattccggtattcggtattctgcccgaaccggtcagcagtgaactatggcgtaccgttgccttgaacgcgcctctcgccatcgctgcgctcgtgggcctgctggctgtattcctaccgcaaggattcgcctgcagaccgttgaatgtacggaatacgtccacccgcggcccggtactggtttcgctgatctactccgccggggcattctgcctgagcgcgatgctgatctcactggcatccacattgctgttcgctctgtccaatggatcgcttggcgatcatcgtcttgctcacataggcgtcgacgtcatggcctccaccagagtcgtcggtcattcgaccgcactgggacttaccgcggcatggctgctcgcgctgattggcatagcgctcgtttttccgatagtctggttggttgagagaatcaaggattcccgcaccaccgccacgacctcgaagaccgccaccgttcatcaggcgcggttcctagcgtcacaaccacaagaatccaaggaggaacaggatgacaaacacgaaccgaccgatacgtcgagcactggtctcggtctttcataaggaaggcatcgaagtactcgcggaagcgttcgtgaaggccggcaccgaagttgtttccactggttcgaccgccaagaagcttgccgaactgggcgtcaaggtaaccgaggtgtccgatgtcaccggattccccgaatgcctcgacggccgcgtcaagacgctgcacccgtacattcacgccggcattctggctgatatgaccaaccccgagcacgccaagcagctcgaggagttcggcatcaagccgttcgacctggtggtcgtcaacctgtacccgttcgccgacaccgtgcgctccggcgccaacgaggccgataccatcgagaagatcgacatcggcggtccctccatggtgcgcggcgcggccaagaaccacgccaccgtggccatcgtcaccgacccggccgattatgcactggtcgcctcccgcgtggccgacggcaccggcttctccttggacgagcgcaagtggcttgccgccaaggccttcgcgcacaccgccgcctatgacgccaccatcaacgagtggaccgccaagcactggcccaagccggcctctctggacgccgtcgaggtggacaaggacgatcagggcactgaagtcgattccgccaagttcccggcccagttcacccgcacctgggatcgtgcgcacaccctgcgctacggcgagaactcccaccagcaggccgccctctacatcgacccgctcaaccagaccggtttcgcccacgccgagcagctcggcggcaagccgatgagctacaacaactacgtggacgcggacgccgcctggcgcaccgtatgggatatggctcccgccattgccgtggccgtagtcaagcacaacaatccgtgcggtctggccatcggcgcgaccgcggccgaggcccacaagaaggctcacgcctgcgacccgatgagcgcctacggcggtgtgatcgcctgcaactccaaggtcacccttgagatggccgaaagcgtgcgcccgattttcaccgaagtcatcgtcgcccccgactatgagccggccgcgctcgaactgctgcagaccaagaagaagaacctgcgcatcctcgaggtggccgagccgccgaagggccacgaggccatccgccagatcgatggcggcctgcttgtgcaggacactgatctgatcaacgccgtcggcgacgatccggacgcctggaagctcgtggccggcgaggccgccgacgctgacacgctgaaggacctcgtgttcgcatggcgtgcaatccgctgcgtgaagtccaacgccatcctgctggcccacgaccaggccacggttggcatcggcatgggccaagtcaaccgcgtggactcctgccatttggccgtcgagcgcgccaacacgctggccgatggtgccgatcgcgccaccggtgcggtcgcggcatccgatgcgttcttcccgttcgccgatggtgcccaggtgcttatcgacgcgggcgtcaaggccatcgtgcagcctggcggctccatccgcgatgaggaggtcatcgaagcggccaagaaggccggcgtgaccatgtacctcaccggcacccgccacttcttccactgatcgggactctctgaggggagcagctcagccaaaacgcacaaaggtgggattccgcctgacccgtcaacgggtccaagcggaatcccacctttgctattcgcctgctattgtggtcacgtaaccgttcgacagaaggaatcgcaacatgcacaaccatccctatgtatccgaagcacatgagggcaagccatggtttgaatggtgcgtactcggcgtcgtcgccgtcatcacactgctggttgctttcggatatacgatggccgccacggtcatacttgccgtgacggccatcatcaccgggcttgttcgcctgattcttcaggacagaagcccatggaaagtgcgctcagtggcgttcgactccttcatcggcatcgccttgggaatcggcctgctgattacctacttcagcttctttggactcttcggcaacatctttttccgctgaatcgccatcagacgaggcggcctgatcgaagaattcgccatcgtcgagcgtgtccgcgtttgcatcggcatccgtctgcggaagatcggcggcagccggcactttgggagtggtcatcatctgcgcgatgatcatgaccaacgccaccacagcggcggccaagaccgggctaatccagaatacccacagctgctgcagcggattttgcgtaagaccctcattcatcgcggccagtgcgatgccggtggaacgggcgggattgagaccggcaccggtaaccgggtagctgatggcggtggccagaccataggcaagacccatggcaatgacatgacggtccgaggactcgccgtgatcacccagagaagacatggcggtggcaacgacaatcagagaggcaacgacctcgacgacaatcgccagcgtaatcgagaacgtaatgccatactgggtcagcagcgagtaagacacggagccgttttcgaaaccgttaacggccggagtcagccacactttggcagctacctgctcggatgtgggcagcagcttgaccacggcgaagccggcggcgatggcaccgatgacctgagcgatcacatagaggatgccatccaggattttcgtcttggaaaccagcacggaggctacggtgatggccggattcagctggccaccggacacgcgggagaagatggcggtgactgcggcatatgccaagccggtagccaacgcgaagaacacgatattgatgccatacacggccgaaccccatgtggagaaggcgtaaatggcaaagcacagcaggaagctgccggccaattcggcgcacacgcgcagagccagcggctgttgcttggtttcttccatgattgttcattccttttcatctgttggaagacgggcgaacccgcacaaacggttgccagtctagcagcagtcctacgttgcggtatgatatataggttggaattgactgggattccagtccgccaactctgaagtatgtatacaaatcgacagtctctgcgatgacagaatctgtccggccacgttgggagaacgatgccaaacgcatattcccgcgctgcgaaagcgcaagacgattccaattccattcgactccagaagctgcttgcccaagcgggattcggttcccgccgcaagtgcgaggacatgatcaccgaaggccgtgtcgaggtcgacggtgaactggtcaccgagctcggaactcgcgttgaccctcataagcagcaggtgcgcgtagacggttcgcgcgtacgcgtcaatccgaaccacgtcactctggcgctgaacaagccccgcaaggtgctctccgccatggacgacccgaagggccgctacacgctgcgcgacatcgtgggcgacaagtacgagcgcatcttccacatgggccgtctcgactacgattccgagggtcttatcctcatgacgaacgacggcgagctctcgcagcacgtcatgcaccccaagtacgaggtcgagaagacctacgtcgccacactggaaggcaagatctccggcaccgtgtgccgtcgactcgtgaccaccggcgtgcagctcgacgacggctggatcaagctcgaccactgcgcgatcatcgactcctcgcgtgaccacacgatggtcaaggtcgtgctgcactccggcaagaaccgcatcgtgcgccgtatcttcggctcaatcggcttcccggtcaagcgcttggtgcgcacccagatcggcccgatcaagctcggtgatttgaagcccggttcctaccgcgtgctgtcccagacggaagtccgttcgctgtccaaggaggttggtctgtgattcgcgttgccatcgacggccccgccggcgtgggcaagtcgtccacgtccaaggcgctggccaagtatttcggatacgcctaccttgacacgggcgcgatgtatcgtgcctgcgcttggtggtgtctgaagcaggacatcgatctggacgccgaaaccgtggatgagcgtgtcatcaccgaagcggtgggcgagttcttcaccggcgaccatttcgatatctccgtggacccggacaacccccgcgtattcgccgacgacgaggacatctccgaggccattcgttcctccgaagtctccagccatgtctccaaggtgtcgaacgtcatcccggtgcgcaacgtgctcatcgccgcccagcgcgcctacatcgcccgcgaagcgtcggccgactccttctccgggggtttgggcatcgtggccgagggccgcgatatcaccaccgtggtgtccccggacgccgaggtgcgcgtgctgctgaccgcccgtgaggaggtccgtcaggcccgtcgcaccggccaagccgtcaagggcgtgggtgctgaggatgtggctgcgcgcgacaaggccgattccaaggtcaccagcttcctgaccgccgccgatggcgttactaccatcgacaattccgatttggacttcgcccacacgctcgatctgctcatcggtctggtcgaggacgccatcgagaaccaggagtacgagcagtatgccgccaatctcgaaggctatgagctggacgaaggcgatgaggatctgatttccggccgcggtttcacggaaggcgcgcgcaaggccggccccaagccggtgggtgtgctgactgttgtaggccgtccgaacgtgggcaaatcatccctggtcaaccgtatcctcggccgccgtgccgccgttgtggaagacacgccgggcgttacgcgagaccgtgtgagctatgacgcggaatgggccggcaccgacttcaagctggtggacacgggcggctgggaagccgacgtggaaggcattgaatccgccatcgcctcacaggcacaggttgccgtgaccttggccgatgctgtgatattcgttgtcgatggtcaagtgggcatgaccaccaccgatgagcgcatcgtcaagatgctgcgtgccgccggcaagccggtcgtgctggccgtcaacaagatcgacgaccaggccagcgaataccttgccgccgaattttggaagctcggtctcggcgaaccatactcgatttccgccatgcacggcaggggagtgggcgacctgctggacgtcgcgctcgacaagctcaagcaggccgagaagacttccggctacctcacgccttccggcctgcgccgcgtggctctggtgggccgcccgaacgtaggcaagtcgtctctgctcaatcagctggcgcgcgaagaacgtgccgtggtcaacgatttggccggcactacgcgcgaccccgtcgacgaaatcgtcaacatcgatggcgaggactggctgttcatcgacacggccggcatcaagcgacgccagcacaagctcacaggcgcggaatattattcctctctgcgcacgcaggccgccatcgagcgctgtgaattggcgctgatcctgtttgatgcttcgcagccggtatccgatcaggatttgaaggtcatgtccacagccgtggatgcgggccgtgcgatcgtgctcgtgttcaataagtgggatgcgatggacgagttcgacaagcagcgtctcgaacgcctgtggaacaccgaattcgaccgtgtgatgtgggccgagcgtgtgaatctgtccgccaagaccggctggcacaccaaccgtctgacgcgagccatggataaggccttggaatcctgggatcagcgtattcctacaggcaagctcaacgccttcctcggcaaaattcaggccgcccacccgcacccgttgcgtggtggcaagcagccgcgaatcctcttcgccacgcaggcatccacgcgcccgccgcgtttcgtgatcttcgccaccggcttcctcgagcacggctaccgccgctacatcgagcgttccctgcgcgaggaattcggcttcgaaggcacgccgattcagatctccgtgaacatccgcgagaagaagaagcggaagtgacacgcgcgtaatttgccagatttcaaatatctggtaaattatctactcggtgcttttgcaccatcgggccgtagcgcagtttggtagcgcacttgactgggggtcaaggggtcgcgggttcaaatcccgccggcccgaccgattagccccggaattctgccacttttgagtggttgtcttccggggtttttccgttttcagacaatatgagacaacatgacgacggacttacctttgtaagccattcgtaatgaattatcaccgacaattcaccgcctccgcacccccgtcgtatgcgtttgccccaaacaggggctagactggttcctattgatttgacgaaagggacccgaattgacagaaataaacgataaggcccaactggatatcgccgccgctgacgacaccgacgccgttacctcggacacccccgaagaaaccgtaaacacccccgaagtggatgagactttcgagctttcggccgccaagatgcgcgagcatggcatgagcgaaaccgccatcaaccagttccaccatttgtatgacgtatggcgccatgaagaagcctccagctggattcgcgaggacgacatcgagccgcttggccacgtgcccagcttccacgacgtctatgagaccatcaaccacgacaaggccgtggacgccttcgccaagaccgcattcctcaagctcaatggcggtctgggcacctccatgggattagacaaggccaagtcgctgttgccggtgcgtaggcacaaggccaagcagatgcgcttcatcgacatcatcatcggtcaggtgcttaccgctcgcacacgcctgaacgtcgaactgccgctgacgttcatgaactccttccacacttcggcggacacgatgaaggtgctcaagcatcatcgcaagttcagtcagcatgacgtgccgatggaaatcatccagcatcaggaacccaagctcgtggccgccaccggcgaacctgtgagctaccctgcgaacccggagctggaatggtgcccgcccggccacggcgacctgttctccaccatctgggagtctggtctgcttgacgtattggaggagcgcggcttcaagtatctgttcatctccaattccgacaatctcggtgcgcgcccctcgcgtacgttggcccagcacttcgaaaacacaggtgccccgtttatggctgaagtggccatccgcaccaaggccgatcgcaagggcggccatattgtacgagacaaggccactggtcgcctaatactgcgtgaaatgagccaggtccatccggacgataaggaagcggcccaagacatcaccaagcatccttacttcaacaccaactcaatctgggttcgcatcgacgctttgaaagacaagctcgccgaatgcgatggtgtgttgccgttgccggtgattcgtaacaaaaagaccgtgaatcccacggacccggattccgaacaggtgattcagctggaaaccgccatgggcgccgcaatcggtctgttcaacggttctatctgcgtccaagtggatcgtatgcgcttccttccggtgaaaaccaccaatgatttgttcattatgcgttccgatcgattccacctgacggacacgtatgagatggaagacggcaattacatcttcccgaacgtcgaacttgatccgcgatactacaagaacatccacgatttcgacgaacggttcccctacgccgtgccatctttggccgcagccaactcggtttccattcagggcgactggacattcggacgtgacgtcatgatgttcgccgacgccaaactggaagataaaggcgagccaagctatgtgccgaacggcgaatacgttggtccgcaaggcatcgaaccggacgattgggtgtgatttacaacacggtcgaacgataaaaaagatattatttttgtgaaatggcgctcaagtgcggaaaaagcctctaagatagagtgagtgtggggaaactcatacgcacttataacgaaacagtaactatacgtgaggactaatggcagagggcacaagcggacgtcggcgtttttccgacaaatggggcaagcacgagctggacgtactggctgtgttgtcatccgcgttcccgcaatggctcacatcccgccaaattgcgcagcgcgtcaaggcttacgccgactcgtatggagagctggcagatcaggccgccaaggccgcgttcgccaagcagttccagcgtgatcgcgccaagctcgccgctatgggcatcgccatcgaatcacggcagcctgagtattcgtccaagtcggaaggccaggacttcgcgtcctaccgtctgcagttgggcgacgaaccgcgcgtccgtctgatgttcgagccggaagatatgccggtgcttgccgccgccaactatctggctcgttcgatgtcgatttcctccgagccggatcagtcccagctcgcccaacatgcgtcgcgcaccacgccgcgtgtgccgcagacccctattcccggtctcggtttggattcgattgcgcctggcttgggcacgcagcccattccggactcgctggtcaaggttatcgattcgcgtcgctttgccgccaccgttgatgtggacggcgaacacctgaacgtggcctacaccgattccgacgatttggccatgtttgtgctggagcatccgggtgccacgattgtcagcccgcaggaggctgtggacgcctatcatcgccgcctgcacgccgccagccgattcactctggctgacgaatccgccagccctgtaagcgcctcggtggtttccccgtcgattagtcgcgatgttcgtgagccgggtgatcccgagtcgatcaaggcccagaacaagaagaacggccccgctttccaaacgggcagcgaggtggatcgtcgcctgcgtctgatgctgttcctctccgctcacctgggtgaggaattctcgatgagcgagctggccgagcgctttatcggcaaaccgaagaacgacgacgagctcaagaaattcgtcaacatcattcataaggacatcaacaccctgaccaccgtttccgacgatggtgagatggctggcagccagttcttcgatatcgactggccgctgctggatgccgagggtattgtttccgccaccaattcgttgggccttgaacgtcttgccggcatttcgccgcaatacctcagcatgctcaccgcctcggtcagctacttggcgcattcgccgttactgccggacaagcagcgtgggcaggccgaatccctgtatgagcgtttgcgccgccatgtcagcccgggccagaccccgtggctgagcctgaccggctatgagctggagccccgaagcttctccatcgtcaagcgcgcgatcaacaccgattcgctgttggacatggagtactccgacggtaccggtagtacccgtcgcaagctggtggcccccgccaagattttcatcgacgaaggcgtgtattatgccgccgtctacacggatgtcggttccgccgcccctaaggacaagaaggcctacgtctccaaagacaagaccatcgacaaggcgaacggcaagccgcgcatctggcaggtgctgcgcttggcccgtatcgaaaaggcggaactggtcaagcccaccaagcagatcaacatcccgaacatgccggtgagcgaactgcgcaagtggagtttcgacaacggtaccgacgcggtgttcatcaccgatcagcgcgatctggcattcatcaagacattgccgggcgctaccgtcgaacaatgcggtgccggtgaaaaggtgcatctgaccgtttcctccgactcctggttcgtggccttctgcatcgcacacgcgcgtcatatcacggcggtcgccccggaaacgttgcgcaccatgatcgtggcacgcgccgaacgcgaactgagcatcagcgagaacaagtaaggagcctttcatgccttggtggatatggctgattctggccctgttcatgctggccatgattgttgccggactcatctatgcagcccttcatggaatccgtgccctgaaagacatgtccgacatcggcggccagctcggtgaacgcgtggccgcgatgggggagtctggcacctctgccgacaccagcgagccgcctctgttcactcagccgctcagcgtggcacagaatcgttatgccgaggcccatgcggacgtgattcgcagcaaggccgccaagcgcgaacgccacacccaggcatgggcccgctggaagcgattcaacaactaacggaaagcagcaatggcacgtcaccaacaccataagggcaatgccgattcccagacgctgagcccttcgcagcggtacgcatcattccaaaaagtccagcgccatcgggcgtccgcagcagcgcgattcgccgaatccctgcccttcgaactggacgacttccagaccgaagccaatgacgcgctcgaagccggcagcaacgtactggtcgcggccccaaccggtgccggcaaaaccgtagtggcggattttgccatttatctcgcccaggaacgcaacgtcaaagccttctataccacaccgatcaaagcgctgagcaatcagaaataccatgatctggtcgacgtgtacggcccggacaaggtaggcctgctcaccggcgacacctcgatcaactccgaggcggacatcgtggtcatgaccaccgaagtgctgcgcaacatgctctacgagcgttccaccacgctgaacgcactgcgctacgtgattctcgacgaagtgcactatctggccgaccggttccgcgggcccgtgtgggaggaagtcatcatccacctgcccaagacggtcaagatcgtcggcctgtccgctaccgtgtccaacgtggaggatttctccaactggattgcctcggtgcgaggcgacaccaaactggtgatcagcgaacaccgccccgtgcctttggaacagcacgtcatcgtgcaggcggacgaacacaccgagcctgaggtgctggatctctatcgccgcgacggcaacggcgagcagaccaccaagctcaacgccgaactcatcaaccggctcgaccagttggaccgcaaggccgcacgccggcgcggcgaggaacgccccgataagcgcaagggcttcggcagaggccgcggcggcaaaggcgccaagggccatgccccgaaagcggaacgccacaccccgcgccgctgggccgtggtggacgagcttaactttctgggaatgttgcccggcatctacttcatcttctcgcgcaacggttgtgaccaggccgtggaacagtgtatcaacgctggactggagctcaccaccgatgaggaagtgaccaagattcgccgcatcgtggatgagatggtggaggggcaactcactcaggaagacctgaaagccctgcagttctccaagttccgctttgcgttggaagaaggcttcgcttcgcatcatgccggcatgattgccctgttccgccagatagtcgaacgattgttcgaagaaggtctggtcaaaatggtgttcgccacggaaacactggccttgggcatcaatatgccggcccgctgcgtggtggtagagaaactcgagaagttcgacggtaccggtcatgtgggcctgacgcccggcgaattcacgcagctcaccggtcgtgccggtcggcgcggcatcgacaccatcggccacgccatcgtggttgaccatcacggttttgtgcccgccacggccgccgcgctgtcatccaagcgtgtctacccgctgcactcgagcttccgacccacgttcaacatggccgtgaacctgctcaactccagcgactacgagaccgcgcacgttaccctggaccagtcgtttgcccagtgggaggccaacgaatcggcctggcagctggaatcgcagatcaacacactgaagaacgcgctggccggatacgaacaggcgttcgcatgcgaacacggcgacttcaaacagttcatgaccctgcgtatggagctgagcgacatcgaaaaggaaggccgccgcaaactgaagcacgaagtgttcctgaccgatcaggagcgttcacgcgccttccagaaccttgaccagcgcattcgcgatttgcgcaaggcggagcacgagcatccatgccgcaactgcccggacctccagcaacacctcaagtggggccaccgctgggcccgcgagacccgcgaactgcagcgcgtcaccgatcgctacgactcccgtaccgggtccgtggcccgtcagttcgatcgcatctgcgatattctcaccgggcttggttacctcgaacgtcatgtcaatgcggccggccacattgacatgacgttgactgaaaaaggtctgctgctgcgccgcatctacagtgaacatgacctggaactgtgcgaggcgctgctcgccggcacgttcgacaagctcgacgccaacggactggccgctgtgctctcttcactggtatacgaggccagacgcgggggagacggcgaaccgaggcactacccgggcggcatctccgggcccatcgccatcgcttcgtccaagctcaagggcatttgtgaagacatcgatatcctgtgcgaggatcacggtctggacgagatgcagcggccggacttcggcattctcgacatcatgtatgaatgggcggatggcggttcgctgggatcgtgcctgtacggcaccgacatgaccggcggcgacttcgtgcgcactgccaaacgactggctgacgtgctgcagcagattgctgtcgcccagccgctgccgttcgacgggggagagcggctggcaggcctcgcccacgaagcggccgaccgggtcaatcgtggcgtggtggcctactccggcgtggactgacggggctgtttgacgggagtttgtcagccgacgtcggaagcttggaatagcggccaagtccgaactgttgcgtaaattagtagggttaaagatctttcaaggaggatgccgatatggcagaacgtagcctcaggggcatgagcatcggagcgaaatcgctggagtccgacgacaacgtcgatttcgccgcgcgaaacgatgtggcgtatgtatgcccgaagggccaccgcaccatcctgccgtttgccgagggtgccgaaatcccggacgagtgggagtgccgttgtggttccgtggcccaccgtgagggcgacgccgaccgtgagggcgacgaaatcagcaaacccacccgcacccactgggacatgctgctggaacgccgtagcgaagaggaactggccaccctgctcgaaaagcgcctgcaaatgcaccgtgacggttggattcccgactacgagtgatctcctactgaacaacacgtgaacttgatgcccagtcatcccgactgggcataatcattgttggaacaagtcgcattgtttgacgaccattcaaagcagtcgacatgaacaagggggagtggaatctcaatggcacagcatccgatgaaagtggtcctgttggatctcgacggcacgcttaccaagtccgacggcggcattatcggctccgtcatcaagaccttcgaagagatcggtcgaccggttccggacgccgccgaactgcgacgcttcatcggaccggcgattattgaatctctgcgtcgcaatcatgtgcctgcggaagatctggatcgggccgtggacatctaccgcagctactacggagaccgtgccgtgttcgacgatccgaacgagcccggcaacaaggtgcccggacgactggtgaacgtcgtattcccaggcatccgtgaacagctgctcaaactgcatgccgacggttactacctggcactggccagctgcaagcccgaataccagtgcatgcctatctgcgaccatttccacctgaccgaactgttggacggcatctatggtgcttccaaagacaattcccgtctggacaaagatcaggtgattcggtactgcttcgacaaaatcggttttgatgctgcagcgggggacagggccgtgatgatcggcgaccgctacaccgacattgacggcgcccacgcctgcaatttggacgccatcggctgccgctggggctacgctccggccggtgagatggaggaacacggcgcgtacgagatcctcgagaagcccgagcagatcgaagaagccgtaaaccgttatttccaaacgcactgaaacacaacggcgaggacttcttcatgatgggatgcgatggagcctgcgccgcgggcttcgacctggttttcatcggtttgccattgctgtcgctgtatgagattcccatgctgatatggttcatttggcgagcattccactggaaacgagatgacaaggattggctgaaaggcacggcgattcttgcaattgcggtggtcgctccggtgctcctttggctgttggcctggtatgctccggtgctcctttggctgtcggccttggtatgcgtggactagttgatgcaggcgaccgaatccttgtcaaggataactaatctgacataacgtacattatcggctaatagtatgtggtgattttagccgaaccagtagtatctagctgcggattagcctcgccgcagagaatcggctacttcgcaacatcatccttattccggtgagaagcaacgcccaaacgcttgtccatttcgttttccgaagcgttgcgtgcctgcagatacatggcgatgagttccagcagcaccagcgcgaatatgatgattgctccgggcaattgcgcgtggtcgtagaacgcgagcatgcgagcatccatcagatccgctgtaaacgtcaacacgggaaacgggatcagcgccgccgcaaacgacatgaaatgcgttttcaccatcgaccagtcgaccggatcgaccggcggtcgccggcgtttcggcgtgaacagatgacctcggctgaccgttatagtgatgatggacacagcaaagatgacggcgaccatccacagaacgcccggcaacaatccgacaacaatcccgttcacccggtcctccaatcagtcataataatcaccgcaacatataaaaacataagatggcaggcaacaaaagcaacacatacaacaaagcgacctgccgaccaaagccggcaagtcgccaacaaccatacatgtatcaggcggttgcgcgttgcaagcgctgtgcctcgagcttcttgcgcatcctcatggcagtcagttcatcaatcggacggcccgtggcaatcgtcagcggcttggcctcaagatcaacatattcttcctgttccaaggccgtctcaatctggtgccacaacgaacccaccgacacggcgaacactgccttaccgctttgcaacagttcgagcatctgttcgctggttgtgcattcatgtacgttttgaccatcgcacatgatggtcacattggccagctgatcggtgctgcgttgagtcaagaatccgatggccgccgttacgttctgcagattcacaccggcatcaagcaacttcttggatacagcgagaatcaccacatccttaaacgagtatagtcgtcgtgaaccggagccatgagacggcgtgatggacggctcaacaatctgcttgcgtgcccaataatcgagctgtcggtacgtgatgccggccaccttggaggccacagtgccacggtagccgcgcttgatctcctcagtatcgacgttggagaacaactccccctgaatcgcgtcagcgttcagattctgacggtcctcaagcgaaacatgaagatgcagcccggtctgtcccatggcactcccctaactcatgcgtgtctcgcatatgactcacactggtgtaatcacatgattgcaatttctgcaatcagtctaaccccgtgctgggtgtggactattgggaaataatggcagatttcgtgaagaacacgaggcggaatttaccgatcatgatttcgtcgccgttcttcagcgtcgcctgatcaacacgctgacggttcacgtaggtgccgttcagacttcctgcgtcaaccacaaagaactgaccgttgaccctgcggaacacggcatgctgacgggatacggtggagtcgtcgagcagaatatcagctcgcggatcacggccgacggtgatttcatcctcgtcaagcaagtaacgagaacctgagaccgctcccctggcggaaatcagcaatgccgttccctcggacaatctggtgatggtgtccagatcctcttgagtcagcggtcgatcgccggtggtggtaatgggcagtacattaatcgcgggcaggccgataatggtggtttcgcctgcgctaggaatcgggttggtcataatcccctattctaccgtctttgcatactggttttgcgtagcttcgcgtacttcgtcgataatgatgctgtcagaaggctgtacattgacgttggacccgtatttcacctggagctgagcgcccacaccgccggcgatatcgactgcgttggacagttcctgcggattgccaatggccttcaccgtgtatgtgggcttgatggtggtgccatccacgatcaaaccttcctcggcgtcctgaatgtaggtggaggtgatgacgcgcacgttattgatggcgattacctcggcaccggcattgcgaagttcctcgataaggttgaacatgattgaggcgtccactttagtcgtcaagcctcgtccgattcggatggtcacgccttgaccctttgccgggagtctgccggagatcaagccgctggtctcctcgttttgcttggcgatcttacgcgcctgctcctgctcgttagccgccgatttcagcgagttgagctggctgttcaactgggttttacgctgctcgagattggagatttgcgtattcgactcgttcagcagccttaccagttcactctcgtccatcgtttcgtacgtggatttagtgttattgatctggctcatgtaggcgaaacccaacaacgcgcacatcagagcgatgagaatcgaggatagtaaccgtgatttgttgctggcacggttgagatccttccggggcttcttacgcaccgtgggaaacgacccggtttccatccggtcgttgaccttgtcttgtgcatgctggtcgcgcattttctccagcatgttgtctgattgtgctttacgtgccatacgtcagtacccttgtcagcctcggaagatgaagcgtctgatcgcggacacgttggagaagatgcggatgccgagtacgacgatgacggctgtctgcagctgcgaaccgacgccgagctggttgccgaggaacacgagcagtgttgccgtcaccacgttggcgaggaaggagatcacaaacacgcggtcggagaagctgcgctcgaaataggctcgcgcggcacccagcagggcgtcaagagcagcgaccaccataatcggcagataaggctgcacgatgatcggaatgtccggcttgacgaacacgccgatgacgacgccgatgattagtcccagaacggctgccattattcattcctttccgcgtacttcacttcgccagtgactgctgcctcaagtgtaatcgaattggatttgctcacctgcgggtagataccggcttccttgaaggaatcgtaaagacttgcaagtttcttcttccccatcgcttcggccaaggcgctcttatcgcctatggcttcaatggtataggggctttgtatcgcggtcatgccgatgagaatatgcccgccggccttgcgtatcgaggtttgcgcgccgagcctattaccgttgatggcaatggcttcggctccgttttggaacatcagggagaccagttgctgcagatccagatcggtgatgactcggatgttcgtggaggtgccgactctcgtcgaggaggattgatccgactggcttgccgcgattggatcggccagcgtcatggtgattccttcgccttcgaccaccgtggcaccattgaccatttcgtcttggataagcgtatcgcttttcacgctgccggatattttcttggactgttcgtcaacttgggagcgcaaattattgacgtccgtggtgagttcgtctatttgcgagttgcgattctccaattgcgtggccaaagtctgccgtacctgcttacgcggatcggattgcaactgttgcacgaataggctgcaggcaaagccaacgccgacgcagatgatgaatacgacgatgcgattaaaccagatggagaaggtcgaacgatgctcatggaccagtcgtgagtcggagaacatcggatccatcggacgattgacaagatcatcgatgagctgaagcgaatcgtcgttggttttacggcgacgtctggtgcggatggcggcggcgtcatccggggaaagcgcatgatgtgattccgcgcctcggactgagtgggagaacacggcgcggcgtcgtaccggctcattctccttgggtacggggaatgagaccggggccgtggcctcaagcgccatacttctcccccagttccttgcgtagcaatccgacgccctgcttggtatagatatatccggcgagccaatacatggcgatgccccagatgccggcggccagcgcggcgatgtagagcaagtggaaaaacgtactggtgcccaaatcggcgaaaatcagaccgacgatggaaatcatcagcagcgcggtaccggccttgcccacgaaatgcacgggcagcggaccataaccgtactgggcaagccatagcacctgaatcgccatccacagatccctcagtcccacgataatcagcatccaccatgggatgatgccggcgacgctgagagccagaatcgagcagaaaatgagcagtcggtcggcgatcggatcaagaatctgaccgatcttgctcacttggttgaatctgcgcgcgatgatgccgtcaagtccgtctgaagccgaggaaatggcgatcagggctagcgccgcaatcatctcgtgcttggagatcagcacgctgatgaaaggaatcgagatgattcgcagcgcgctgatcaaattgggcacagtgaaatagatgtcacgtgcttccggactgtatctggcgttgactttctggttggtcatatcgactaacagtctacatgcgggaggcttgcagagcggtaacgatgatgccgcgtgcgccgacttcgtacaaatcatccatcagctggttgaccttggccttgggaaccatgactcgcacggcgttccactgtttgtcgtgcagcggggagatcgtcgggctttcaaagccaggggtcacggccacggcggcggcgaccttgctgatcggaatgtcatagtccatcagcacatactgatgcgcagtgagcacgccttgcagacggcgggtcagcacggccagacgtgggtcctgctcgttcagacgcggcgaacgaatcaggcaggcttcggagtgcatgagcggttcggcaaacacgcgcaggccggcgttgcgcagggtggtaccggtggagaccacgtcggcgatgagatcggccacgcccagctgcacggaggattcgaccgcaccgtccagatggatggtctcggcctggatgccgtgctcgaccagatagtcgtgtacgagcttatcgaatgtggtggccacgcgcttgccctgaacatcctccagggtggtgatcggggattcgttcggtgcggcgaaacggaaggtcgaggcaccaaagccgagcggcatgtgctcgagcgcggcggtaccggagttcttgagtagatcctggccggtgatgccgacgtcgatggcgccgcggcccacgtatacggcgatatcgagcggacgcaggtagaacaactcgatgccattgtcgggatcttgcacgaccagctggcgagggttggtgcgcagacggtagccggcctcggccagcatgttccacgcgggttcggatagcatgcccttgttgggcactgcgattctcagcatttgcgttcctctcacaggtgcttgtagacgtcttcgagcgtcaggccgtgcttgatcatcatgacctggacgtggtagagcagctggctcatctcctcggcggtgcggtccgcaccctcgtattcggcggccatccaggtctcgccggcctcttcgatgatcttcttgccgatgaagtgggtgcccttgtcgagctcgtcgacggtcagggagccttcggggcgggtctgggccttttcggacagttcggcgaacagggattcaaacgtcttcatgtgattcagattcttttcttgcggttatggatgaaaggtggattgcggttcaggcttggagctcaggccttgaacgcggcctcggccttggtgcggatgtcgtcgatggcttgggcgggattctcggcgccgtacacggcggaaccggcaacgagcacgtcggcgccggcttcggccacgatgtgcgcggtcttggggctcacgccgccatcgacctggatgcgggtcttcaagccacggcgggtgatctcatcgcgcaggcggcggaccttggccatctggttgtcgaggaacttctggccgccgaagccgggctcaacggtcatgatgaggaccatgtcgaactcgtcgaggatatcgaagatcggctcgaccggttcggccggacgcacggcgaagcaggccttgcagcccatctcgcgcagctgtcgggccagacgcacgggggcgtgggtggcacccatgtggaaggagatggaggcggcgccgagcttggcgtattcgggagcccaacagtccgggtcctcgatcatgaggtgcacgtcgaccggcagatcggtgacctgacagatgcggccgacgatcggctcgcccagggtcaggttcggcacgaaatgatggtccatgacatcgacgtggaccaggtcggcgttggcgatggccttgagatcacgttcgaggttgcagaagtcagcggacaggatgctgggtgcgattgcgatattgctcatggtttcctaccttatctgtgcaatgggacttggggtcccgtgtttcgcgctgtttcggcgctgtttattgtggtgtcacttagtgcgattggtttgctttttctggcgaagctgttcctcttcgatgctctggcgttcgagctcgtcggcggtgaccgccgcaagcccgcgcgcctgcgccttggggtccggaccgtactggtagagcacgacgaacaggatgcagccgagcacgaagacgatgatcgcggtccacacgttggtcctcaggcccaggatcaccgtggagtagttgatgcgcacgttctcgatccaggtgcggcccaggccgtaccacatcaggtacatggcgaactgctggccggccttgagccggtcggcgagcttgtggccgaggtagatgatgagcgcggcgccgatgaggttccagatcatctcgtagaggaacgtcgggtggaacagcgtggttctgtagtccgggcattgcgcgccggaatagcagatttcggatttgccgatggcgtccgcgtcgttgagcttcaggccccacggcaacgtggtgggccagccgtagagttcctggttgaaccagttgccgagtcggccgatggcctgggccacgggcagcgcgggggcgatggcatcggcgaagatcgcgaacggatagtgcttgtggcggcaccacaggaacgccaccaaggtgccgacggagatgccgccgaagatggccatgccgccttcccacaccttgaggatgttgaccaagttgccggtgggcgggaagtagtcggccggcgtggtgatgcagtggtagaggcgcgcgcccaccagcgcgcagggcacggtgacgagcgtggtgtcgagaatctggtcgaaggtgccgccgtaccgcttccaacgtgtggtgaggatccatacggccacgcagatgccgatcaagatgcagatcgcgtacatgtggatagtgaacgggccgatctcgaacttggagaaggtcggcgagggaatataagccagattcatcgtgcctctacttgctggtgctcatggtgtgtccacgcgcgggttgtgcttgatgctctgtgactaccctaccgtgtcacggcacaacccgcgtgaggcgcaccgggcgttcaccgggcgttgtggatgccttcggccagttcctcgctcttggcggcgagcagcttcaagccttccttcgggtcgcgtgcggtcttgttgtcatccgcgagcagggtgtgcacgagcgcggagccgacgatgacgccgtccgcgtaggagccgaccttggcgccctgttcggcggtggacacgccgatgcccacgcacacgttctcggcaccggcctgacgggtgcgctccacgagcagttcgggcgaggcgtcgatggtggcgcgttcgccggtgacgcccatgcgggcggccgcatacacgaagccgcgcgcgttgcgggccacggtttcgaggcgctcggtggacgagtccggggagaccaggaagatgcggtcgagtccgtgacggtcggaggcttcgatccactcccccgcctcgtccgggataaggtccggggtgatgagaccggcgccgccggcgttctcgaagtcgcgggcgaagcgctcgacgccgtagtggtacacgaggttccagtagctcatgatgagcggcacgccgccggcgttggccacggtttcgacggcctcgaacacgcgcttgatggtctcgccgttgttcagggcgatggaggcggcagcctggatgaccgggccgtccatgaccgggtcggagtacggcaggccgatttccacggcgtcgacgccgtactcgaccatcgtcttgaaggcgtcaagcgagacgtccgggttagggaagccgtagggcaggtagccgatgaaggcgggcttgttctcggccttgaacttggtgaacatagcacccgaattgctgggcttgtggctgatgcccagcggctggccggacggcgtggttgcttcgttggtcataatcaaaaatctcctcttctggttcaggcgacagtattgccgtgggcgccggtcacatcgagcgcggcggcctggtcgtcggtcaggtagccgaaccacttgccggcggtggccatgtccttgtcgcctcggccggagatgttcacgatcatcacggccttgtcatagcccttggccttcagatcggcggcggctttgtacgcgccggccacggcgtgcgagctttcgatggcggggatgatgccctcggtctggctcaggtcacggaaggcgttcatggcctcctcgtcggtggcccagctgtagttcacgcggccgatgtccttgagccatgcgtgctcggggcccacggaagcgtagtcgaggcctgcggagatcgagtaggtgtcgagcgtctggccttcgtcggtttccagcaggtagctcttggcaccctggaacatgccgagctggccggtgccgggggcgaagcggatggcgtgcttgccggattcggggccgttgccgccggcttcgtagccgtagaggttcacgcgctcgtcgtccaggaaggcgttcatcacgccgatggcgttggagccgccgcccacgcaggcgcagatcgcgtccggatggtcgatgccgtaccagtcctggagctgctgcttggcctcctcgccgatgatcttctggaagtcgcgcaccatggccgggaacgggtgcgggcccgcgacggtgccgagcaagtagtgcgtgtccttgacgttggtgacccagtcgcgcagggcttcgttgatggcgtccttcaggatcttgtcgccaagggtcacctcgaccacttcggcgccgagcatacgcatgcgggccacgttgagggcctgacggcgggcgtcgatctggcccatgtagatgcggcacttgaggccgagcatggcgcacacggtggcggtggccacgccgtgctggccggcgccggtctcggcgatcacgcgggtcttgcccatgcgcttgacgagcagggcctggccgagcgcgttgttgatcttgtgcgcgccggtgtggttcaagtcctcacgcttgaggaagatacgggcgtcgagaccggtcttctctttgacaagtgcggagaagcgcggggcttcggtcagcgggctcgggcggcccacgtaacgctgctggagcgtcatgaattccttgtggaatttggggtcggccttggcttgcgtgtacacgcgctcaagctcgtcgagggcggtgatgagggcctcgggcacatagcggccaccgaactggccccaatacggtccctgatgttcgctgagcggggtcgtttcggatgctttcacttgtgctcctgcctttactagtcgttccactgcaagttcatgattgtcggcggtggccacgccctcgccgaccagtaccgcgtccgctcccgcgcgggcgtagtcttcgacctcgaccgcgccgaatacgccggattccgctaccttgatgacgtcatcgggcagatcggccgcgagttcgttgtatttgttcacgtccaccttgaggttcttcaggttgcgcgcgttgatgccgatcaccttggcaccggccttgcgggcgcgttcgatctcttcgcgggtgtgcgtctccaccagcacagtcatgccgagctcgtgcgccagatcgagcaggtgcttgagctgggcgtcgtccaatgcggcgacgatgagcagcactaggtcggcgccgtgggcgcgggcctcgaagatctggtagtcggtgacgatgaagtccttgcgcagcactggaatgtgcacggcggcgcggaccttgtcgaaatcgtcaaggctgccgaggaatttgcggccttcggtgagcacggagatggcgcttgcgccgcccttctcgtactcgcgggccagcgcggccgggtccgggatgtcggacaggtggcccttggacggagacgcgcgcttgatctcggcgatcacggggatgccgtcggcgcgcttaagccatcgtgtcgcgtcaatcggagccggggccgccagcgcggccttcttcacatcctcaagcgatacggtgagctcacgggtgcgctgatcctccagcgctcccgccaccagttcgtccaaaaccgacatggtcctccctttgttggtgttcggtcatgcgccactctaggtcacgtcctgtcccgattgccgaacccgtcctacattttgggctttcgcaggcgattccggcttaggcagaacattggcataaactggcacgcatgtgcagacgttttgcgctcgacttggaatgggacgccgtggctggaccgcaccatcgacggcgcatccttgctcgccggcgtgcggaactcaggcactgcgttatcccgccgcttgcaatttcatgaggtcgccccgctgcagggcgacggcaaacgcctgattcagccgttggattcgaccgagcccatgcgcctgttttgacggaacatctttgacgagagatcgtcactgaatcaatgtttgctatatatgtatcacagtgtcataactatgaaatcatattgttgaattgtggtatatgaagttcgcatgacaacgatgtcaccgttggtaggtggacagtaggtgccgttgctgccggtggtggtgctgaactgccgatgtggttcagtccaccagcccgcgcagcagcgcgatttcgtcgcggtgcgtggtcgacgtctgctccttggtttcgagaatcatcgggagcttggccatggtcggatcgttgaccagtcgcgtgaagaacgggatgccgagctgcccttcgccgatattggcgtgacggtccttatgcgagccgaggccgaactgcgaatcgttcacatgaatcgccttgacccttgccaagccgatcacctcatttaactggcgcatcacgccgtcgtagtcattctccaaatcgtaaccggcatccaacgcatggcaggtgtcgaacgtgacgccgacgttcgccttattctccacgccatccatgatcgtggcgagctcatcgaaattgcggccacattccgtgcctttgccggccatggtctccagaagcaccatgacgccatccgcacgctcgaacacctgattcagtccctcgctgatcagccggcagcctgtctcggagccttggcccacatgcgcgccgggatgaatgttgatatacacctcctggccggcctcgcggatggcggtcagcagctcgatgtcctcggccaacgcctcgatcgcgaatgcgcgcttggcctcatccttgccggccagattgtagacgtacggcgcgtggacgaccaacggcccatagccctcagccttcagacgcgcaccgaacgccgccgcgtcggccgggtcgagtgccttcgaacgcttgccgtacggggaacgcgggaagaacgcgaacgcggtgccgccctcctcatgggagcgttccagcagcgcattccatccgccggccgtcgacagatgcgatccgatatacagttccgtcattccaaactcctcgtgttccactcgctgttcgtgttaccgctatcatatggtaggcagcatcgagcgccgcccgcacaaccgacacgagacacaactgttcacccgaccaaaggagacccgagcatggcggtagccggcacacccaaggacgataccggccttgaacggaagatggagtcgcgccatctgacgatgatctccctgggcggtgtgattggcaccggtctgttcgtcagctccggctatacgattcatcaggccggcccactgggcgcaatcctcgcttatgcggccggttccctgctcgtctattgcgtgatggtccgctgggcgagctgtccgtggccataccgtatgccggcagcttccacatgtatgcgaagcggttcatcggccccggcaccgcgttcaccatcgccatcctgtattggctgaactgggcggtggcgctcgcatcggagttcacggcggccgggctgctgatgcagcgatggttcccgcattcgccgtcctgggtgtggtcggccgtgttcattgtggtggtgttcgcgcatggtatggtcgctggccaaggagcggctgattcccgcgcgattcgccaagacgaatttccgtggtgtgccggtgtgggccgtgctgttcagcatggcgggttcgctgctggcgctgctgtcttccgtgctcgccgcctcgaccgtgtaatttggtgttggtcgcagtatccggtttggcgacgctggtggtgtggttctccgtgtgcgtgtgccatatccgtttccggcgtgaatgggcgagggacgggcacagcgccgatgagctcgactaccgtgcgcccggtttcccggtgctgccgtggctggccatcgtgatgtgcatcggcgcgctggtgctcgtggtgctcgatgagacgcaacgttcgaccctgattgcatgattccgttcgtcgcctgctgttatgcggtctattacgccctcgaacggcagctcaaacgcgaaagaatgcctaactcggtttcgaggggctgattcggcgttcgccggaggtctacttgcgtttcaaggggctgatgcccaagtagacaaggctctgaaatggcgttatgtcgttgccacaaagccgtttatacttgcggtttggcgtttgagcagcccctcgaaagccaagtagatgtccccaccggacgaaatcagccccttgaaagccaagagccccactttttcggcgaattacgtcttatatcaggtcgtacggcatctgatgcttgaccatccagaagatgccgaggccgatgaacaccagcagattgaatccgccgctatgccaccacaccacggcgatcagcgtcgccatgcgcgccacatagaacgccgcacgccgccagccttctcgcggccgggtttccactgtcatatgcgtgaagctgccgccgagcgtacagccgccgcgcaaccatggcaccacgccctcgaagaggatgagcgccgccaggaagaggatcgagccggtccagtcgaacggttccatcgactgccatgagccgttggagcccgagggcaggttcgattggacgatcatgacgaacagatgcgtcggcatcacggcgaacccgatcagcgtcatgtcgatgatgaacgtgatcagccgcctcatgaagccgggtgtggtggtcggcgtcgtatcggcgacccgcgccggaatcaggcgcagcgagaacatggccagcgcgaacccgatcagcgcgccggtcgtgttccacaggagatcgtccacgtcgaacagacggtaggcgcacgggaacacgcccatgaggccggtcagctgcatcgtctccagaaacagcgacgtggcgaacgacagtactgcggtaaccggcagcggccaacgccagatacggcccatgatgaagcccaacggcaggaagaacacgatattaaacgcgatttgcagtacggcggtgagaccatcggtacggatgtcaccgatgaactgcagtgggttgatctgcggtgtcagatggtgcgcggcgcaataggccgccgcatcggccggcatcggatacagtgtgaagcacagcaggccgagcagatacagcaccgtgccatacgccactatggccgacgacagtcggatgcgattgtcgcggtgatacagcagcgccagcaccggcaccgtcagcagcatggacacaaacggccacaatgccagcgcgaacgcaaacggttcggaaaagttcttaagaaatcccatcttcaatgctccctgcttcggcccgctccgttcggtttcggaccatgactctcgacttctgattccaaggtacggaacatgacggcatgcgggtatcggccatgagagcgaaatcattggaatgaaaggcgattcgtatcattcgcatggatgaggaagatgcaccagttgtgactgacaattgcggcctgcgaaccggcaggatgaatgggactgacccaactggcccgtctcatcttgtagggtgtttcgtgctcttgtaggcagatgattccaatggcgatgaacggaataccgccattgcaatgacctctcgccaaggccagctacctacaagatgctgaatctgcctacaagatgaattcgccggtgaaccatgccggcatcaccgcttcgaggtaagggcgcatcacgttcacgagccgaaattcgcgagcgtagttcatgagtttgaccaagtcagtgtgcgcggatctcatgtaattctggaaggcggattgcaaatcttgcggatccactgtgctgcgggagcggaacaaatcgcaaatggttcgttccaaatcataaacgcgaaccgtatgcccgaacatagtgatagccgacgccaggccaattgtaaagcgattgtcggccacctttctcactgttacgtcttcattcttgagacgagccgtacctgatgattgcggtaaggtaatcgtcggtgtcaggggggggggctcgccccctctccaagcaagaacaacgcagtttcatgcgaaaaaatggctttcggatatcgatactgcaattcgaacagcggatcggactccgcattcggtgaaacatataagccctttgccgctttctcaagcttggcttcacgcacgaatcgcgaaatctccgtgcgggaaactcctcgacgctccatttccgataccggaagatatcccatatgctccttcaatacgctttccgcttctgtcgctctagtggacatgggcattccttcagatgttgcggagctcggagagttgcctgaagaaaagttttgctatcgcctaacctaatgcgttattcgactccaaccgttgctcgacttcgaaatgctcgaatactatgagcgagttgtcgttcaacggaaagattgggttggcgaattcatcgcggtattccgccgaattccagaaagattcgtgtgcgctccgccattgggccgccgtgacgtcgccttcaccctcatcgatggcgtaccggtcagtgacttttccgagcggaatcacgtcaaccgcagtggtgacgagtacggctacgggtcgttcatcggaatccaccaacaccgaatgcgcgccaacgcacggcagcggttcgacctcttcctcatattcaatcatcagcgcagcggtggcggtttttacgccgtccagaatgagcttcaccaagcgatcgcgttcaggcccaggaaacataaactccgctttgggcaaatcactggtttcaaatgccgtattgacgctcatgcaatgctccagatcgtctttatgttcaattgtgctgtgcttttcttactcccatcataatagcccgaattccatgagtttccggcgctgatccagtggcctccattacggtcaatacaacctgatgccaagcaatcacatgacaacaagtgacactgtactcacgaaccggcctactatgggcggcatgacgattcgtattgttccgattgagccgccatggtttgaggaaaaggcccaagttcagtcgtgcacgtggcgcgaactcaatcaggggcatattccgcagggaatcgtggatgcgatcactcccgaattcgcgctcaaactgacgcgcagtcacgccaaagaccccaatcaggtcgtattggtcgctttggagaacaaccacgtgattggttttgctgagcttctgcaaacgccacgttcgccaatcaaacggtccgaggctgcggaactggcttcgctatatgtgctggaatcttgccatcgtcatggtgttggccgtgctttggttgaggcaggccaacgcgccatcggcaacgatcggctcgccttgtgggtcgccggattcaacaccaacgcccaaggtttctaccgtcacatcggcttccatgagaccggcctgactcaaaccgaagacatgggcccggaactcgaaatgatcaactactctgacggcgtattccagtgagcagcccgacctcccacacgcgtccggcgctaccatgaagccatgtctttgaacagtgagcaacgcgcggcgactatccgcgaatttcaggagaacatgagccggctgggtctgaccgccgaacggcggcaaggattttggcgtcagcggcagcagagtggagcaaatcatcaccctcaagtcgggcgtgctggagtatccgtggattatccgcgcctatctgctgagcagagctgagacacagggcgtggaactcacgccgttcatggcgttacgcggaaatccgcacgattattggttcctcgacggcgactctatcgaccgaggcgaaatcgattaaaaccgattgataatcggccatttacacgcaagaggcgccgtcaatcgcctcgcgcatagaggccatcgctctccatgcaggtggcgatgcgtgtgtagtattccgtcttgtcctcatggtcgatacgtgcgccgcaatgctgctgcaccgcaagacttgccggattggttttgtggacactcaggtaagcctcctcgatgccgagctcgcgggccttggcgagcgtgagcttgagcccggcggtcgcgtagccgtggccgcggtattcgcgggcgataccgtagccgatgtggcccggaccgttgcgcaggaagtcggtgagccggtgacgcaggttgaagatgcccacatagtcgccctcatcgttgacgagaatgtatttggtggctggcacccagccgtccggcaggccgacgccaagcgactcatcacgcaaccctcgcacgtatgcggcgaattgttcacggtccatgccagccgccgggttctcgaatcccgtctcttccgccgggaatttcgcgaacaagtcaaatgcacgttctggatccgccagccatgtctcgatcagccgcatcggtcgcactcctcctgttgatacagcagaccatactactactgctcggccaacgggcgcgaactttatctggttagccattcgtctgcggtgatgcggcgtacgagttcgtcgcgatatacgtcgccgagcagtttgagatgcacatggcgggcggtgcgcacgggtgctagtccgagtttgtccatcacgcgggaggatttgtggttgttgacgtcatgcacgccccagattgcggtcagttgcaggtcctcgaacccgtgatgcagtatttcccgcccagcttcgggaatcagtccttggccccaatacggttcgccgatccaatagccgatctcgcgcgtcgactccggctcgcgacgctcggggtcgactgcatccgacaacggcgccaatccgatactgccgattggctcccccgtctccttcaggacgaccgcatatgtttcgggagtgctcagcacattacggattacccgcgcactgtcctcgacactggcatgcaccggccatgcagcggccggcccgatgtgcggattgcttgcatacttgaacagcgccttcgcgtcggcaacatcatcgattttccacgggcgtaacagaagtcgttccgtctgcagttctgttttcaaattcaattgagcttctccccttgttcacggatatgattcgcttcttctagtcaatcagcttgtgcccgaaattcctacggcatgcatgtactcaaatatatcttcacatttgcgggatgacacacagatctggccattttttgcgtgacgtcccgcagtactgcgggatgccatcgagatcaatcgtttgacgcacgtagcatcccacatcattaattattaaaatcgcgggattacgccattttccatgttgagccataatcactcgtaagaaatgctgcgggatgatagacgaaaaacgctgaaattcacgttgcatcccgcactcatcccgcaatctacaacgtccgcgactctcaccattcaaggattcgcacgactattgataaatatcccgcgagcaggaaaaccagcaaccacacgagcgacactaatgaattctgcaaaggcaacgcaccatcagccagcgagcgaatcgccgacgaatagaacaagtcactgacagccggcaccaaatagacgatgaacggcttaagcagtatgggcaccaggaagtagatggatagtccgagcagcacattcccggcaagcaaagaaagcgacagtaccgcaacgccgttcatcactaccagcatcatgtaccggatcatcagacggccgctgacgccgtgtccgtaggcgatgaagtttccaatggcgttcaccatggtcagcatcaacccgacaacgacgatactcacgactttcgctgtcatcagggaaaacgccattcgccgccgggaaccgacgaggagagccgctatcgccgtttcgcccgaattgatttcgataatggccagagcagcggcgatgatcacgagcgcttgcgaggcaagtgtcgtgctgctttcgacggtcagcgggttggttccggaatcgtccaaactaatcggcatcagagcgaccgtgtacacgagagacacccagcacatagccagcagacaaacgacccgcaggattcgtgttgtcgcgtccttgtatatcagggctttaaccatgctcgtcacatcacgcccctctcatactttcgatttcaggaaaagccggctacgcaccatcaccgccgcagtaaacaccgccaccagccaacacgtcatgacgattgcggatgcggccaccggaaattctcctgcctcatcgtcccgtccgaacgcaaagcttttcccgccgatcgtcggcagcaccatatcagcgtgaaccactttcagcacgccggatagcgaaacgacaagtagcagcagaatcacggccagtgatggcacgtcacgcttcgtggacaaggccgcgatatagccgatcagtcccatgaccacggcgaacgccatcaccctcagaggtgtggtaataaccgtagccgtgaggaacatcggtcgcagcgcgggattcaacatcaccacgagtatcgccgcattcagcagtgatgacagcagtgagacggctatgcagtagagcacggtcgcgagcacgtcactgaccgcgaacggatagggccggttatacagcagccgcagctggcgttcatcgcccgaccggaatcccgccgccacaatcaacgccacgataatagggatgagaatgattgaggtctggtagggcgaggcgagcatggcgtcggacacgatatgcgccaggttcgggtccaatgcgtcgtgcgattgtacggtaccgtttgctgtgatggacaccgtcgaggaaatcgtctgcacgtcgagcaccgcgaacagcgcggtgagtgccagaacggcgcatacggaccagtagaattgccagtttgcgcagtatcgcaccagctggcaggacagatggcggggcaaagatgtcatcttcatcagcctcacttcttcaccacgttgaaatacgcctgttcaaggctgccgtactggtcgagcaacgcagcgatgtcaccatcgagaaccttccggccattcgacaggcccacgacgtgatcggtcaccagttcgagctcggccatgtaatggctggagacgatgacggtacggtgatccgaaacgtaatccttgatgaagtcgcgcacccattggatgccttccgggtcgaggccgttcaagggttcgtccaagatgagatacggggcgtcggtcaggatcgcggccgcgatgcccagacgttgtttcatgccaagcgaataggtcttgaacgtccgtctgcgcgcctcgtgcaatcccacgagccgcaggcattcgtcgcatcgggagaacggaacgccggcgaccagtgcaatccaacggagatggctgagtcccgtccgggacggatgcggcgtcaacccgtcgatgaacgagccgacgatattgcacggagatggccccagttcgttgtatcggctgccatcgaacgtggccgcgccgctactggcaggctccaacccgagcaggatgtgcagcaacgtcgactttccggcaccgttcggaccgattagcgcggtgaccttgccctgctcggctcgaaacgacacatcatccaacgcctgtttgccgccgtacgttttcgacaaaccggaaatctctatcatcacagctcccctcttctactcggaatcaacaacacccaatatggtccggctgcgacgtgcccgcgacatcgtgtcaagcaatcgcatgacaacaggttttcatccggctgtgggcatggctacgatgagcggcatgaggcatgatgatatggttggggtttcggcgcgggcaatccgtatcggcgtattggataatgatccgttcgccttggacgcgatgtgcgcgatgatctcggccgtttccatggacttccgcgtcatgtggagcacgggctctcccgcggtggcgattgagcattgccacaacccgcataccaggccggaggtgttggtgctggatatggcattgggcgggatcacgggcgcggacgtgtgccggcgcatccggcgcaggaccggtgggacaggcatcgtgtgcgtcacctcgtattccgtggacgtctaccagcgggaggcgatcgcgtccggcgctcagggactgttcgcgaaggaacgactgaggaccgatatcgccgtggcgatacgctgggcggctcaaggccttcccgccgacgaacaggccgctgtgggttttcgtgacgcgcagaccgcctatgggctactgtccggcacggtgccggcgaagatgtctgttgacatgagggatcccctgtcattgcgcgagaaggagatcctgcgcctgtacgcgcggcggctgaccaccgacgagatcgcgggccggcgtcatccgccaccatgatcctgctcgcctccaccatggacggccttgatctcagcaggagccgggtgatggtggccgcggtgcagagtctggcgttctactgctttccgctcctgaccggcctgctgttacatgtgatgcgccaacgcgaccatgactcgtacctgctgcgccgacaacacgaacgcggggagacggcccgcagcctgcatgacaccatcggcaacgacctggcctacctgatcctgcgcatcgaccacgccgaaaccgaaggcatgcccgccgacgaacacgaataccagcaacagctcgacgaattgcgcgacgccgccagccgggccatgggccacacgcacgaggtcatcgactcgctcgaaaaccacccgcaacgtccatccgacccatcgcatgaaggctcgcacggcagcaagcaaccccgcacagccgattccacggaagtcgatgccgccgcgcagcgtgccgggctgcaatcgctgatcgacgaggaggaggccaggctcgaagccccgggattcaccggcgacaacctgctcgccgaaccacaccggccgctcacgccggagaccatgcgactgctggcgggcctgctgtcgaacctgctggcggaactgtacgcgaacatcgccaaacacgccatccgggcgaatggtacgccatctgcgtcaccttcgacacggacgccatccacgtctccgccagcgacaccatcacacccgatgacacgagactcggcctcgaccgctaccaaaccatcatcgaaacacacgtcggcaccttccaaacccacaccgaacaagcccactggcagctggaggctggcattccaatcgatggcggccggtaaaacatgcattcgcagaccagccatgtcaagcaatcgtatgacaagaatcatccgtttacggcatcgccgccggatgactacaccagcagggcacccgcgagggagacgacgatgacgccgatcacggccaccgcggtgatggtctgtcgcaatatcagcgcggcgataatcacgctcatggcggggtcgatggagaacagcgtgccgaccacgcgcgccgacgtgatacgcccggacaacgtgtccatcgtgtagggaatcgcgactcccagcaccgccgaggcggcgatgatgccccactgggcggccgacatgtgcggggcgtgactgatggataccggcgaagtggccagcgccgcgaccgtgaccgacaaggcgagcccgtcgagcccggtgcccgtcttgccgacccggtcggcgaagagcgtgtacaggccgaagcacacggacgagcgcgagcatgacgatcgcggcgaccagcatgcgcatcgaactgaccggaatcggccccaacgcactaaacaacgacgccgacagggacgacgacgtctggatgcccaacgatcccaccataaccatgccggccgccgccatcacacggccacgcgccgaacgcggcgcccgaagcttgcccaatacccctcccctgtcacggccattcccacacgacctctgcgtcaccaatgacagtgttcggcgaagactcgcgacgtgcggagtcgactttgtatggcgggatcagcggaaagcggcaggctcactcccgcaacggaatacggtgagaaagctggctgccggacgattacgatccgaaacagtgcacccgtatacggcttcggtcagacacgtttcaccgccttgaacagcagacatgcgcttatcgcggcgatgacgacgccgaccggaatcacgtaaccggcgaatttcaccccgttcaacacccatgtggttggtatgacggcgtacagcatcggcgcgtcctcgaacatgccggaactcaccgtaagtccggcgacgatgaagaaggcgacgacgttccaggcgacgagaggactgacccagagtcgcagaacgaagcatgccagggaaaggacgacggcggtgaacgcaagcatcagaatggtacgcgacgaaagcgtctcgttgacgacgaatccgacggcaagcccgtacagcaaagtcaggcagacgttgatcacgacgccgagcgacagcgacttcacgctgaagcgaagcaggagccggtcgtggatgctgaaggaacggtacgaggagggcacccttgcattggagaagacgagaccggccgcggttacgggaagcgccatcaccatcgccgactgcaccaccgcacccgtgttcccgtaacgcaaaaagaacaacggaaacagcagcacggccacgaaggcgagcgtcgaccagcggatcaccgccacacgctcaatacgcaatagggacttcatttcctctccactccttcgcgacggaaccggctcaacagcatataggcaaccaaaagcaccacgatcgggacgacgaccatcacggggccgacggacgctcgactcgccgcttccgccggcgacatcacggtgccgttcaggttaagtccgacggtccgtagggcgttcgcgacgtagggcgtcgcatagtcgggaaggtcgcccggcaggagaatccatgcatagcaaaggatggccgagacgattccggcggttctgggatcggcggcgatctcgacgatcgagtagatcagggaggtcgcaaggctctgcagcacgacgaagcacaggacagctgccagatgcgggtgaattccggtacccgtcaggaccatgatggcgtcgaagcacagtacgccaatcaggttcacggaggtcaggatcagggcccggaacacggccctgagcgagcatggcgtccacgcggaatacacgtggcgcggcaggccaccgtagtgcgccttcgcgaccctggcatcgcatgcgaagagcagcgaaaggcagatcaacggctgggtggcggtgaaatagacgcaataccctccggttatcggggttccgttcgccgcgcttgagatccacgcacccagcagaagggacgagacggccccaaacaccgcggcgaggaaataccacgtgttccagtagtaggcgaccaacgcgcgaacaggggaaacggcgttcaagaccctacctcccctgatacagatccgcgaggttcaccccggtcagatccgtgacctgcacggcccggccgtgacgaatcatgatgcactcgtccgggacgccctggatctcatgaagcagatgcgtggagatgactacgcagttccccttgtcccggtaggcgcgaagcgtttcggacaaggaggctatgccatcggggtccagaccgttctgcggctcgtcgaggaacaggaacctcggatgcggcacaagggcgaggcacagctccagacgctctttcatgcccgtcgagtagtccttcgccttccgcccatacgccgcgcgattgatgcccacaccgtccaacgccgcctccgggtccacatccagaccccagaacgcggagaccacctcgacgttctctctaccactcaggtaaggaaagaaactgggatggtctatcgccgcggacatctcattgatattcgtccctgtgtacgtgacctctccgctcacgggctttatccgtccgagtagcgtcttcatcaacgtggttttgcccgcgccgtttgccccaagcagacagatgatcctacccgtgctcaaccgcaggttaatgttgctgacgattggggaacccttgtacccgatcgagagattcgcagccgatataactggcataatcacccttcacgaaaggcgggcctgaaggcaaaggcaggatgccttgcccagacccgcgcgttgcaatgtcgccgccatttcacccttcagcggccgcaaacgcaacatcatgtcaggcaatcgcatgacggttgctccatgctccctcgatttgccgaaactatccatcggccaaaggaatgaacctgcgcatcatccgcaaggacgatgcatccgactcccatcgcacacttgccgccaccggtctctccccccaaaaaaatggcgaagggcgggttccagtgatcgtcgcaacgcctggctgactgatgggagggccaggtggacaggtgggtgttcgagggcgtggagtacgcgacgcgtggcgagatgtgcgcggcgcggcgacgccggtacgtcgagcatctcgaggcgggcatgaacttcacgcaggccgcgcgggcggtgggcgtgtccaaacgcaccggcaaggtgtggcgcaacggaaggacacgatcgaacggcaggaacgagaaaccgtcggtggactggtatcgttccaccgtggacattccccaaaagatcagttcgaggtatctgagccaggacgagcgcatcagcatcgccgactggcggaaggccggcatgagcgtgcgcgggatcgcgcgcacgctcaatcgtcccgcgtcgaccgccagccgcgagctggtgcgcaacacgaatcccgcgaccggcatgtacgagccgtaccggccccagcagatgagcgcggacggcccagacgacccaagcccgcgaagatccatacggtgcccggcctgctcgcatacattcgcgcaggattgcgggcgcattggagtcccgagcagatcgcggggcgcctgcgcgccgatttcccggataatgatgctatgcatgtgtgcgcggagacgatctaccaggccatctacgtccaggccaaaggcgaactgaaaaaggacgtcatcaaggccctgaggagcgggcgcgcccaacgccggccgcacgggcagacggactcgcgcaagccccgtttccgcgaacccatgatcatgatcagcgagcggcccgccgaagtcgaggaccgggcgatacccggtcattgggaaggcgacctgatctgcagcgcggccaacaaaagcgcgatcggcacgctcgtggaacgctcgacacggttcacgatcctcctgcacctgcccgacgggcacgacgccaaacacgtccagcaggccgtcatccggaaaatgcaatacctgcccaagctcctgaggaactcgctgacctgggaccagggaagcgagctcgccctgcacaaacgcatctcgaccacgttggatatgcaggtgtatttccgcgacccgcattcaccctggcagcgcggcaccaacgagaacaccaacgggctcctgcgccaatacttccccaagggcaccgacctgagcgcataccccgaggaccacctcgacgcggtcgccgaggaactcaacgaccggccccgcaaaacactcggctacaggaaaccatccgagaaaatactcgaactcatcaacacagcatgatacgatcgcaccaatccaagaccgccatcaagagcggcaaaacacacaggtgttgcaaccatcactaaaatccgccaagcccaccttgccgaatggggtgtcgaacatggaatccgtcttgggagggcgtgcggtagtcgcattcgtaacaacaatccgcttgaatgagctgctgagcaaatagcaggtctacatgcctgctttgaaccagccgatggcgatttgagtgcgattgcgcaggcccaaagttgcgaggatacgggtcacggcacgtttgacggaggcaggttcgacggtgagttgattggcgatttcctcgttgatgagcccttcggagatgagtgcgcagatttcacgctggcgaggggtgagtgcgtcgaaagctttgcgcatttcttgctggcgctggctgctggtgggatgcggaacgcctcgttcaagcacttgtctggtgattcgtggggtgagtattgcgtcaccgttggcgatggcgtgaaccgcgtcgatgaggttgtgcttggtgacgtccttgagcaggaagccgctggctccggcgtcgagaccgccaaaggcgtaatcgtcctcgtcgtacgtggtaaggatgagaatgctgatggtgggccagcgtctggtgatgcggcgagtggcttcgatgccgtccataccgggcatccgcacatccatgaggattacattcggcaatggacgatgctgaacggcgagctgttcgagcgtctcgatggcggatcggccgtcagcggactgggcagtgacgacgatgtcggaagcatcgtcaagcatgagttggaagccaagtcgcgcgaaacgctggtcgtctacgagcattatacgaatcatgcggtgtggtccttttcgttcactccgttggacgggatggtcgcctcgacgacccattcgccgtcttcgtttggaccgtattcgaagatgccgcttgccgattcgacgcggtggaatagacggacgagcccagtaccgtcatccttgcgcgcgtccttgcgcgcgggactgccgtcattgcggataatcacggcgacggtgccgttctcgctgtggttccaggcgatgctgatatgcaccacgttctgtccgtgacgtatggcgttggtgatggcttcgcgagtcacatcgaaacacaaatcagcctgagcttcgtcatcggcgcgcgtaccagtctcggtgaacaccgtgacgatgcccagccggcgtgcgtgcgcgagaatcggccgaatgtcatcccatgaatgctggtcggattcttgggtgtgcgtatcgtcaccgttcgccgctccatcgaactcggtcagtgcgcggacggctttgcgcgtgtcgcccagactctctcgtgcgatttcgttgatgccgtgcagcgcatcctccacgcgtgggtcatcggttttgccggccagaccctcagacagtgcgatgattacggtcagaccctggcccacactgtcgtgcagttgaccggctatgcgcgaacggcgtattgcggcatcgcgttggaaggccagctcggctgcccgccggcattcctcggcagctttgtgttcggcttccttggcctgttgcctgccacgtactgcaagcgcgccgcctcccacggctgccagcgttaccactcgactcacccattcggtcgcgagaacgtccggatgcaccatgatggccgacgcggtcatcgacagcatcatgccgatgcctccaacgcacagcccgcgccccctcgctgtccgggcgaacgcatagcaggcgacgagcgtctgaatcatcacgattgagtccaaccgccagtacgaggcaactattaacaataccgcttcaagcgccaaggcaacggctggcagccagtaacggacaagcagtatcgcactgctggctatggtcatcgccagcagcagagccaatcccagcggatctttggcaaacgtatacatggtgtcggccggcgctccgatcgcatgctcccacagcatcgctgcacattcgaccacggcgatgaccagtggcacggccaggaccgtgaccttattggcctgcgcggattgcggtttcatggctcccattgtggctctttttgtatgatgttgcgtgcatgtcagcatgtgcgtatcgtgtcggccacgctgcggtgtagcgcggggcgaatctgcgtgaactggatgaggaacaatgccagccagcaggccgtgcccatgccgattacgcccggccatgggatttcggccacggggatgccgacgagcgccgcggatcttgcggcgaaaacgcttgcgctgacggcgaccgggatgagcgagagaatgaccgcgccggcggccagctgcaggctctgccagagatacatgcggatcacacgacgtggggacaggccgatgctgcgcagcaatgcctggtcggcgaccatgctgcggttcgacagggcaatgaccgccatgctggtggccagggacacgatgcacagcatcgttatgagcagcagcgagtccgcgtagttcaggctcttcggatggccgctaaggcgagtatccggccataggatcgcgcgcaggtcagcagggtgaccgacagtcccatggcaagggcgagcggggcaatcgtgttcgtgttgctggcggccttcgccttggcggaacgggcggcgagcacgccggtcgcggacccgcacaggcgacacacgacacgtccgatgcccaatagaatcggaatcagcatgctgacaaggatgtacatgccgaacgaggcgatgatgccggcccacagcgcgctgttgaatgtctgccccgcctcctggccgaacgcgagcgtccgtggcgtgcccatgccggagaacgccaatgccagcgccgccgccatgacaatcaaaccaagtgcccagtgcgcccaagaccgccaaccgtgccgtatcccgatggctcccgtgccgcgaatcacctcgatgggacggatcttcgctgcgcgcagcgaggggatggacgcgcccaacatgcacgtggccacacccaacagcagggatccgagccacgcggccatcgacggcgtgaacgcaggaggtgcgaacgagccgaatccatcggcgaagctttccgcagccatggcgttgaactcgggaaccgccagcaggctggccggcactgcagccagagagccgatcagggaaccgaacaggctcgccacacccacgagcatccacatgctggcaagcacctgactcgggctggcgcccataagccgccattgcgcgaacgtgccgtgaatacggttgaccgtggccgagccgaccaccgtcaacgagaagaacgcgagtaatgacaccaccacatagatcgtgaccgacaccatgccgaactcggccggatcaagacccgcctgccgcgcggccaatgtgaacgacggagacgaggtccacacgaattggttcatgcatatgcccaccagcgtggtcaccaccgcgaccaccagaatcgtgggtacccatcccgtgacattgtcacggaacacacgcagcacatacctagccacgatgagcctccttccgctgctgcggatacgccacgcgctggaccggtcggcccggttggacggattggataggctgggcgttcaccatcatcgggccgacagaccgcgccggcgcaaccagcggcggcgacccggccggtacgaaagtgcggcgtatgccatcggcaatctgctcggcggtgagtctgccagcgatgtgggtgacctgaccgtcgcgcaggaagatcacgtggtcggccaaagcggcggcatccgtgtcatgcgtgaccatgaccacgctggagcccgcatccgccagctcgcgcagcacctgcagcacaagctcgctgttcgcggtgtcgagcgcgccggtcggctcgtcggcgaacaccaccgccggacgcatgagcagcgcacggcacagggcgacgcgctgctgttcgccaccggacagggcgcttaccgtcgtcttcgccctctggcgaagaccgaaccgggacagcagctgcgtgacctgcacgtagtcggccttgcgatgggcgagcgagagcggcaacatcacgttctcctcgaccgtcagatacggcacgagattgtattgctggaacacgaaaccgatatgcccgcgaatgaaccgcgaacgccgttcctcattcagtgcgtagacgtcggtaccgccgatggtcacccgcccggaatcgggcctgtccaatccggacagcacatacagcagcgaggtcttgcctgcgccggacggaccgacgatcgccgtcaagcccgctccatcgatatccaacgaaacattattgagaacagtctgcgtgtttgcgggtcgggaggcggttcgagcatcgaaccctgtccgtttcaccagtccgagcgcctgaatcggtgtgccggcattttgccaaggcatgaggtagccccctgtcgtgaaagttgacgccgtttttctcaaccttcgcgccaggggcatggcaggtcgaggtaaacacggaaagtgacaccctagggtgacagattccagtagcgttccatgaccggcacccaatatgccctcaaccagaccagcgacaacgaggacctgcccggcatcgtccaactgcccgcctatgccaagtatgatggacggctgctcgtcatacttggttcctccgggaagcgaatatccttctgtcgtttgcggaaacaagccctgccgatgcccaagaccgccagataaagcaggaacatcacgggcacgacccatgtcacgtaccgccacgggtcaatctggaacgtatcgaagacgatgaacatgacgccccacacgttgatggcgacgatcgccagaatctgggcggccgccgaatcgaacctggattcggccgggctggtatcgttcgcgtcggccggaacgtcaggcgtccgcccggcgcgacgcatgaagccgagcgccgcccacacgatggccgccaccaacgccacggccgccggcaccaccagcttccagaactccccgtcattccagccgtaccggatgacggcgcacgtgatggccgtgacggcggccacgcccaatgtggcggaagcgccgaaaaaccacagcagaccttgattccgacgcccaccatgggaggcccgcacctcatcgtccgcaaccatatcgtccccgcattccataaagtccgacgcgtacgcatgccatctcaattatggcactcaaagagtcaatcagacaacatgctgtcaagcgatcgcatgacaggaatcggctatccgtcaatgcctcagggtgctgtcgatgcatatccgattgaccgatgcttctacatgcgtgccgacatgtgccggtccttcgcgtccgcgtacgcattcttacatcacgacctcaaactaatctacgaaaaactttaaacagatatctatttgattttaatattatttatggtatacttaattttattaaacccgccgtggattgaaggaggcaggtatggatatgacgatgatcccgccgtggatgtcgaacctcgatgacgaggatatgacgttcatcaaacggtttctgctcgcatcaggctccatgaaggaggtcgccgcgcagtacggcgtctcctaccccaccgttcggcttcggctcgaccggctcatccagaaaatccagttgggcgagcagatcgagaacgagccgtatatcgcgctcatcaaacggctcgcggtcgatgacaagctcgacttcgacaccgccaaaatcctcatcagcgaatatcgcaagcagctcaagcaaggagagtaatcatgattggcgccacaatatttgccgtagtgtttttcgtgtttctcatcgccatctgcatcggcttcatcatattgcagatcaggctttcgaagatggacagcaagtggcccggtctggtattgcccgccatcacattgctgctgtcgcttgtggcggcgattaccgtcttcgccagggcggacatcggtgcgtatggcaacatgtggaacgtcgtgctttccgcattcatcgcgttcctgtccaacaacgtatccaccatcgtgctggccggcatctacttgtatcagcgtgacaagatcaatcgtcgcgccgagctggcccgtatgaacgttcaggacctgtaagccgcgaatccccacagccgcgcccaagcgacatcgccctcccccgaagagatcacgatgttgatggtgcgattgtggggttcgttacgtgtgaaaacaaaaacaggacgacgagaagacgagaactggaccgcgccatcatcgctcttacaggattcgatgttcctttcccaggaacttattgaccgacttttccattcgcgtcatcgccgccggaggcccacaccagcagggtacccgcgagggagacgacgatgacgccaagcacggccaccgcggtaatggtctggcgcagtatcggcgcggcgatgatcacgctcatggcggggtcgatggagaacaacgtgccgaccacgcgcgccgacgtgatgcgcccggacagcacagcctatgcaccaccaacgataatgttcagtgcaaacgcatagcggtcaagcacttgcatgatgcggcagagcgttactcaacaaaagccaagcaaagacaccgatagatgttaaggaatcagttatatctgttttttcgccagctacaggagagaatcgactataactgatttccatgcgcttcttcagagaagacaagtctgttggacactttgatggactaaaggccagaacacaatggcgctagatgggacaaaaggtacattggtcctatggctaagcgcaaacatatcggcaccgtaattctcacgatactggtcgcggctctgctggcgtcgggcatttccggctggctgttctggcagtcggcgcaacgggtaatcggcgaggcgcagtaatccgtcgagcagggcgacttcaagcaagcgcttgagcagatgggcagcgctggcagtcacatcgtcacggcgcgtgatgaaacccaaggcatgccatgtcaggccgccgaatacgtgccatattacggttcggacgtgaaggcggtgcgcggcatgctgggcgcggccgccgacgccgcgaccaacgccctgcccaaaatcgacagtgccgcgcagggcacgttggtggacttcaatatcgaagagctgctgtccggcatgaacttctccgacggcacgctgtccattcccaaaatcgcctccatcaagcaggatctgtccgacgccggcgtggtcttgaagcgcgtcaagacgtcgatttatgcgctgccgcaaccccacacagaacagatcaccgaaatggtcaaccagggcaagcaggtagtggaccaaatcgatgaggctttcgacaccttgaacaccatcgtcgagaagattccgggctgacgtcggtttgttcttgtcagacgtaccattcaggccggcgcagtcctaggaatggccgctgtttgcgcgctgctgcggtctgtgtgagatcgatgtcggcgataatcaactgttcttggtcgtcggcctcgctggcagcgttgacgtacgggtccaccaccactgattggccggcgaacgccacatcaccctccgtgccgacccggttgcccatggcgatggccacctggttctgcatgacctggacgcgaatctcccacaggaacatctccaacggttcggcgctgatatggccttgttcgttgatccatagcgaagcgtcgcagttgtggccgtcctgagctttgaggtacaggttcggtgaaaacgtacatgccatgttgccgagtcttgctctgcaatgcggcgacgtgacggtcggtcaggtccatgagatatcacgacgcatcgcggttctcatactgggggaagaacggggagaactgtatctcagggaagaacaacagatcggcaccggcctcaccggcctgatcgtagtaggccaaggccctatcggcgttttcgtcgatattgtcggtcatcgccatctgcgccatcgccagtctcatatcgtttccccatctttgagctgcgaaatttatccgtataggtcaattgtgttgtactccaatgtaatcagtcaatacacgccaagtgaaaaccattgaaaaacaatgtgacaacatcatgcggccttagcaaaactcccctcagtcgtctacggcgccagttcagccgtaatgaagacggtctggcgaccgcgctacatagctcgactgtcgcctcgccctcgcttacaaacagcttcgctgtttgcttaacggctcagcctccagaggggagccagtagacgagtagtgcgttaccgtttcacgattgagcgcttggcgaggtgtggggttttgtgttgtttgcggttgcggctggcggccgacttttcgcgctcgcgtcgggctttcgcctcctcgcgggcggccatcgcacgctcctcctctagggatggcagaccggctgcggcacggcgacggttgtcctgctcgtagtcgcgcctggccttgtgctcgcctgccgccgaaccgggcgtggggaaccatcgcaattgacagagcgtctggccgagattccacagattgttggtcaaccaatagagcagcacgccgaacggcaacgtggcacccgacaccacgtaaatggcgggaaagacgaacacggtcatcttctgcacacggaattgcggcgagaccatagcatctttcgacgtattgcggtgaatgagcatccactggatcgcgaacaacgtcaggcacatcaacgccacggccacgccgatgatgatgcgtgactgcggcgaggcaaccgtgccgaacgagtcggcgatgcgtacgccgaatatggacgatgattcgatgtcgcccgccatggtgtggtcgatgccgcccaacggttccgcattcccatcggcgattgcaggcagggattgcagcgtgtagaacagcgagcacaaaataggcgcctggatcagtgaaggcaggcaggagccaagcggattggcgttatatcgctgctgcaaggccatgatttcacgttgcatggcttctttggaacgcgggtccttgcgcgcggcgtacttgtgctggatgcgttgaatctgcggttggagcacctgtatccgctgcatcgcacgcatttgggaaaggaagagcggcagcagacagatgcggatgacgagcacgaggcacatgatcgcgatgccccacgcggggctggggccagcagtcatgccaaacgtgaccagggcgtggtgaaacagggtgagcagttgggcgacaacccattctaggggtcgcaggatgtggttgaggatattgatgaagttcattgggattcctgatgaattgacgaatctgggatgtgtttccgagttcaagcaactgcaatctggtacggcaacagctgggaactcccctcagtccgcttcgcggacagctcccctcagagaggggaaccaaattagggggaaacaagaacatcgcataaatgcgtatccacatgtcgcctaaacaacacaattgcgttagaccgtggggcgcaacgatgagagctgaaaagagaagctaaatcagattcgggaatcggggagcgtgtaacggggccagcgtggcatccattgcgggcgggcccatgagcggacggcgttcatcaccgtcgcatcgaagcggaagctggcgggcaacggtcggcggccggccgaacctacgaacgacaacagcacgaccgcgcagcacgcacatacagccgtcaccgtggcgacgaagaccatggcggccagggcagtctgcgaatcaccgccggcaatccagcagccagtggcactcaacgacaacaacaacgtcatcaacacgatgatgtccgccatcggcatcgaacgcgacagtacccgcccacgcgaggcagccatcgtccacgcaccggccaaacgctgccgcaacgactccgcacaggccacgggcagaagaactggcatcatcagcagcacgcatacggcaaaccccagccgggtgccaagtgcaatgccgttcatgatgttctacccattccttctgaaccatacttccgcctggaagacggtcccagtatatacccgattcgacgccaattcggtattgtccaaaagcactgaccaattcgacgaaaatcacatctcatccaccatgacttgtagcgctccgccactggcgtatcactgcatatcaaagtcgctcatcctcgaattactgtcctgcaacaccgaacgtgccgcgggctggaatgtattttgagtcctgagtagattaaccgttcacaagaccgatatcgcaacggcgcaacaaaggcaacagcacgcccaaaaagcccggaattccaccaatatgagatggtcgacaaaataaccaaaacgtcaacgaaaaccataggaggccatcgaacatgtccgagaacatggaaaaaaaaacaaacaacattcgatttgccgtcgggtttctggcctttggcctcctgtggagcaccggcctgtacgtggtggccaccgtgctgcgcatccagaaggtgaagtagccgctgcgagtgcctatctccgtttcagggggctgattttgactcagcatcatgcagcgcagctatatcctcggtgcgggtatactattccgggccgtcacgacgacgcctatggaacgcacgcacggcaaagagagaaacatgagtcagcccgacaccgacacggcggcacagtcgccgtcctcgcaacaggaaccgcagattcagacggatggccgtcgaagccattcggaacaggtgaaccaaccagcgcaaaccagccagtccgagtcgtcacatgatggcaaagacgagcacgccctacataccaacctgaagcgcggcatggagtcgcgccacctgcagatgatctcgttgggcggcgtgatcggcaccggcctgttcctgagctccggatacaccattcagcaggcgggccccatcggcacgatcctggcatacagcatcggcgcgctcatcgtctatctggtcatgctcacactcggcgaactgtccgtggccatgccggtgaccggctccttccacgtgtatgccgaaaagttcatcggccccggcaccggcttcgtgatcgcgatccagtattggctcacctggacggtggcgctcggctccgaattcaccgccgccggcctgctcatgcaacgttggttcccgaacattcccacatgggtgtggagcgcggcgtgcatcattctcatcttcactttgaacgccttgtcggtgcggttcttcgccgaagcggaattctggttcgcctcaatcaaggtgtccgccatctgcgcgttcatcatcatcggcctgctcgccatcttcggcgttattccgattgccggctaccagcatgctccgatgttcggcaacctcgtcaaggacggcatcttccccaacggcttcatgccggtgttcgccacgatcctgaccgtcaacttcgcgttctccggcaccgagctcatcggcgtgaccgccggcgagacgcgcgacccggaaaccgccgtgccgaaggccatccacaccacgctgtggcgtctggtgctgttcttcatcggctcgatcaccgtgatgtgcgcgctgatcccgtggcgccaggccggcgtgggcgaaagcccgttcgtgctcgtgttcaacagcatcggcatcccctatgcgggcgacatcatgaatttcgtggtgctcacggccgtgctttccgcctcgaattccggcttgtacgcctccacgcgcatggtgtggtcaatgggcaacgagggcatgattccgcgctggttcgccaaaacgaaccgccgcggtgtgccgatgctcgccctgtgcgccgcgatggccggtggccttctggcgctcctgtcttccgtgatcgccgcctcgaccgtgtacctggtgttggtggcgctttccggcctgtccgccgtggtggtgtggatcgccatcgcctactgccagatcgtgttccgtcgccgttggctggctgccggccattccgccagcgaactcaaataccgcacgcccggctatccgtacgtgtcttgggcggcgttcatcctgtgcaccgcatcgttcgtattggtgattttcgacgtggagcaacggttcgcgctcgtggccgagctcgtgttcatcgtggcctgctatggggcgtatttcctgcaacagtgggtacgcaagcgcaaaaaggcgaccgaggccgacgacctcgatacgctttgggtcgcgcgcgactgaacacatgaccatagtgtgatacacgtcacttcctgaagtacgtagtcgttatggaatcacccgcacgtttcccgtatcggagctgtacgatagctgtgagacaggggggtcgtcagatttcggggggagggttccggtaacggtccggctgcaggatgcaccggaccgtgcggcacgtatcaactcgtggattcacgccaaactcagttcagtatgccgattctcgtaaatggccagaagcggaacaacgccacaccttggatatcgtcgtatggcactagcccattgttgccgtcgtcaagatggtatcgagaatctctggaattggagcgattatcaccaagcacgaacacgttgccgtcagtaacggttacggaaaaagggctgtcgcttggattcacgccggacttaagataagcgctttcatcaatgggtttgccgttgaccgtgatgggctccccggatcccttgcaggcgacggtatcgccgggcagaccgatgacacgtttgattaggtaacgattgctgtcgattatcgacatcagattggtgggaagctgctccccctccatccagtctgcgggatctttgaacacgatgatgtcgccacggtgcagtgtaaagagtctcggagtcaatcgcgaggcaaatacgcggtcgccgatttgcaacgtgtcttccatgctgcgggatggaatcacatatacgttgaacacgaaggtacgtcccagcaacacgaccagcatcaccgcgatcactgtcagcagatagccgcgaatttcgctccaaacggagggctttcgcgcatatctcctcgactggccacgcgcttttttgctatgacgccccaccatcacatcctttccgaccgataacgcaacaccatagtcctcaaaccatgccgttacctacgcatgtttgagctcagctgtcacaccagcggttcgcgcacgtccagttcacaggcgatgccggtttccttgcgggcccattcggccgcctgcagtgcggcgatgttccataatgcgcacggcactccgccaaggtccggatgcgatgcccagaatgtgaggtcatcagcgtatgcggtgatgaccgattcttccgtgactggcataatcgtgtggtacaggcggtccgcaagtgtggccacgaattcgttggccgcggcgaacgtgtcgatgagatgctgttcggcggtcaccggcgggccgaccagctcccaggattcgacatccgtggcgctccaatgcgcggcttcgccgtccacttcacgctgcaaagagacgaacagcctggcgaactcatccgaagtcagtcccgtaacccggcgtcgggttgacaattcaatcggagtcatcagataccgttcctttcgcttcgttcattccgttgtttcgctgcttggatttgctgccagccggcacaaagcccatctcgcacacctcacgatagcccaaactaccggcatggccatgattgccagccctacgaccagtagccatgaggagccggcgtaatggcctcatcgagcattgtcggatgattcgcgtggcccacaatcgagacagtatcggtttccgttcggttcgtgcggccagactatcgcccgttcttgccgattgcctgtaagcaggttcggatagactggcgcgagaacaatgcgagaaagaggcaaggatgacccggaaacagtcgcaacagcacgacgcacaacgcaaaccgtcctggcgcgtacgctggaaaaccatgagccgagccgtgggcatggaaatccgcgagcacaaaagctcattcgcggtctatgtggtgctgcgcatgctggtgctcgccatggcaatactccagttctttaacggcgactacgaaaatgtgttcctgtgcatcctgacgttgctgctgctgttggcgccggcgttcatccaggtgcagttccgcatcgagctgccttcggtgctggaagtcatcgtgctggtgttcgtgttctcggctgagattcttggcgagatcagttcgttctatgagatcttcccgttctgggacacggtgttgcatacgatgaacggcttcctcgctgcggcgatcggcttctcgctggtcgacctgctcaaccggtccgaccgggtgaagttcgagctttcgcccctgtatctggcgatcgtgtccttctgcttctccatgaccatcggcgtgatctgggagttcttcgaattcggcatggaccagttgttcgggttcgacatgcagaaggacgccatcgtgcattccatcagctcggtgatgctcgaccccacgcacaccaaccatgcgattcgcatcaacgacattacccaggtcacggtcaatggccaagacctgggcctcggcggctacctcgacatcggtctgatcgacacgatggaggatctggtcgtcaacttcatcggcgcggtcgtgttctccgtgttcggtttcctgtacgtgaagaaccgcggcaagaaggactccatcatcagtcgtttcgtgccacgccgcaagtccgccgaccgcgattacctgcgactggtgattgatggcgggagccgggaaagtcatacaaatatgagagatacagtaatcgaacaaacgttcgactgccctgataaactggatgcataatttagcgacgacaacgacatgatttacagacgcccgaaaaaagaaaggcgatctcatgactggcgaggaactgaagcggcagattgctttgtatgagagcgcggaccacaccgtgcacctcgatgtgaaggtagacgaggacacggtgtggcttaacagacagcaattggccttgctgtttggccgcgatatcaaaacaatcggcaagcatgtcggcaatgcattaagggaagagctcaatggattttcagttgtcgcaaaatttgcgacaactgcatctgacggtaagacataccaagtcgagcattacaacctggatatgatcctgtcggtcggataccgcgtcaaatccaaggaaggcatctatttccggcgatgagccaactcagttctgaagcagcatctcgttgatggttataccatcaatcgcaagcggcttgacgcacttcacgccgtcgtcaaggtgctatcgaggtccaccgaaccggaaattgctggcaccgccgagatcttggaacgatatttgccgagtcttgtgctgcttaacgactatgacacaggcaatgtccctatacccaagggcgacgagtcccagtgggtcttgacctatgaggacgcgatgctgttcatccggtcgatgccgtatatgccaatcactgttgtgtttgcgaactccttcgctcatggtgccgaaaatgcatacatttggttattcgctgtttgcggtggggcgtgcatgggttagtgtttcgggttcgattccctgtcagaaaaaataatcgagtgcgggattacggccggtaaggctcctgtcgtggatgcggatgcgcgccggtcttacggtggtgctttcccgaaacgtggattgcacgaggtgtgggacggcacgcggattcggccgttttccgcccgccgtcccacagcgctcgctatgaacggttgtggataatcatggagctgtagcggaaatcggcgttattccgcggtttcgacagttaatagaacaaatagaacaaatagaacagccagcttaggcacggcgcggcaaatggcgcaaaccggccgcgatagtagtagcgtggtgcataccagtacaaccatgcgaggagaacagccatgatcaatgaggaatacaaggccatgcttggcggcaagtccgtgattcgcgagctgagcgagtacgccacgagccgcggtgccgaaatcggctaccagaacgtgttcgattacagccttggcaatccctcggtgccggctccgaaatccttcaccgacgccatggtcgacctctacgaaaacggcgatccggtggccatccacggctactccccctcgctcggtatcccatccgtcaaggacgcgatcgccgaaaacctcaacgaacgtttcggcatggcatacaccggcaaccacatcttcccgaccacgggcgcggcgggcgcgctgtcccacgcgatgcgtgcggtgaccaagccgggcgatgagatcatcaccttcgccccctacttccccgaataccagccgtacgtcaagggcgccggcgccaagctgaccatcgtgccggccgacaccgagaacttccaaatcaacttcgacgcattcgaggctgcacttaacccgaacgtgcaggtcgtgcttatcaacaccccgaacaacccgtccggcgcggtgtattcagcggacacgctcaagcgtctggccgcgatcctgaccgccaagcaggtcgaatacggccacgatatcttcctgatcagcgacgaaccgtaccgcgaaatcgtgttcgacggcgccacccagccctacccggccagcttctacgcgaactcgctgacctgctactcgtggtcgaagtcgctgagcctgcctggcgaacgcatcggctatgtcgcggtgaatcccacagccaccgacgccgacctgctcgtgcccatgatgggccagatctcgcgcggcaccggccacaactgcccgccgagctcgattcagctgggcgtggccaaggtcatcgaccagaccgccgatctcaacgtctacgagacgaacatgaacctgctctacgatgcgctgaccggcatcggcttcgacgtggtacgccccggcggcacgttctacatcttccccaaggcgctggaggacgacgccgtggcgttctgcatgaaggccaaggaatacgacctgattcttgtgccgtccgacagcttcggcgtgcccggatacttccgcatggcctactgcatcgacacggagaaggtcaagcgctcgatccccgtgttcgaaaagttcgcccacgaggtgtacggcctgtaaacacggaccgcaagtaacaaacacaagaaaggggttgccatggaatacaccgaagacgccgatcgtcgcgaactgctgctgcacagcgcctatgactccgatacggtccgggccatggagcgacccctgctggacaaaggcgtgccgctgatgcgcatggccgcccaggccgcggcccacatggcggccggtatgctggacgacgaggatctggcgctggaggacacgtcgatcgtgctgctggccggggccggagacaatggtggcgatggtctgttcgcggccgccgcgctggcccaggagggcgcgaacgtcaccgccatcgccgtgggccggtcgttgcatgaggccggattcgcctcattcgtgcgcgccggaggcaaggtgctggtgcttgatcccgcggctgatattcccggttgcgcgtccgggttttccgccggtgaggccggcgagcgattgcagaccgccatcgccgtggccaggaaatcgcatctgatcatcgacgcgatgaccggcatcggcatccaaggctcgctacgcggcatccccgccgcactcgcctccgcccttggtctcgacggcgaggctcccgatgagcccgccctgccaaaccgtgagtcgtcaggcgattttccgctggtacttgccgtggatacgccatccggcgtcggtgtgaacgatggttctctgcccggcccgtacattccggccacggtcacggtcacgttcggcgcgatgaagccgtgcgcggtgctgccgcccgccacgttcgcctgcggccgtatcgagttgctcgatttcggattcgatatcgacgacaaggatccggacgtcgaggtggtggataattcgttcgcgtccgacgcggtccgtctccccaggttcgaggattccaaatactcccggggcgtggttggtctggtgaccggctcgcagcgctaccccggtgccgccgtgctcaccgccagcgccgccgcccgcgcgaacaccggcatggtccggtatctgggcccggagcgcgcgcagaacatggtgctcgccgcactgccggaagccgtgatcggcaagggacatgtgcagtcctgggtcgtggggtccggcgtgcccgaggctagcgtcgagggcaccgacggcgatatgcagcgggacaccatcgccgcattgctcaagcattacgcgctcggcagcgaggatgagaacaaggacgcctacgacatgccgccaatcgtggtggatgccggcgcactcgacctgctgccggagcgtgtgcccggccaggtggtgatcacgccacatgccggcgagatggcgaaactgctcaaccggttcgaaaccgccgccagcaccgcggagcatgccgattcgcacgagccgtacaccgccgacgacgtgcggttgaacccgttggccagcgcgaagcgtgcccacgagctcaccggcgccaccgtattgttgaagggcgcggtgaccatcgtggtggatgaggaccacgtctatgcgtcgggtagcgcaccggcctggctgggcaccgccggcgcgggcgacgtgctggccggtctgaccggcgccctgctcgcccagcaggatgacgtggccaccacgggcgagaccgtggcctcggccgcctacctgcatggcctggcggcggcgatcgcctccgaatccgagcaacaaggctggcaggagccggaactgatcggccgcgagcatcgccagcgcttcatgacgctcggccacccgattgtggccggcgacgtggcccacgccatccccgaagccatcgccgacgtcatcgcatgattccgtacgttggctcccctcagagaggggagccgacgtatgaaaccccctatactaaatcgcagaccccactcaacggccccaacaacacaaggagcatcatggccaactcccccatcaccgacgtgattttcgacttctgcggcgtgctgctggactggaacacccgcgcatgcctggaaggccgattccccgatgagatcgtggaacgcatctgcgccgacgacgacccctgcggcttcttccgctacgaggaccgcatggacaccggcgaggatttcgcggacatctacccggatgtggtacgcgaacaaggccaggaactcgccgacatcttcaagttctacatcggccactacgcggacgcgctgccccgcacgcttccgggcatggtcgagctgctggcggatttgaaggcccacggctacggcgtatggggtctgaccaactggtcgcatgagaccttccacctggccttcgagaagtacccgcgccttgaacagctgttgcagggcaccgtggtctccggcgtggagaagatgcataagccgaacgccgacatctacgagctggccctgacccgtttcggcctcacggccgagcgctgcgtgttcttcgacgacaccgccaagaacatcgtcggcgccaacgaggtcggcatccacggcatcctcttcgagaacgcgttgcaggcacgcgaatcgctcgcagaactcggcgtacgtctgtaagtcgccaaacgttgcatcgcggcagttgaagtctatggacccgtccttgacgacggtgaccggccgtgtggcgactatccctagcgatataaatagactttatgacactgctgcagctgaaatacatcgtcaaaatcgtcgagtgcggctcgatgaacgaggcctcccatgccctgtacgtctcccagccggccctgagctcgtcggtcaaggaattggagaacgagctgggcatcgagatcttcacccgctcctcgcagggcatcgccctgaccgtggacggcgcggaattcctgacctacgcccgccaagtgctcgaccaggccgacctgctcgaagagcgctataagcatgccaaaccgcgcaagcagctgtgccaggtctccacccagcactacatgttcgccgtcgaggcgttcgtggagatgatcaactccatcaagtccgacgaatacgagttcaccatccgcgagacccgcacgcgcgacatcatcaaccaggtcgccaacatgcagtccgaaatcggcatcatctacctgtccgattttaacaaggacgtgatcggcaagctcctgcgcgagaagcacctcgaattccacccgctcttccgcgcgccgctgcacgtgttcatctcgcgcaacaacccgctggccgccaagaaggtcatcaccatggaggacctgaaaccttatccgttcatccagtacgagcagggcgaggaaggctcgttctacttctatgaggaagcggtctggccggagtactcccccaagcagatcaacgtgaccgaccgcgccacgatcctgaacttcatcatcggcctcaacggctacacggtgtgcaccggcatcgacaacggcgacctcaacaacgagaagatcgtcaccgtgccgctcgacaccgacgaaacgatgttggtcggctggatcacgaacgagcgttccaagctctccaaggccgccgaaacctatctcgacaagctcaagtccgtagtctccgaccacggctacaagctcattgattaggagtaagtaaaacaggcatggtcagcagtgagatatactgcgattaagccaaccccgctggggaaatggaagtaagggccggctcctgagtatctcaggggccggcttttgcgctattgagactgactggcaaaaccagtttgatggcctccgactacttggccaagattaccgacgcggcggctgtcgcggcgaagcctttgagcacttcaatcatcacgtcgcgatcttcgacatcaatgttgcgggccgcggcgagcataatcggcagtgactgtgtcaaatgcgaagtgaggtcgccgaatgtgtcgtatccgccagcctcgaagatggcaaacaggttttcgatgaacttgcggcgatgctcgtcgtcgtattttgccatccatccgttgatcgtgcgtgccaggtattgcgcgctacttgtcagtccatcagcctgtacgaattggccatgatcgacttgccagtgcaatgcgaaatgctgcatgatgctggcaccgtcgctgctgaccaccgtatagccgtcttccacatgctcacgagtctcaaacagcatgccgatgatcgacgagcccggtaccgatttatggatcttcgacgcaatgcgtacgtacccgtcctcatcgaagaacacctcatcgaatccaggcccatcgtgcgaatatacgaccgtgatacgttcctgaatctcgctaggcacattggccgccgcatacaccgccagattgccgcctttggaatggccgccgaccataatcggcccggcccaatggccagccagctcggtcagataacgcgcggcggcctcctgcgaggcgaccgggcggcggaacgccatcatgaagtcctctttccacccgacgattgagctgtcggtaccgcgaaaagccacatagagcgtgccgttacccagttcgaacacgcaggccgagaactgcttggtggttgcagcatcgaattcgtccacgtatgcgcccacgcgtaggttcctccaacgtgggctctcgctcatcgcacgtaacagatcgacattcatcgaaggcgaccacaccttgccgaacatgtcgtcatagcattcggcacgcagcaaatcgtgaatcggaaccgtggcgatcatgccgtcggcggtctctgcattctcgtgatagcgcggcacgttatccggcatgcgagcataggccaactgggacaaagcgaggctatccgcctcggtgaacggcagttcggcgaaagtgtcgaaatgttgccgaatatcgtcggtgatgttccccatagcggccttccttgttcgaatgcaacgaacctacggtaattctacgccgagcgggttttcatcacaggcgagtcggtcccagagtttagaaccctatctcgctttcaagggagctgatttggccttctggagacatttatctccgtttcaagaggctgttcatccgtcatatcccgagtatgagcggcgtcaccccaacgtcattccgccattttcatgctgcttctacttgggcatcagcatctcggcggtcttcttcattaccttgcgacaacttgttcgctttgctgtccagatgatgctcgatgccgaagtaactgcatatccccacgagcgcaaacagccctatatcaactaaccagttcatagcacgctccttgccaaagcttttgccttaatatggtgctgctgttcatggaacgtaataaaaaaagcgggctcgcaagcccgcttttggtttttagattgaagacgatcaggcgccgtattcctcaaggtaggcggcggcgcgctgctggatgtcgtggctgagcagcggggtgccgtcggggttcttcatcttggcggcggcgtcgaagatctcgcgcacgttggcgatggagagcaccgggaagccgaattcggcttccacggccttcacggcggacatgtcggagtccttggtcttctccatgcggtccacggagagcacgagacccacgacctcgacgttcgcctcggccttgagtttggggatgacttcgcgcacggcggtgccggcggtcatcacgtcgtccacgagcagcaccttcatgccgtcggtcagcggggtgccaaccatccagccgccgtcgccgtggtccttcttctccttgcggtcgaaggtgtatccgacggtcatgttgtggccggcggtcagcgcgatcgcggtggacacggccagcggaatgcccttgtaggcggggccgaacacggtgtcgatgttgcggggaatcgtgttgtgcacgatggcctggctaatcttttcggcgtagaacgcgccgagcgcggcgatcttcttgccgtcgtcgaaggcgccggcgttgatgaagtacgggctcttgcggccggacttcagcgtgaagtcgccgaacttcagcgcgttggattccaacaggaattcagtgaagcgatgtgcgagtgtttctgccatgatgttccttacctccaagtctgtcctgcggccagtttagcagcgagttcgggacggctgtccaacaggtcgtcgagttcgcgggcgacgcgcagcggggccaccgggtcgaagagcgcggccgcacccacttcgacggcgttcgcgccggcgtacaggtattcgagcgccttctcgccgctgtcgatgccgccgaggccgatgatcggaatctccggcagtgcggtgcgcacccgatagacggctgccaggccgaccggcagcacggccgggccggatacgccgccggtgacgttggcgatgatcggcttgccggtgcgaatgttaatgcgcatgcctttgagcgtgttgatcatgctcaacgcgtcggcgccatgttccacggccgcgcgcgccggcacggtgatgtcggtgacgttcggcgtgagtttgacgatcatcggcttgtcggtcatcgggcgcagccggtccataagattggcgagggccaccgggtcggtgcccacgctcatgccgccggcggaaacgttcgggcagctgacgttgatttccagcatgtccgcgtcggagtcggcgagcttttccacgaccgccgcgtaatcgtcatcgcaatgtccggcgacattggagatgacgaacgcgcccgcggccttgagcttgggcaggtcctcggccaagtaatggtcgatgccgggattctgcaggcccacggcgttgatgttcgcggccggcgattcggcggtgcgcggcgagggattgccttcccacggtacgggcgaggcgcccttggtgcatacggcgccgagctggctgacgtcgtagaaccagcggacggcggcgtactggaaggtgccggaggcggtgccgaccggattcttccattccagaccggccaccttggtgtggtgcttccacacgtggggctcgtacaggttgatgtggttgtcgccgccctgcgcggactggttgtttgcgctcatcgtcacttcccccatccgagctgttcgcgggtgaacacgggtccgtcggagcagaccttgaggcggccgtccacggtgtcgatggtgcacagcacgcaggtgccatagccgcagcccatgcgctgttccatgctcagctgcgcggggatgccgcgttcggcggcccagtcggccacggccttcatcataggcagcggtccgcaggacagaatgatcggcttgcgatcgtaggccttcaggtcgtcgccttgttccagtttgttgagcaggtcgaccacgttgccttcggcgtcgtcgatgctccacgaccagtccgcgtaccgggagacgtattcctcggcgaagtggtcgttgcggtaaccgaatacggcggtggcaaaggaggcgtcgtgttcggcgagcttttgcgcggcgtagattagcgggggcacgccgagtccgccgccgacaagaatgtagttggcgtcttccttgaggttgaagccgcggccgagcgggccgagcacgtcgacggtgtcgccggcctgcagtcctgccaactgttcggtgccgtgtcccacgacggcgaagatcacgctgacttcgtcgccgtcgacttcgctgacgccgaacggacgcggcatgagcatgaagtcgtcgtgcgtgaacaggttgacgaactgggcgggcttggcatgggaggcgatgaacgggtcgcggaacgtcagtcgcatcacgcggtcggtcagttccgtaacctgcgtgatttcgacgttgtggcgcggcgggaagaatccggccgcagtcgcttccgtaaccacatcatgggtgggggtgaaagttgtcatttcattcctattcagcacatcaagctccccctatcaggggagcggtcaaccgcaggttgactgagaggtagttaaacacactcggctccggtttccagcccacactcacgtatagcccacagccggacaatctacctacctatatacggcaacccgcagattatcgcgcatgtcgagcgccgcctggcgcgcgctgctcgccacaaggtccagcgcctcgtcggcggtcatggattcggagtacttgccgctcttcttccatgcgccgataatgccgcgcgacgagttgacgatggcgccgctgccctgcttgtcgaacatgcctgccacgtccgcggccgtgccgccctgcgcaccgtagcccggcacgaggaagaacgtgtgcggcatacgttcacgcaacgccttgccttcctcggggtgggtggcgccgaccaccgcgcccacgcgggagtagccgtggctgccgatggtctcggcgccccatccttccacaagatcggccacgtgctcgtagaccttcgtgccgtcggccaggtcgagcatctgcagttcgctggaggacgggttggaggtgcgcacgagcacgaagatgtccttgtcggcttcggcggcggcctcgacgaacggggtgatgccgtcggtgccgagatacgggttgacggtcaccgcatcctcatgccacgggtcgaagtcgcccacgccgttcaggtggtgggcgtaggcggctgcggtggagccgatgtcgccacgcttgatgtcgccgagcacgtagaggccctgctgggccgcgtattcgcaggtcatcgtgtagatgtccacgccggcggggccgagcgcctcgtacatggcgatctgcggcttgacggcgggcacgatgtcggcgatggcgtcaatgatcgtgcggttgtattcgaagtaggcgacggccagctgcgcggattcgacttcctccggggattcgaccgagtcacgcacctcgtcggcaaagctcgccacgacctgcggcggcaccagcgcctcagtggggtcaaggcccacgacgctggggttctgagtgttgtcaatcgcttcgatcaggcgatccatgctgctccttgtgttatctacagacggctgaacatcagctgggagccgatgattgtggcgagggggcgtccggtgacctgccagccgccgaacggggtgttacgagccttggagtggaactgttcggggtccacggtccattcctcggcggcgttgagcaccacgaggtcgacattgtcggcgtcatccacgcggctcaagtcgagcagtcggttgacgccttcacgctgcggctgagcgtcgctctcccccgcaatcacgccatccggatcatccccggtgggcgcgggttcggcgtagtcctcgaccagcgcggctacgtcggttggcacatgccccatgagttcggcaggtccaacggacatgagctcgatcagacgctcatcggaaatgaagccgccgtcgacgagcaccttgtggcacacgccgtacgcgcattccagtccgatgatgccgttgggcgcctcaaggaagccgagttccttctctgccaacgtgtgcggcgcatggtcggtggccagcagatccacggtgccgtcggcgatggccgcgatggtggctttgcggtccgcttcggagcgcagtggcggattcatcttggcgagcgtgccgtacttgagcagcgcctcgtcgctcaacgccagatagtgcggcgcggtctcgcaggtaatcggcagtccttcggccttggccctgcgaatcgcctcgaacgagatggcagtgctcacatgctggaagtgcacgtggacaccggtgcggcgggccgcttcgatatcgcgggccacgatcttgagctcggtgtcttccggaatgccgggcacgccaagctcgcgggaaacggggccttcgttcacggcacctgtatcgtgatgctcgcaatgctcgatcaggtacaggtcggaggccttgacgttctccagcacctggtccaggatctccggcgtcacagcggaaccgtcgtcgctgattgcggtgatggggtgcgtgagcatggccggcgtcttggcgtcgtcctcgaatccgggcacgtacttgagccaatcggcaacgtcgcttgcctcatgaccggcgcgatccttggacgcgcacacgcacagatcgtaacgaaccggcaattgaacgtcatgcgcagtatcgtactgctgcaggaagtcgatgacgttgtcgaagccggcatccagaacctcttttgcaccggtcgcttccgggccagacacggtctgcccatccagtgccggcaacgtgttcggcatgatgagcacgttcgtgtatccgccggatgcggacgcacggcagccggagaccatcgattccttgtaggtctggccgggatcgcggaagtggacgtgtgggtcttcgaaaccgggggccacggtcaggccggtggcgtcgatgtcggcgccgtcagccacggcggaggtgtcggcgaagtaggcggcagcggtcccgggcaccacgaggtcgatgacctcgccggtgttccagaccttgatgttgcgtagggtgatgctcacagtttggcttcctcgtcgcagtagtcgcagcggtattcgagccgctcggagtgcacgaggtggaacatctgcttgatgccgggctcggcggtggtcacgcagcgcgggttcacgcaggaaatcacgccgacgatgtgctcgggcaggttcggctgcttcttttcgacgatcttgccgccgcgcaccacgtccacggtggcttggcgggccacgaagccgagcacgtcgaggtcgatgtccttgtcatcttcgattttgatgatgtccttggagccgtaacgcttggagtcggcgttcatgatgagcgcaagcttggttttggccgggtcgattttcaggtattcgagaaccttcagcgaggttccggccggcacatggtcgataatgatgccgttctgaatgctggtgacttccatcaggcctgaacctccttggggttgagcggttcgtatccgggcagttcgtcgcccaccacggtgctttcgagggccatgcgcacgagcatgccgttcttgacctgttcgaagtaggcggcacgcgggtcgtcgtccacgtccacggcgatttcgttgacgcgcggcagcgggtgaagcacggccatggacggcttggcgagctgcagcttctcttcgtcgagaatgtaggtgtcgcgcaggcgcaggtagtcgtcttcgttgaagaagcgttccttctgtacgcgggtcatgtacagcacgtcgaggtcgccgatcacggaggccaggtcgcgcacttccacgtaggagcagctgtcggtggcgttgatgcggtcgatcacgtactgcggggtcttgagctcgtccgggctgatgagcacgaagcgcacgttgccgaagcggcacagggtctcgatcagggagtgcacggtgcggccgaaggtcaaatcgccgcacagtcccacggtcaggtcggtgatgcggccgaagcgcgactgcagcgtggccaggtcggccagcgtctgcgtggggtgcatgtggccgccgtcgccggcgttgattaccggcacggatgcggcgcgggaggccaccagcgcggcaccctccttcgggtgacggatggcgaccacgtccacgtagttggacacggtcttcaacgtgtcggcgatggattcgcccttggtcacggaggccagctgcgcgccggcgaatccgatgaccttgccgccgagacgtagcattgcggtctcaaagctcaggcgcgtacgggtggagggctcgtagaacagcgtggccagcactcgcccatcgcaggtatgggcaatctctttgcggtgggaatcgatgtattcggccttatgcagcaggtcgagaatctggtttgtagacaggccgtccagcgttacgacgcttttgccgaccattggcgtttcttcagacaaggctcaccttttcgctcgtggttttcaggtggccacccttgcgtgacctaatctaacttacgccatttttcggacagccgcattcaccgagtgtccacctgaaaatccaacgaatatgctgccttatcgctgcgcgcggcgtcgatttcgttccagtcgcggtgcgatcacgtgcatacgcgggcgaggggcggtttgcggctgctgcgttgcggcggaggccgtggcggtggttgccgcagccgcctcgccttcggtcttcccatagaacaagcgctggcatacgtcacggcatttgcgcatcacggccagcaggtcgttctcgaaatgctggccgcggtgggcgccgtagccgaggtagacggcgatgccgcccagcgaatagatgtcatcaggcagaatatcggcctggttggcgcgcccgctccacagatagctgccgttgcgggccgcggtgcacaacgtccatgccttgcgcagctgaatcgcgtcgatagcgctgatgagcttcttggcttccagcacgtccaatgcctccagcgtgccgttgacgcgcagatctttgatatcgccggcgtgctggagctgcatgagttgcacggtccattccacgtcagacaagccgcccttgccgagcttcagatgccgttcacggcgcacgccgcgcggcagacgctcggcttccatgcgggccttgagcttgcggatgttctgcaattctgcttcagtcagttccgtggtcgggtagcgcagcgggtcggcgatgttgatcaggaagtcccgcgccagttcagcgtcgccggccgcgtaccgggcgcgcagcagcgcctggcgctcccaggtcgaagcccaggattcgtagtattcctcgcaggaggcataggagcgcacgagcgggccgttcttgccttccgggcgcaggtccaggtcgagttcgatcttgggttccagcgtcgtcggtccttgcaggatgttgcgcaggtcttccacgaccttcttggcgaaggcgttggcttggccgtcgtcggcatcgtcggccggacggtagatgagaatggcatccgcatcggagctgaagttcacttcgcgcccgccgtaacggcccatggcgatgacggtgatgccggccggcgcggtttcgacgccgaactcggcgatctggtggcgcacggcccaggtcagggaggcatcgatgatcgcgtcatacacgtcggtcatggccttgagactgtcggagtcgctgatcacaccgctcatccaagacaggccgatgcgttcgatttcgtggcggcgcatggcgcgcatggaggtggcgaactcgttgatgttcgagccgaaacgttccagcgccgagccggtctgcacgtccaaggcctcgcgcgtgcgggcctgcagattgtcgtcgtcgccaagccagctgatcgattcgaccgacttgttgagcgcgtcgcccaggaatcgtgagttggacaggatgtggcacaggcgctgggcggcggaggtggagtcgcgcaggaagccgaggtagccggattcggtgccgaagttctcctccagtttgcgccagttgagcaggcccatgtccgggttctggccctcgcccagccactgcaagacggcgggcagaatgatgcggttgattttggccgcgcgccccacgccggcggtgagcgcctgcacgtggcggatggcggcgtccgggtcgccgaaaccgatggattcgaatcgttcctgtgctgcctcgacgctcaggacgatctggtcgttctccatctgggcgttgaccggcagcatcgggcgatagtagatgtcgaggtgcaggtggcgtacttcgcggcgggtgtcgtcgtacttgtcgacgagttcttccgggtgcaggccgaatgcgcgggcgagtcggcgcagctcctggttctggttgagctcgtccacgtcgatgtcgcgcttcttttcgaggcctccgaccgaggcccggccgaggtccgggaacaggtgcgtgcgcttcagggaccagatctgctggcgatgttccatcacgcgctcgaagcggtagtcctgggacatgcgcacggcctgcttgcgcgagacatagccgccttcggacaggcgctgcagcgagtcgagcgtgttgctggtgcgcagcgattcgtcggtgcggccgtgtacgagctggagcatctgcacggtgaattccacatcgcgcagaccgccgcggccgagcttaatctcgcggtccttcaggggcgcgggaatcaaatcctccacgcgcttgcgcattttctggcagtcgtagacgaagttcttgcgcttggatgcgctccacacgaacggccgggtcatgtccatgtaggcctgaccgaggtcggggtcgccggccaccgggcgggccttgagcagcgcttggaactcccaattctcggcccactgctcgtaatagttcttgtgcgaggagagcacgcgcaccagcgcgccgtccttgccttccgggcgcaggccgccgtcgatctgccacagcggctgctcggccacgcccatgatggcggactggcagacgcgctgtaacatggtgcccatcttggtgcccacgcgaatcagcgtctgatggtccacatccttgtcggccggttcgaccacgtagatgaggtccacgtcggagacgtagttcagttcctgtgcgccgagtttgcccatgccgatgatggtgaagcgcacgtgctcgctgccctcggtttcgtggcgggcgatggccagcgcgccttcgagcgccgcgtccgcgaggtcggacagttcgcggctgatggtcggttggatggaggtcgggtcgtccgccacggcatcctgggcgatgatggcggccagttggttccggtagctggaacgcagggccgtggccgcttcggccagatccttggaggcgacgggcatggccggttcgtccgggtccgcgccgaccgccttgagcagacgtgcacggcgttgcgcgtgattgaacagatggctgttacagttgtcgactgctgccgcctccacaagctgcggcttgaagcgcatgaacttgcccatcgcgtcggagacgccgagcaccgtgaccagacgcttcagggcgtcgttgtcggggatgacgtgttccagatcgcgctggctggattgcatcgcgttgacgatatccacgaaattgctcaatgccatatcggggtcgcaggcgtgggccagcgcgctcagcagttcggcgcatcgctcatcgggaatgtcgtccgccttgagctggtcgaacaaggcgcgggccttgtcgaggtcttgcagacctgccctgatgaggtccatggagctgggtttgaagatcgacgattccataagattccactatatacgctcatgccctccgaatggggcatgagccgggaaggagtcatcgggcgacgctgatgagctccgaggaatccatatcgtaatcggccatggcgtaggaacggatggcggggtcatcataggtgttcatgtaataggtgttggtcttggacgaatatccgctggtgaacagcgtgcgttcgaactggccgtcgcccatcttcgccatgccgtccaccatctgcacggagccgagggtgtggaacaggcgcgacacattggcggcttcatcgttctgctgcgggtaatgcgcgttggtgtaggccacacgaacgaagcgcgacggggaactcacgtcgcccgggatgccatgcatgcccacacccgcaccccaggcggtcaaggaggccttgccccatgaagtcggttcggccatctcgttgctgacgcacatgtagttgcgcaggttttccatatggaagtcgaacgtcggctgattggtcagcacatcgacgtcatcatgatgcacgtgcatgccatcggccatctgctcgacgacgatgctgcgcttgccgtcgccgatgaaccagtgcagcagagactcctgctgtcccggcacgatctgggagacgagcgtcacgttcctgagcgcctcctcgacctcgtcgacggagtcgaaattacgcgccacccacagcggaaattcgaacgtggcgacgttttccgtgccttcgaccggttcgtggacgaacgaggcgtagccggggaaattcaagccggcgatggccagaccatgttcattggcgcagtcgaaatacatcggcctatcggccatgaccacacccacgccgatcaccgcgttcggcttcgccttgccgcccgcaccaaacaccgtgtcatagtggtagccgcgcggagtaaccaggatggtctccccatatgagaaactccagtcgagattacggccgaaataggtgttgccctcatcatcggagaaacggacaccagtgcacataacggactcccttccatcgctttggttggcttgcacgttcatgatacccatcggccgctgggagaactctgggtttcgccagcagatcaacgtgcggcgcgacgcattgagatgcgccgcgccgcgatacgcgtcaaccttgcgtaccgcggaacaacggttccgcattgcgccagatacggcgcgtggtggcggggtggttcatcgaatacaggtggacgccgtccacgtcgtgggccacgaggtcggcgatctgctcggaagcgtagaggatgccggcggcacgcagggactggatgtcgtccccccacttgttcagcagggtgttgagcctgtccgggatgcgcgaggcgttgcgctcggccatgcgacgcacggacttggctccacgcaccggcatgatgcccgcctcgatcggcacggtgatgccggcggcgcgcgccttgtcgaggaagcggtagaagtcctcattgtcgtagaagagctgggaaatcaggtgagtgacgccggcatcaaccttgattttgaggttttcgatgtcctggtccagcgagtcagcctgatagtggccttccgggtagcaagcaccaaacaccttgaagtccggcttcacggagcggatgtatgacacgaggtcgctggcgtggttgaactcgccgaccagctgctcgccgtcgatgtagtcgccgcgcagcgcgagcacggcgctcacgccggcttcctcgaacatgtcgagagcctcatcgatcttggccttgtcggagtagagcgcggtcaggtgggcgactgcagggatgccgtattccttgctgatcgtgtgggcgatgcgcgcggtggcggtgcggtcggaatgggtgccgtgaccgtaggtcacggagatgaagtcggggttcagcccttcgagtccgtcgagggtgtcgtagatggtgccgacaggcgcgttgcgcttcgggggaaagacctcaagggtgaacatcggggaatgcatgctgatttccttacataaacccgagctccctcatccagagggagctcggtgatttccgctacttgtcgagcttggcgcgcacggccttggcggcggcgaccaggttctccaggctcggccaggtctcggcgttaccacgggtcttcagaccgcagtcagggttgatccacaccttcttgacgtccatcttgtcaaggatctcgtagatacgatcctcgatctccttctcggaaggaatacgcggggagtgaatgtcgtagacgcccgggccggcctcggtctcgaagtgcgcgtcatgaatggcgtcgagcaccaccagatcgccacgggaggcttcgaaggagatcacgtcggcatccatcgcgtcgatgtcgcggatgatgtcgttgaactcggagtagcacatgtgggtgtggatctgggtggtcggcttgacggcggagtgcaccagacggaaggccggaacggcccagtcgaggtacttgacgtgccagtcggacttgcgcagcggcagcttctcacgcagggcggcctcatcgatctggatgaccttgataccggcggcctcgagatcgagcacttcgtcgcggatggcgagggcgagctgcttggtctgctcctcgtgggtgatgtcctcgcgcggccaggaccagttgaggatggtcaccgggccggtgagcatgcccttcatcacatggtcggtcttggactgggcgtacgcggaccattccacggtaatcgggttggcgcgggaaacgtcgccccagacgatcgggggcttgacgcaacgggtgccgtaggactggacccaagcgttcttggtgaacaggaagccgttgaggttctggccgaaatattcgaccatgtcgttacgctcgaactcgccgtggaccagcacgtcgaggccgatctcctcctgcttcttgatgacggcgtcgatctgggctttgatgaactcgtcgtaggcttccttggtgacctcgcccttgcgcagcttggcacgctcggcgcgaatctccttggtctgggggaaggagccgatggtggtggtcggcagcagcggcaggccgagggcctcgcgctgcagggcctgacgctcctcgcgggcaggctgacgcacgtagtcggcgtcggacagcttgccgatgcgctcggcgacggccgggtcggcggccacgcgggtgccgtcgaacagagcctggttggcggcgagggcggcggatgccttcttctcgtcctcggtggcgtcggccagggcggcgacttccttgagctcgtcgagcttctggacggcgaacgcgaagtgcttgaggtcttcggccgggatgccggtctcgccttcggtgctgaacggcacgtgcagcagggaggatgcggtggagacggccacgttggcggtgacctgcttcagggcgtcgaccaggccgagggaggtggcgtagttgttgcgccagatgttgcggccgttgatcacgccggcgaagatggtggtgttggaggccacgccatacttggcgacggcttcgaggttctcctcgcgaccttcgttgaggtccaggccgatgccgtcgaagccgagcaggttgacggtctcgtacacgtcggcgatgtggccgaagtaggtgttgagcagcaccttgacattgcccttggcggacaggatcttggtgtacagggtcttgaagagttcaacgtcgcccggctccttgtcgagcacgaggtacggctcgtcgagctggacccatgcggcgccgagctcgttgaacttggcgagcacttcggcgtagacggcggccacggcgttgaccaggcccttgtcgagctcgagttcggtggcttccggggtacgggcgagcttcaggaacgtgtacgggccgatgaacacgggcttggtgtcgatgcccagcgccttggcctcgttgaactcgtcgaacggcttggtggagttgagcttgatctccgcggccgactcgacttcgggcaccagatagtggtagttggtggtgaaccacttcttcatcggcagggcggtcacgtcgcccttgtcgccctggtagccgcgggccatggcgaagagcgtgtcctcctggttgtcgaaggagagacgtgcgtaacgctgcggaatcacgttgagaaggatggcggtgtccagcatctgatcgtagtagctgaagtcgttgctgggaatgaggtcgatgccggcggcctgctgcagcttccagtgcttggcgcgcagttcggcggcggtggccttgacggcggcgaggtcgttgacacccttccagtagccttcgatgatcttcttcagttcgcggttctgcccgatgcgggggaagccggagacggaagtcagagtggacatgaatcctccaatgtatgcgttcgtaacccgacttagggtagcaaaacatccggattccggcccttataaatggccgcagagtgtcgttatagatggaatttatatccgctttagtcgaagtctttcacattgatgaccgcgagcagttcgccgctgtgcacctgccattcgtcgaacggtttgttcgatcccatgatcacgatggatgcgggcgaaagtcccaaattcagcaggtcgagtcgttcgccgtcggagtcggcggaggcgagccattgggcgctgatcgacacagtcggctcgtggcccacgatcatgaacacgcggttcttggccttgacgtgggcgagctcgtcgaacaccgcctgcactcccccgtcatacaggctgatgcggtagtcgacgattggcttgtcgccaaaggtcttgagcatgcggtccaacgtctggcgcgtgcgggtggcggacgagcaggagatttggtcgggcaccagtcccagcgactcgatgcccttgcccacggccttcgcctgtttcagacctttgtcggtgagctcgcgctccgagtcacccttgtcgccgaacggctcggccttggcatgcctcatgatgatgagaatatggtcgtatttcttcgccgctttggcgactttgctcagcttgatgcccatccgtggctcccttcacgaaccgtctgcccggtgtggcggtgtggtgttgcttccagtatagaggtgtgtgagcgttcacaaactcatcgtttggcggttattcgtgcgtgttgccaagttctcccacctgacggtcgaggtcgcgcaacaccttacgtagtttgtggtcggagatgtcgcgcagttccagttcttcgatctgcgcctcacgctgttcgtcggtgagcgagtcgatgtcggtctgtgtgtccttggtcacgcgatcacgctttctgagcgcctcgaacccggaggccatggcgcgcgagataacaaggaaaccagtatggccgatcatctggtggtcggggcgtacggcgaggccctgggccttccatgtgcgttcgaacgattcctggatctgcggctcggtccagcagccggccgcgcgcagggcttcggccatgcggctcatctgcgtggtggtagttacgtaactgaccaacacgccgccgggggcaatcacgcggtatgcctgctcgagcctgttccacgggtcgagcatgtcgagcatgatgcggtcgaaccagtgttcgggcagttcggcggcaacggaatcgaagtcgccggttttgagatcccaccagctgggggcctcgccatagtacagcgtggcattggcttgggcgaccttggcgaattcggggcgcagctcgatcgtggtcaggtggccgcgctcgcccacggcgtccagcaggttcacgctcatcgcgcccgagccggcaccggactcaagcacgcgcatgccggagcggatgtcgccgagctgaataacttgggcgatgtccttcggatacatgatctgcgcgccgcgcggcatcgaaagcacataatcggccagtcgcgggcgcatcaccgcatactcccagccgccgatggcgcgcgacgatttccacggcttgttcttgtctttctcggggtagacctgattgacctgtgcctcgcgcttggcatgcacggtgaggattacggtgccttcggtcttgccaatcacatcgtcatgcagaatcaggccatgctcggtctgcgtggagccgccggccacaagctgatcggtgatcttcttgcccttgcggtcggtgaactgcactttctcgcctgcggtgagaggcccgcgcctcggctccataacttgctccttgcgtgctcggtgggtcaatcgctacaagtctaatgcatgtaagctcgctggtgaggtgatgacgatgcgaatgcagatgacaagccagatcgatgccggcggcaatgaccccattttcctgatgttccacggttacggcaacgacgaaagcgagatgatgcggattctcgacgccgtatatgcgccgacgcgagccgatgcggccccggccgcaattgccgccgtacccagctatatctcgttccgcgccacctacgcgaggccctatatgggcggcaattactggtatcccgacggctgcggcgtggacgagcgccaacgcgaatgcgcggcggtcggggatgcggtggcttcactgctggatgcctcggcattcgcccatcgcaggaagatattgatcggtttctcccaaggcggttatctgtcgtatcgtctggtcaaggtgcatccgacgttgttcgatgccgcgatcctgctcagtccttcgttcatgggcgaggaacaggcggcgcttgactcccctacccgattcttcctggcgtatggcgcgcaggaccgcacgattccgctgcccgaccagcaaacggcccatcaggtccttgaacgggccggacatctgacctatcgcgagtattccggcatggcccatgccatctgtgatgaggaaatcgccgatatccgggatttcctacgtaccatatgatgccggtgagtgaaacacgggttgtcgagtggttccgcaatcacaccaacggattgccggctgcctgatacagcgaccaccagtcacggcgttcgagttcgatatcggcaccggccgccatctggcggatgcgctccggtgtcattgagccgagcaacggctggataccggcgggatgacgcagaatccaagcgacggcaatgccgttgggcgtggaaccgtatttgccggcaagacgggtcaattcggcgttcagctcggggaaatgctcgttgccgacgaacggaccgtattccgtgccggattggaatgggcaccatgcctgaatggtcatatgcttcagccgtgaataaggcaggatgccgccggtgcgatcggctgcgggatcgctcgccatattgaattggatttcagcgtcgagcatctgtgtatgcatcaggccgaactgcagttggttgatttccaatttctgacgaaggccgctttgcaatagttcgatctgccacgggcccatattgctgactccgaaatgacgcactttaccgcttgattccaacgcgtcgaatgcttcggcgacctcgttcaactcaaacagcgtgtcaatacggtgcagcagcacggcgtcgacgtaatccgtctgcaaagcctcaagctcgtgatcgagtgcgtcaatcagatgcttggcgctgaagtcatatccgttggcgccgccatcgttttcgccgaaactgtagtcgatgccgaacttggtttggatgaagatggtgctgcggtcgagtcctgcgtccttccacgcttggccgaaacgcttcgaactggcgtgcgcggcatgatcatggaatccatagatgtccgccgtgtcgaaatagtcgatgccagaatcatgggccacggccacggtacgtgccgcatcggcggcatccagcgcgtccatgcgcatcacacccagcgccactcgtgacgcaatcatgccggattgtccgatttcctgagtcttcatagtgtctcatttctgttatcgtgaatcggcgaacgggcactgtccgcctcgttgccgggcagcaatctccattgccgcggcttatgtcaccttatcgcttgaagtgcacttgaaggcaactcgcaggcaggcagcgcgcgctgccgggcgcgtcttcgcgtcttcatgtcttcgctgtgatcgagacatcgttgtgccgtgatcatgcctatttcttgtatgatgacctctatagcaacagagctagggggattccatgaacactaccgattcatccaaagtcagtgatgccaacgccggcgcaaacaatgtcatccatatcccgcacaatcccacgcttgccggattggccacgctgacccgcaacgtggcgtacaagaccggggccgataacctggtgatggatatcatctcaccacaatccaccggcgatgacgatgaccgccgctaccccaccgtggtattcgtgcaaggcagcgcctggaccacgccgcatcgcgactacgagatcccgcagctctcggctttggcccgcgaaggctttgtggtggctacggtgaatcatcgcgatgcctcgagcgacccccacgacatgttccccgcatatctcgaggacgtcaaagcagccatccgctatctcagggcaaacgcacgtcaatggcacgtggaccccgaccgtctcggtatctggggcacgtcgtccggcggcaacacgtcgctgctggtggggttgaccgccgacgatccgaggtatgaggatggtaccaatgccgatgaaagcgatgcggtgaagtacgtggtcagctgcttcccgcccactgacatgcttgaagctgtcgacgcattcgacgatgagaccaatccattccggctgtattatttcggcccgttcgcggccgtggtgggtgcgacccatgagaccggcatcaatgccgaggtccgtcagcgtgcggctgatatgagtccctacctgcaggtgcgggatgaccagcagtatccgccgatgctcctgttgcacgggaccgccgacaccgtggtcccctatcatcaatccgtcaagatgcgcgaccaactggtcgagcacggcgtggacgcgcagctggtgctagtcgacggcgccgaacatgagtacgatttctggagccagcaggtcttcgacgtgatcttcgatttcattcgtgagcggagctgaacacatcatgcttttgggcagatagtgcgacccaaacatcccgttgtctatttagaagtgcaacctcctttttaaaggatgttgcacttctaaatagacaacgggccgcgtgggtcgttcgcccggctgccctacgatagagggtgtcgccgtattcccaacggcgcagtccgtgcccgggacgaggggctcggccgaatggcgcgacgatgcgccttgaagttaaggagtcatgatgaagtcatggagattcaccggcaccaatgaaccgttgcagctcgccgagctgcccgagccgaccgccggaccggggcaggtcgtcgtcgacgtgaaggcggccggcatctgccacaccgatgtgggcattctcaccgatccgggctggatgacgatgctggcgcaggtgccggtcacgctcggccacgaggatgccggcgtgatcagccaagtcggcgagggcgtggacgattttcaggtgggcgaccgcgtggcgatatgcccgaccacgccggccggctgccccgggtcctccttcgacggcggattcggcccgaagatcgtggtgggcacgcaggcgctggtgcgcattcccgacgaggtggatttcgtcaacggcgccgcggccaccgatgcgggcatgacctcgtacgcggccgtggtgcgccgtggcggcgtgaaggccggcgacagggtcggcatcatcggattgggcgggttgggccagatcggcgcccgcgtggcccatctgctgggcgccgaggtgcatgtggcggagatcaaggaggatatctggccgctggccaaggaactgggtgcggtggacgcgcgccggtccatcacggactatccgaagggattcttcgatgtgatcgtcgacttcgccggattcggcgacaccaccgccgacgcggtggacgtgatcaggctgggcggcgtggtggtgctcgtcggcatgggccggctggaaaccaccatcgatgccaagtcgctcatcgtcaaccagtgcgatctgcgcggatccaacggcggcacgcccgatgacatccgaggcgtctacgagctgatgcgcaccggcaagctcacgccggtcaccacgaccgtctcgttcgacgaggtgccggaggcgatcgaacggctggagcgcggcgacgtggtcggccgtctggtcatcagctacgagtgagggatggagtcagctgggacagcgtacttcggctatgctgtcccgaccattcgcctagaggaatggttcgtcggttcacgccctcgctggcgggagcatgagccgactcacgatccggctcggtcagcctccggcaacggggcgtgggccgggggtcatactgcgtaggctgaccagcggccgtgggtgtgctgcacttcgatcggcatgccgaacaggtcggagagtcgctcgtcggtcaggccatcctccagcgggccggcgtagacgatggtgccggcggagggattgcccatcgcgtcgatgccgtcgtcggtggcgtcctcggcacaatcctccatatccgcgtacttcgcgaccgtcccgcgatccacatgaagacgccgcgctatctgcgcacgcgacagcccctgccggtcgagtctcctgatatcttgcacaatgggcatcggtatcgccatgatcctttccttcccgagcaccggccggcggcaaccggccgaatccaattcgaatcgcaactcgggaatatacaggccgcggcaccgatgcctctcacatcaccgggaaacgatgacggcaccggggaaaaccatcagcccacactgcggaaaaacactgccgaacccgcccaacaaacattgaagcaatacatccatgcctccaaccccatccgactggcaacacctcacaccacagccacccatcacaaacagcgaaaggcccaattgttgtcatgtccgacactcacctttctcattcaactcacatcggcaaatgtcatgcacctatacgcatcttcgcaaaaagttatcgactttttcatgtatatctgagaaccacaaaattcaaacctcgaagtaatgcaataaaaaaactgtaacatgtagatatgtacaattgaatatgccggcgtaagataacagaaccacactcatgtatagagtcaacataatgaacgacaccatgtataagttcaagcattatgaggacaatccatctcttctccaccagtatcgacaagtacgaacaggacacacagatcagtctgttcgataccgccatccctgcgcaagagctcaaggagatgtaagcttgttttgaactccagaggaaaggcctcagttgacgtattcgcagatcatagtgtttgtgttcaattagttgttgcgggtttagtcacgatgatttttcgggtttaggcagagcatgccgaccacggaatggtcttaactggatggtgcttgtatctccgccagaaaggaccggaaaggattatgatcagcatgccccaagtacagtctatccgtcgtttgcggcggaacggggaatccgtcgcgtcgatcgcgcggaaaacacatgtcagcgagccgacggtgcgtaagtacctcgcgaaggaggatctgtcggccgtgccgtcggtgagaaagccgcgcgcgtcggtgatcgacccgtatctgcccgtgatcgagcagtggctcgcggaggatcgcgcgaactggcgcaagcagcggcataccgcgaccaggatctgggagcggttgagggacgagcatggcgcggaggtctccctgtccacggtgacgcgggcggtggcgcggctcaggcgtgagttcgcggcggagcgtgatgaggcgttcatggatctggtatggcatccaggcgaggcgcaggccgatttcggcgaggtcgacgtgctgttgcgcggcgtggtgcagcggatgcatcatttcgtgcttgatttcccgtattcgaacgtcggtctggtgcagttgatgccgggcgagaacgctgagtgcacgtgcctggcgttgcgcaacctgttcgagtggctgggcggtgtgccggagcggatcgtgttcgataacgccgccggcgtgggccataaggggtacggggagcgcgagccgcgcctgacgcacctgttccaggccttccaggcgcattacgggttcgattgttcgttctgcaacccgtattccggtcatgaggagggcgcggtggagtccaaggtcggcatggtgcggcgcaagctgttcgtgccccggccgagcgtatggagcctggagaacttcagcgccgggctgccggaccggtgcctggagctggccacgaaaccgcattgccgcaaggacacggaggaacgtggcctgttctccgaggaccgtgcggcgctgctgccgttgcccgggaagcgtttcgacgtggtcacgtggcggcatatgaaggccgaccggtacggcgtggccgcgcccggggacggcatcgctgttccgcggaccgggcgaacgcgggcagaggggtgatcgtgggcctccgcgcgctcgaggtcgaggtcctcgactcgtcgggcaagcatctggcgacccatcctcgggcgtacggccaggccagcacgaacagcgaggacccgtccatgcagttggcgctgctgtgcaacaagcccgcgtcctggcccaacagccgggtacgtgacgcgttgccggacccgttgcgggaatggctggatcggcaggacggacagacacgcaacgaggcgctgcagaccctcaaacgcgttgacagggaatccgggtgggcgaacgcggtcgaggcgatgctttccatcctcgaatcgaccggcggggcggaccgcgccggtgtcacactgctcgcggccaggctcgccgagggcgtggcgggtatcgaatacgacgatgacaggccggatccgggtgaatacgacatcgcgttcaccgcggacgtcggcgtgcaggaaggcgggcgatgaacacgaagacggacgaagggctctacgagaaggcccgcaagctgttcatctccaaggcgagcatcgacgaattcgccggctgggccacgccccgccaggtcgacgccgtccaccgcctgctcgacacggaactggcgaacagggaacgcgcgaagcacgacaggctcctgcgccgcgcccggttccccgtcgtcaagggtctcgacggctacgacttcacgaacgtcaggctccccgacggctacatgctcgatgagctcctagggctcggtttcatcccgcgcgcgcaggacctggtgttctacggcaagaccgggcgcggaaagacacatctcgcgatcgggctgggcatgaaggcgatcgacatggggctgggcgtgcggttccatcagaccgccgagctcgtcctccagctgggcaaggccaaacgcgacggcacgctcgagacgatgctccgggacatcggccgtgccgacctgatcatactggacgagttcggctacgcacccttcgacatcgacggggcgcgcctgctctaccggatcatcgcgggcagctacgaaagacggagcatcatattcaccacgaacatcgagttcagtaaatggggcacggtcttcgcggacgacaaactcgccgcagcgatcatcgaccgcatcgtgcaccacgggcggctcctcgagttcaccggccagagccgccgcgtcagtgaggccctcatgttcggcaggaacacctccgcgcaaccggaaaaataaggaaaatgcatgcaactgcctaaacccgaaaaaaatacatgactaaacacgaaacaccgacttgacgaaatacagatcatagttttgggtaacgggtttgatttggcacagcatatcccgtcgtcttattctgctttcttccgagataggtacacgaagtatcgggaaagcttcaagaaggcgattatgccaagagtcacctatcaagtgaatgtcgaggacccctgcgtgtgggactaccttttcattgcttggcatgatacatcgaaaaaactcgatgattggaaagacgtggaaagcgcaatcaaagagtgggtcatcgggaaaggcagcatcagccttaacgatgctctaaattactggaccatcctctcagtgaagccatcacgtcctgatgcggtggtcaacgcatatctaaaaattcagaagtatgttaatgagcattcgagtaacatcgatttttctgtacttaattacttcaacacttcagcggatttggatgacgaaggttcagaagatccagtggaaattctccgggtgaaactgcttgactttttcgcgaaagaacttcacgttattgaagacgccttcactcgatacctgatacgagtccagggtaatccctcatatgattctagcagcagaaacatctataaagcaatggcggaaaccggaactgacattccacttgatgagcaatcgaacgtcattctatccttcaactacacgactccgctgcttcagagcccgcgagaagagtccatttactatcaccgcaacgtgcatggtgacgttgatcgcttctcagatgaaagccacggaggctatgattatcacgtcatatttggcattgatggccaggctcatatggatgagcctggcgtctatcaatttacaaaaaccgccagggtgttgaaattacggagacagtatttgacaggggaaatggcaggtcgctcaatattcgacgcacaaagcaatggcagcgacatagctgaagtcaagtttttcggccattccttgggagaagctgattactcttacttccagtcgctatttgaccaaatagacttatacggcggagaaactaaactgaccttcttcggtacgttgtcgtatcctgccaactacgatgcaatcattcgattgatgacagaatacggaaagaccatcgtacccgaagcgcacggaaggaatcttctccataagctgctgctcgaagatcgattgaagatagctacatttgacacgaaaattgtagcataatcccgttccggaagagggaaaagcgatggggaaacgaatgtaagccatatggacctgttccacaatgagtttgctgccttaggataaaccgcaggtctgaaggttctcgaagaggtttaagttacctcccattttgtctagaagcctctcacctccatcagaacagcaaacatggtcatgtactgttgcaactttacatttgttgaagattgggactaaattctaatatgaggtagctgtttgcagtcaaggaggacgctatggtttcagatactaaagcagtaaagtcggtcggagaattttggacgtgctgtaagttggcgatgaatggttgggctccagcactaacgagagacggtctggaacgaacggacatacttgcggagagaagccacgctccttttgatgtcacgcaaattagcgtgcaggtcaaaacttcccgcaatgaaagatgggcgttaaaccctgccaagatcggctctcaacgtagcttgtatgaatggttcgtcttggtcggatggaatgaaaacgagcagaccctgtccagctatattgttcctcggaatcatgtatctgctggagcatggttgggacatatgagatggctgaccgatcccactgctaagcgaaatcgaaattgcgggcctgaacaagcccgtatggatgtttcggttttcggcgattacaaagaccgatgggatttactgctgaagccaactagccagactccgatattgcttcctcatgaacttcatgaatttgctctaattgccgatgcttccaacagcaagttgcctgaatggcacccttggtcgggagacagcttacctgaatggtgattaaaacgcatagccatcacgtttttccgtgatggcttttcttaagctcggattcgggtatgagaagccctcatggtcgaaagtcgcaaggtctgaatgtcgacaaagacggaatagccacatcttcagacaccatttcatgcatcatcagatgcccaatttcatgagcaatatcgaaacggacacgttctgcagtcttactggtatctaccgccacatacggcacaccatcgaacataaaactgaaagcatccacgtctcgtccgacagtcggcagactaaatagtcgaatgccatgagcttccgcaagactcgtcatctcgggcaacggattctcaccatatcccaaaatcaacggaagaagccacagaaccatcagtccagctccggaatcctcatcccatcacatgccactgttcttcatcagcttctccgactccaaagtaagtgacccatcctcggccagcagaggagtatctagcacggccttgattgatgctgcagtggacgcagctgcggcaatagtcttcttactttcctgacggaattgcgaataatccgttccctcggtctttatgatattttccatttcaagaattgaaggcaggaatttagcatcaagacgggcaagcaaagcgtggaacatatagctgcgtctacgaatggcaacgcactggtccgcaccggccatcatctgctcacaatatttgcttgcctcagcagactgggtcttcgcttcctcaaggtttttaccacccttagcaccgatgataacgcccatgaccagcaatgcaggacctgcgactaaacctccaagtacagcggcaccaccggccatgcccaagccacctgcggccaaggaccctcccccgaagaacgccaacgtggcgttggaagcagccacaccacttaatgcactgatcgcagttcctgtggaagccgtggcgagtgccgacgcggcactatatgcaccaaacgcagccaatgcaccgctggccgccccggtcacaccgccttccagcaaagacgaagctatgtttcccatggttttgagctcagcaaaagccgctttgtctatgcgcagtttattgagctcatcaagcccttcggacgcggtgaaatcaacatttttcagctgttgaaaagcatcaaggaagcgctgaacgctcccatccaaaataatgactttctctttgcccaaggcattcagggaatctgaacattgcctacgaagcttttcgaggttattagctgcccatcgaatgcgtgctccggaattgtcgttaagctgattcgccgtgtgctgatcaagactacctttggcagccatacccacgcctgcggtaccggcagcagcggccattccgatgaatagtggaacaacaaaaaatggcatagtgaattccttcctgggtttctcttatttgcgtccaaagaggccaccgaagaagccttgtacagcattggccgcatcgcccgcacgttttgcagcctcattggctgcgtcacccgcacgtttcgcaacctcattggctgcgttgcctaccggtttcagcactgcatcattcaccggcttcagcgcatcgccaacttggttgagaacaggagcaacattattgtcaaacgtatgcttcaccgcatccgcggctccctgagcaccctgctgaacctgatccacaaccggagcgaccaccgagtcaacggcatccttggtctgatcaaacacgtccttctctggaaccatgacttccggggctggcgctgccgtctcgtcttcaatcagcaacacggcagcgttttggagaacattcacgcgctcttccagctgatccaccatggggcgaacttcactatatggcagttcggaattgctgatccagtcgagctcgcctcgcacgtcatacgccgcgcgcataagatgttccatttcggggtatatggaacgatcggcaatcatcgtccgggcaatatgtctgatgagtctgctttctactgcatcatattccccatcggcgaaggcaactgacaacatattccacagaagcagccttggtgcaattcctgcagctcttttatccgttcgatgcgacaagactgcatcaacaccctcaacaattacgtcgtagcgatcatcggaatcgtggcactggtttatacgctcatcgcacgaatcgataatctctttgcgataatcatggaagtgctttgcatccaaattgtcacctatatgatcgaatagtgcgcgttcgtcgtcacggactgatccatcgacagcaatcagataataaaatgcttgtaatgcatcacgtgttttgatgtacttcattaactggctcctccttataaaacgaaattgtcgtctgacgccatcaaatcatcaaactcctgctgagtccgaaaccttggcaagtatcccaaggattcttgaatttcggcgtttccggtcaaatatccatcaatatcattggaaatcaacgcttgatccattgcatcgaatgctctattaaacaattcatcatgagtcgccagataattctcgacatccctagacatatcacgcctatattggcggatgagctccaccgcttccgcacattcgcgttccacacgaatacgctcctctttcgccagctcatagtcatgcagagcagtggataattcctcatatacggcaacagctgcagcatatcccaaggtgcttccagccataccaaccatcgcagccataaaagcaccatctgcaggtactgcggccatcgccacggcaacgcccatcactcctccgagctgccccattccctgctggccgaggcgctctatacaaacagctccagtaatctcgccgcggcaatacagtgcaaccaccttggaaacatccgttacagtggagaccatcgtagctgcaacgttcgttctcgatagactacgcagatactcgctcgacgcgttttgcatggcacccttaatggcagcgccggaaaaagcggtgacatagccgaacgccgcagccaagcctgcatcgacgccgacgtttctcgctgcctccgctggctcaatagagccattaatgcaggcaaccatatttcgaatcagagaaacaccaccaccaatcagcgcaccattccttgcctgctgcagaccggctttattggcaactctggctacatctttcgccaccatgcgtctgggatgttctcgcgcatacaacgcttctcgcttggtgagtccacttttccgcaggcttttcttaatctgtttcagatcatcgatttgctgctgaatagcctcagaattcttgccggcaagccgacctccatccagctcgccctgaagttttcgtatctgttcgttgatgccgtcaggcccatcacccatcagtacatcgtaataatcatccggaataaccatgctgacgtctgcatcacgatattttgcatatttcttgcttttcaacttatcaagaagctttttcgggctactgccgacgaacttcatttgagcctcagagccgatgattggtttgcccaagtcatccacttcgacaatgtccacgatggggtcgttcgacacttgccgtccatctggatgcttcacgtcatcatatcgtttgaatcgcgtatcgttgccagcaatgatgttatcggcgttcttcctggctaccgcctcaacctcggcactaaaacccgcttgctgagctagattctgctttttgaattcattgctagtctccatcttagcaatggacttcaaggtcttaggaggtctggaattctcatcagcaggtttctctctatcacccgcataggccgctaaatgttccttgatggcagaaccaaagcgttgcacggtttccgccgcaacaccttccagcgcctttcccataatgcgacggttttcgtcttccttgcgttcctcgttatttcgaccgatatgagtttcatcatccgccataggatgccccctcgcatatgccacatctacgccaaccacatatatcagaaaaaaatgttctaatactgtaatcagttcttcagccgtgacctgttaataatcctacattatagcggcagaaaaactcaccatatcgtcatcctcgattaacgattagatagacatacttttgcgaacaacacaggcaccaccgtatggaatgtgtccaacaaccgttggcaaagccaaatccctcacactattcgaacccgaatgcgtctcaatctctgtcccccactagcggcgcatccccgtccaaagcagtctgggcgtcgagcaagtgggattcgatgatgcgcatccagaagaagggagttctcggcaatgttcagcggaacgagacatgggagcgtccagtgcttgggcgtgatcgtggagaacagtaggcagggagtcctcactgttgatggtggcgtactggccatcttcatcgcatacggaaacagtaggttgctactcaccgcgagcgccttaatgccacgccgactccgtccgtccaagcacatcctcaataagctcacgcccgcgcaataccgccagccactgagcgggaatggcatcgaatccatatttgatgccggccaggtatccggcgacggcggcggtcgtgtctgtatcgtcacccaagttgacagcggcgagcacacaactcgcataatcatcggtattcgcgaggcaccagagcgccgcctcatacgtgtctttgacgaagccgctcgaaccaacttcatcacgcggcataccgcgtagcggttcatcatccagctcttgcggccatatgcctttgatgagtccgtcgcgcaacacatccaccatgctcgaacaggcctccatcgagattgcatgagcgtgcgtgattgcagatgcggcacgtacgtcatccgcggaagcatccgcgaacgccaacggcatgatccgcatcagtgagccgttgccattgtctcgttcaccgcttaagcccacacgctgctgcaacgcgatggagaccgttcgcccgcaatcgaagactcgtccgtcaatcgcgtattcgccattactcagccatgccagatatcgctctcgcatatcttcagtattgacttgccattcattggcgatcagcgagtccaatgtggcgagcatcatgctggtatcgtccgaccatgtgccaatcggctggttatgcgtaccgtatcccgtcataccttcgcatcggaaggtatctctcggcatgaattcataaggcacgcccaaggcatcaccgactgcttggccacacacggctgctcttaactgctcgaatgttccgttcatcattgacgcctttcgatttatgcccctcactctacatatgtttcaacgataggtataatcgggcccactgagcataagcgaggtaggtaatgagtctaagggaattaaggttaaagcgagggctgacacaaaagcaactagccgataagctcggctatacacgtgagcgtatagccgctatcgagacaggcgcgcggcctatcggcggcgtgagtcttgataaggccattgagatatgtgacgtgttgcgcgtgagtaatcctcgcaaactgttagaggctgagaagccgaaagaaaacactagtgaaagctagttgtgtgccctaactcaatctttgagcgtaggccggttagcggcttaatcaggtgcaatccctgactacgcacgacggcggcactgccgctacataaatgccccgcaagcactagcaatacttgcggggctgacctttatcaatgcactcaatagaggcagtacccaagtgtaccgcctcacacggaagtaaggaaccatgactgacttatcctggattaccaagcaactgaccggcgaaactacaaagacgctgacagcacaccgtacacatctgtgtgagtatcgatccgccgctcagaactactttgcagagcgaaaacacggataggtcaagggaataccccgctgaatcgtcgtcagcgaagcaactcagagagttagtagaggaaaagcctcgctaagtggccttttagtagagcaatgcctcggtccgcccgaggatttgcctcactgagactgctcagcgaagcaaaagctcgacttaaccgcagaatcgcttcactaaccgcctatcagtgagtcaagatctcaattcactagaggatttgcctcgctaatatgcaggtatgctcaatataccgacgtactgaaatctccacgaagatgagaggaactcaaatggcacttaggtttctcagcaccaaagaagttagcgagcgcctcggcgtcaagaacgcatcagaatataagctgccggaacctgacgtatatatggcactactaaaggttagctacctgaacaatagatgattggaatgcaagccgtcctggtcgcggtgttggcggtggaaggtccctcaagaagaaagactagacgcatcagaattcttcagcatcgtgttactcacctgattctaatcatcttcagccccagcttctggcaacgaaaatccatcttgactgaagtattcaaccctcttaatgactgtttggtgggcatcctcatcattgccccaccagcgccaaccccattcagacggatctggcactgattgcctgcaatccttagccatacgccgcagtacacgtggatcgaatactcgtccaactcgaaagttcgtcagtcgattacgtggaatgaacatacctaccattcgccattgcttacgcgctttcccaatcacaaacaatgttccaccgtcatcctttaggctcgtcctccattcagtcgacacatacacttttgttccaggactgaatatcttcgttccatgcccaatatgatggtcaacaccaacctcatgctcatctacgacatttgctattacgcaccaagtccatggctcttgctcatcgttctgaggaatacacatgacaaccccacagtcatcttcatcgccgatcgcactgtttgcgtataccaaaccgctacttctctaccagttagccagtggagtcgttcacaagcaaactgtagagccttcttgccatacatgattcggacaagcacttctacgtcctgtgcgatattttcgagctcttaacaaataatgccatcgcattgctcgacatgctgcaggtatgccctgtgttcttggtgtcggttcagttctcacgttgctgcgtgcagcgtcaataattcgctctcggcgttccacgatgattctcatacattccggactagtgtgaatggcagatacagttaattcgcccagtccgaaggaggacattatgggattgtttgattcgctgaagaacatgttcgcgcatcatgagcaccatcatggagccagcatcggtcagccgctcactctcgccgacgccaaagcagtgcttgcctttattgtggtgcatcagcagcttgcggacatgcgcaaagtggcggatgcggtcaagcaattgcaggacgagatgccgcagtacatcacattcggcatgtcgcattattacagcgagcctaagcgcgtgcgcttccagtccgagggtggcaagttcatcgatgcggacgccatcgccaccgcatttgccgagaccaccgtattgcaggacgagtgcaaaatccagcatctgatgggagatatcgaagacaaccgcgagcatcgcgatccggcaaagacgccagcagtaccgattgatgaactcgtgcgcgtcaccaatgaaaggcttgcggctggcaacgatgaggggcaacgccgtgcatggctgttcgccttattcgatcagctcgatgacattgtcgaagcgacaaagaacaatcccgagccgcttgccgcagcgttgaatacgattctacgaaacagctccacaattattggcaaatccgccactgccgacgccggcaacagcagcaacaatgccaatgccggcgatgcacgttcccgtatcatctccctaatcgccgacgctctgttcccggccgcagaatcctcgaagacaagcgagtcctcagcatccgccgccatccgcgaactgatgctcaatcccaccgcaacatcgctcgattacatgccagccatagacgtactgcgcgcccacggtctcactatttgccggtgagtccgagaagtcaaccggtggttcatacggcagtggttcatacggcgcataccgcacgaaccactgtgtccgaacaacgagaacgcactacttctccagcttctccaacttttccagtgcctttaatagcgaatcgacatggcctttggcacgtacgttgtaacgagcgataaccacggagccgtcgggattgatgacgagcgtcgaacggatcacgcctacgtgtatcttgccgtagagcttcttttcgccatatgcgccgtacagcttgtgcacggtcaggtcgggatcagacagcagcgggaatgtgagatggtcgtgctcggcgaacttgcgcagtttctcgagtgaatccttggagacaccgagcaccgcaacattctgcgactccaagcgtgcgagattatctcggaaatcgcaagcctcagtggtgcatccgggcgtcattgccgccggatagaagtacagtacaaccctacgtccgtcctcgagcacgtcagacagattgattaagccgttctccgcagtgccgggcacaatcgccggcagagtgaaatcaggagcatcactcccctcttgcagacgagcgtatacaggagcttgggcggaatcatgaacagtagcagtcatgcgtcccatgataggcgtccgagcccgcgacatctatcacagactttcgatgaccactgattgcgtcaataattcggcacgttatattcgacagtaatatgccatcaaagcgtcggcagcgggctctgaaagactcgactaatcgggcaactgcgggtcggcaaaacggcgattctgcagaaccggcattatctggcgtgcggaagcaaggcattcgcgactaagcccagtagcaataagctcggctccctcatcgcccgcttcggcaactacctctcccatcgggtcgatgatgcgacagcatccgatgttccgcgaactcacctcactgcaagccaacacatagcaagtgttttccaatgcgcgagccgcagtcagcagcttccaatgctgctctttcaacgggccgcgcacccaagcggcgcttacaacaatcgcatctgccccgcgcacggccagtgagcgagcggtttccgggaaacgaacgtcataacaggtcatgacgccgattttccaaccgtcaatatcgacgataggcggcaacgcatctcctgggagaaccacgtcggattcgcgggccgcgaacgcatcgtaaagatgcagcttgcgatattcagcgataatttcaccatcgcgaatcacaaggaacgtgttggaaactcgggaatctgcatcccgttctgttacttgctccggcgcaacatgcacggtacccatcagcacaatatgccgctgcgcgctgatacgccgcaagccgtctacaaacggcccgtccagtggttgcgcgtgcgcggcagcatatgaatcgtcatcgccgcgccgcgcaatcaaaccttccggcaatgccagcaacttcgcgccgcccgccgccgcatcacgcgcgaatccgtcgatgatctccagattccgttccggctcctccgccaccgtaaattgcgcaatcgcaactggtaaggacttcgcactcgtcacgccagccccaatgtcttgaaggcgttggctagaccgttgtcgcggatgtcggtggtaatgatgttgcagaaggcctggatgccgtggatggcgttgcccatggccacggatgtgccggcggctttgagcatggcggtgtcgttatcggagtcgccgatggcgatggtgtcggcgatggcatagccaagcaaggaagccacgtcgcgcacggcggtgcctttgtcgatgccgttgatgagcagttcgccgttattcggcgagatcttgtcgtatgagccgtgcacgagttcgaaccagggggcaagatcatgctgagtgttctcgaaggaaacatccggctcgggcccggtgaaatacgatcccttgctcacatgaatcgtgtgacccagcgtagatccagccggaacctctacctcgtccagcaaatgccagaaccgcgcaaactcaccacgattccacgtcttgcccttggactccagatggcggcgataaccttcggaaatgtacatgccgtccgcaccctgccactggtagctctcgatatggtgttcggcaaaataggccatcgccgcatcgatggcttcgggcgatacgaggtgctgaaacagcagcttatcgccgatattcgcctgtgcgccggctacggaaactacaccgtcgaatccaagatccagaatgttgcgttcgattttcggcacggaacgaccggtacagatgaagagcttgtgaccgttggcttgggcccgcgcacacgccgtttttgccgactccggcacaatatgattctcatcagccagcgtgccgtcgatatcaatgaatacgagtttgctaccagtcatgtcgctttccgtcatatgtcgaacctccccaagtcagcttatgctgacagccccctccagagggggcgaagagaaaaataaaacctgccgaaaaaggaaaagtactgctgacacctcccccagtcggcttggccgacggcttccgctggcggagaccaaaacggcatcacacggcgtaggcggcccagcggccgtgagtgtgctggacttcgatgggcatgccgaacaggtcggagagacgctcgtcggttagaccgtcttccagcgaaccggtatagacgatggtgccagcaccgggattgcccattgagtcgacgcccgcttcggtggcatcttcggcgggaatcggcttgcggcccataatggcgatgtgatcgaagcctgccggaatctcttccagacggtgggtgaccagcaccacggcacgttcagagctttcctcgccgattcggctcaacgtgcgcatcacctgctcgcggccgcccaggtcaaggccggtggtcggctcgtccataatcaaaagctcaggatcgcccatcagcgcacgggcgatcagcacacgggtgcgttcgccttcggacagtcgccacatctccttgccttccagataggagacgcggaaatcacgcagcagctggcgtgcgcgggcgtattcttcgtccgtgtaagtatcgcgccaacgtccggtcacggcggacaggccggtgaccacggcatccagcgggtcctcgaactcggggaactggcgacccaggtcggccgatgcgagaccgatgcgggtgcgcagcttgaacacgtcgtatttgccgagctggtggccgagaatgaacacgcggccttccgaggggaaggtgcgggtggccagcatgccgactgcggtggatttgccgatgccgttcggtccgaacagcacccaacgctcccccgcatggatggtgaggttcacgtcggtgatgatgacgcggcggttgcggcggaattcgacgttgtcaagttggaggacggtttgggacatgattctcctcagtggtacaaaacggagggagagcaccgcttattgcacggtctctccctccgtcacgctgcgcgagcctgcgctgtctcgcttttacttcttctgctcgtcgagcaccgactggtagacctccacggtcttgtcgccgatggactcccaactgaacacgtcgcgggcgcgttcgtagccggcctggcccatcttcttggcgagctccgggtcagccatgatcttgtcgatggcggcggccatgtcgtgcacgaacttgtccggatcggtgggggtgccggtgccgtcgtgcagctggtcgatcggcaccagatagccggtctcgccgtcgaccacaacttccggaatgccaccggtggcggaggcgacgaccggcagaccgcaggccatggcctcaaggttcacgatgcccagcggctcgtagatgctcgggcagatgaaggcgtcgcagccgtgctccagagcgttcagctcaggcttcggcagcatttcctcgatccacacgatgttgccacgctcctcgtccagcttggcgaacgcgttcttgacttcctcggcaatctccggggtgtcgggcgcaccggcgcacagcaccacctgaatatccttggaaatcaggtgcagggccttgagcaggtacggcaaacccttctgacgggtgatgcggcccacgaacagcagggtcggcttggaacggtcgatgttgtaacgctcaaacaccttccagcccggatcgtccggcgccggagtagcaaagtcagacatggtgatgccgttgtaaaccacaaccaccttgtctggatcaagattcggataggcggtcagaatatccttgcgcatgccaccggaaacggcgatcacgcggtcggcgtgctcgtaggcgtccttctcggcccaggagctcaggttgtagccgccgccgagctgctcacgcttccatgggcggaacggctccagggagtgggcggtgatgaccagcggcgtaccgtgcagcatcttggccaggtagccggccaggcaggcgtaccaggtgtgcgcatgaataatgtcggcatccacatcgttggcaatctgcagatccacgccgaaggtcttcaatgccgggttggcatcagcgagctcggacggcgtatcgtatccgacgaccttcaggctgcccttggcattagcggcattgggaatcgcggggatatcagcctcagtacgcttgccatcaaacgcacgcacggtcacgtcaatgcgctcggccaaaaccttggacagctcctcggcgtgtacgccggcaccgccatacacatgcggcgggtattcgcgggttagaatatcaactttcatcggactgcctctccttcgtgcgtcagaaagaaactcaagcacttcttactttagggcaccgcatacaagaaaacgcacaacttccgtcgtgcgttttgcttttcaagccggatttaccaggcaaaagatcagacggccgtgccgttctgatccaaattcggattgtgcttggaatcgccagccgtaaagaacaggctcagcacacccacaatgaacaccgcggaaacggtgatgatcagccacatcggatggctcggcagccacataaccacgaagaacgcgataatcgcgatggcgatcagcgtccagctgcccacgcggaaccactgacgcagcgaatgcggtgccttgaacatcttcggattcgtgtagttcgggttagtggtcagcagggtttcggtgtccgcaatcgtaccgccgctgggcttccattcggtgccgtcggtgccgtcctgcagacgctgggacttctgctgcagctggtattcgtcaatcattcccgagcgaccgcgaccttgggtctggtcgtactgcgacggcactcccctacgattggccttggcctgtgcacgacgttctgcacgattcgccatctcactcactcctttatccgcaaaaaaagaatcctgcggtagatattaccgcaggattcatctaaacagcgcgttttcagcgaggcagcatcatcggacgctggctggccttgatcggagccggcagctcactggtctgctcgctggagaggtactcgtccacggctgcggcgcaggagcggccttcggcgatggcccagaccacgaggctctggccacggccggcatcgccgcacacgaacacgccgtcctgggaggtggcgaacttgtcattgcgggcgatgttgccgcgcttgtcgagttcgacgggcagctggtcgaggatggtctcggtgtccgggtgcaggaagcccacggagatgaggaccagatcggccggcagcacgcgctcggtaccgggctggcgggtgaaggggccgttctcgccgggagccacggagacgaccttcaggccggtgacgtgaccgcgttcatcggccacgaagccttcggcggtggtcgagttgtcgatggtgaccttggccttctcctcttcggtgccttcgaagttcaccgagtcggtcgagtaaatgtactcgccaccctcttccatggaggaagtcttctggtaggtgcgggcgaaggtcggccacgggctgttgtccgggcgtgaagacggctctttcggcatgatctgcagcacggtgacatccttcgcaccctgacggatggaggtaccaaggcagtcggaaccggtgtcgccaccgccgatgaccaccacgtgcttgtccttggcggtgatgtcgtgcaccggcttgacgccgaagatacggcgcgtggcgtcgggcaggaagtcgagggcgaagtggatgccgtcaagctcgcggcccggaatcttcatatcgcgcggcacgcgggagccgatggccaccacgacggcgtcgtaacggtcacgcaggtcatcccacgtgatgtccttgccgatttccacgttggtgcggaagcaggtgccttcggcctccatctgcttgacacggcggtcgatcagacccttttcaagcttgaagttcgggatgccgtaacgcatcagaccaccgatggcgtcgtccttctcgtagacgacgacggtgtggccggcgcgggtgagctgctgagcagcggcaaggcctgcagggccggagccgacgacggcgaccgtctggtcggtcagacgctgcggcggcaaaggcttgacgatgtcaagatcccaggcctgatcgataatcgtgcattcgtcgttgcgaatcatggtcggcggctggtggatgccgagcacgcaggcctgctcgcacagagccgggcagatacgaccggtgacttcagggaagttgttggtcatggacagacggttgtacgcgtcctcccacttgccctgacggaccagatcgttccactcaggaatcaggttgcccagcggacatccggtcatacagaacggggtgccgcaatccatgcagcgggccgcctgcgcttgggtccacggttgcaggccggtttcggcgtgaacgtcgaaccagtccttgatacgttcctcaacggggcgttcagccagctctcggcgggtacggaccttcagaaatcctctcgggtcgtccatgtcagcgcgctccttccataacctgctcgtacaccttttcccaggcgccgggcgcattgaaatctacattgttggccttggcctcttccatggccttcgtcatggccacgaactgcttcggcaccacgtgagtgaaccgcttgacggtctcgttccagtcctccagcaaagccgcagcgaactgcgaaccggtctcttcagcatgctgcttgaccagtgcgtacaccagcttggaggtttcggcatcaagcgacttgaagagcagtgcaccggacttgatggcacccgggttgaccttcttcatatcgaggtcaagcacataagtgttaccaccggagaagcctgcaccgaaattgcgtccggtggggccgagcaccacaacagtgccgccggtcatgtactcgcagccgtggtcgcccacgccttcgaccacaaacgtggcaccgccgttacgaacgccgaaacgttcgccggcgcgtccggccacgaacatctggccggaagtggcgccgaaaccggtgacgttgccggcgatgacgttgctgtgcttgtcgaaggtgacgctatcttccgggcgcacgatcatgcgaccgccggacaggcccttgccggcgtagtcgttgacttcgccgtagatgcgcatggtctcgccgcgcgggatgaacgcaccgatggactggcctccggaaccgtgcagggtcatgtcgatggtgccgtccggcagaccttcctcgccgtaacggcgggtgatctcgtagccgaccatggtgccgaccgtacggttgacgttgcgaatcggcatttcgatgcgcacgggttccttgtgttcgagggccggctgggcaagttcgatgagcttgttgtccagcgccttctccagctcgtggttctgctcgatggtctggtgcaggatcgtgccgggtaccgggccggcctgcttgagcacgttggacaggtcgatgccgccggacttccagcgcttgatggcctcgtcctgatccaagcactcaacgtggccgatggcctcctcaagagtcctgaagccgagctgggcgaggatctcgcgcacctcctcagcgatgaacatgaagaagttgaccacgtactcgggcttgcccttaaagcgggcgcgcagctcaggatcctgggtggcaatgccctgcgggcaggtgttcttctggcaggcgcgcatcatgacgcagccttccacgatcagggctgcggtagcgaagccgaattcctcggcaccaagcagagcggcgatgaccacgtcacgaccggtcttgagctcgccgtcgcactggacgacgatgcgggagcgcaggccgttcaggatcagcgtctgctgggtttcggacaggccgatctcccacggggtgccggcgtgcttgatggcgttgagcggggctgcacccgtaccgccgtcatagccggagataagcaccacgtcggcatggcacttggccacacctgcggcgatggtgccgacgccgaactcggaaacgagcttgacgtggatacgtgccttcgggttggccatcttcgcatcgttgatcagctgcttcagatcctcgatggagtagatgtcgtggtgcggcggcggggagataagctccacgcccggggtggcgtgacggaccttggcgatccacggcgggaccttggcaccgggcaaatggccaccctcaccaggcttggccccctgggcgagcttgatctgcaggtcggtggcgtgcacgaggtaatcggaggtcacgccgaagcgggcggacgcgatctgcttgatgcggctgtagcgctgcggatcgttgatacggtcgtcggattcgccgccctcaccggagttggagcgtgcgccaatcgagttcatggcgatggcgagcgtctcgtgtgcttcctgcgagatggagccgtagctcatggcaccggtggagaagcgcttgacgatctcggaggccggctcgacttcggcgatgtcgatgggcttgcggttggtgttgaacttcatcaggccacgcagggtcatgagtcggttcgacgtgtcgttgatgtggtgcgaatacttcttgaacatctggtagtcgccacgctgggtggactgctgaagcaggaagatggcctcgggatcgttgaggtggtcctcgccggtgcgacgccacttgtagtcgccgccggtgcgcaggttgcggtgcggggacgcgctccactggttcgggtaggccacgcggtggcggatggccacttcttcggcgatttcttcaaggcccacgccgcccacacgggaggtggtgccggtgaagtattcgtcgatgacttcttggctcaggcccacagcctcgaacagctgcgcgccacggtagctcatgatggtggagacgcccatcttggacatgatcttgagcacgccggtggagagggccttggtgaggttcttcacagcggtgtccgcgtcgaccttgaggtagccgttacgggccagatcttccacggattcgaatgccaagtacgggttcacgcaggcggcgccataggcgatgaggagcgcgacatggtgaatctcgcgcacgtcaccggcctcgacggccatggaaatctgtgtacgggtgtggcggcgcagcaggtggtgctgcacggcggaagtcagcagcagggacgggatcggaccccacgtatggttggactcacggtcggagagcacgatgaagttcttgccgttggcgatggcctcgtcgatttcggcgaagatctcgtcaagtcgctcttcgagggccttgccgccgccggcgacctggtagaggcccttgaccacgtacgggcggtagtagccgccgaggatgcgggccttgtcaaggcgcttgagctgggccatctcatcagagttgaccacgggcagcgggatgaggatcttcttggcgtgcagctcggaatcggccagcaggttcggctcggggccgatggcggattcgagcgaggtgacgatctcctcacgctcccagtccagcggcgggttggtgacctgcgcgaacttctgggtgaagtagtcgaacagcatgcggctgcggctggaaagcgcaggcataggcgcatcgttacccatggaaccgagcggttccttgccggtgttggccatcggcgtgagcaggagcttcagatcctcttcggtgtagccgaaggcgcgctgacggcgctggacggactggccggagtggctgacgtgctcgcggcggggcaggtcgctcatttcaacggagttgccttccacccacttgcggtacgggtgctgggcagcgaggttcctcttgacctcttcatcgggaatgatgcggccttcggcggtgtcgaccaggaacatctcgccgggctcaagacggcccttggacacgatgtgttcctgcgcgatctccggcagaacgccggcctcggaggccagaacgatgtagccgtcatcggtgagctgccagcggccgggacggaagccgttgcggtcgagcagggcgccgacctgggtgccgtcggtgaagacgatgtcggccgggccatcccacggctcgataagcgtgttgttgtactcgtagaaggcgcgcacgtccggatcgagatccgggttcttctcccaagccggcggcagcatcatgcagatggcgtgcggcagggagcggccggcgaggtgcagcagttcgaggcactcgtcgaaggtgccggaatcggagtagcccggggtggtgatcggcagcagcggctcgaattcaccgagcagttcgctgctcaggcggccttcacgggcggagagccagttgcggttgccctggatggtgttgatctcgccattgtgggccagcagacggaacggctgggccagcggccagctcgggaaggtgttggtggagaagcgggagtggacgatggcgatggtggccttcatgcgctcgtcgttcagatcctcgaagaagtgggtgagctgcatggtggtgagcatgcccttgtacgtgatggtacgggcggacagggatgcgaagtagacgcccacctcatgctcgacgcgcttgcggatgcggaaggtcttgcgatccaagtccacgccggccagagcaccgtccggagaggcgaccacgagagtcttgaatcctggcatggcggcaagggcctgcaggccaaggccgtccgggttggtgggcaccacgcgccatgcgaggacttcgagtccctcctcgcgcacgatcttggcaatggcctgttcctgctgaccggaggtttcgatgtcgcggtcaaggaaggcgatgcctgccgcatagtgaccggcttccggcagttcggcgggcacggtggcacgcatgaactcatccggcatgctcatcagaatgccggcgccgtcacctgtgttctcctcggcacccacggcaccacggtgatcaaggttgaccagcacctcaatggcgtcggtgacgatcttgcgctcaggacgcttgttcaaagtggtgaccatacccacaccacaggcgtcatgctcgttggcgggatcatacataccgtccggagcgtggaccgtgagatcgagcggggctttgaatgtcaccgaaatcacctcaattggttgtgggcacgtaagaaaatcatgcctcttcgttcattgctgttgacacagtaccgttgctccatgtcatttacgtttcatgtgtccatataccgagtcgccataaaagtcaatagtgattctcaagcaattttttttatggccagttatgggggtatttcgaactttttcgctcgaaatgtctatttgaccacacgaaaatacgatacggaaacgtccgtatcgtgaaatgctgcgttgggtgatgttacggattggcggctgtggaccaccctcagtcatgcttcgcatgacagctcccgccagcgggagcatgagaactgtgcatgtctgacaccatagcgatcggcgcgctccgcgaactcaccgaacatggcatccacgtgcccgacgacgtacggctcatgggattcgacggtatccccttctccgcctgcaccaacccacccatcagcactgtggcgatggacgtctccgcaatggctcgtacggttatcgatcgcatggtgacgctgaacgagtcgaacctacggcatgaacggcccgatgacatcacccatgaccatatccagttccaggtgatgccacgcacgtcgactctggccgcctgataccggccggcacccttatgagtgccggccttcatccttgaaaatatgaaggctatgccacgtacagcgcggcgggatacgtaagatacgaaatctcatcgagctgatcgaccgtcacatatccagctggcgcgttgagcacgtccggaatgcggttgacgattgtggcgcacgtatgttcgacggtcgccggcttgaccacgtggaactccacgtccggttcaccctcgatcttccaatcgcacatatcgccatcatccggcccgtacaccttgccgatacaggcagtttccaacgtgatgccctgattagtttcggtggttaccacggcggacatgccgatgcatttgccgaccggaatcatctcgcccatcgtttcggaatacacgtcgacatcgctgaaatacggcacactggcctgggtctgcgatgcgatggtaagcccaagcttctgggccagcgcttcattggaattccatacatacgagggcaccacggtttcgggatgcgcaagctcggcctcgaactcctcggcggtcagaccgcaaccgtgcgctttggccaaagccaggccgtattcctcgacgttgtagctcaccgcaccggtgatcttcttgatgctgtggcatccggcggcgacggtggagaccatgttcacccagtagatgtcctgcatgccggagccgaccatggtggcaccggcttccttggcgatgatgtcgagacggttcgtggtggccggatcggtggtccacgggtagatgcattcctcgcaggtggtgatcacgctgatgccgcgggccaagcactgctcgcacatggtggcgatttcgttctcgaagctgaatagcgtgactaccgcgatatccgcgtcgcactcgttgagtacagcctcggcatcggcgcgaatcggcacattgatggggccgatgcctgcaaacacaccggcatccatgcccacgacttccgggttcacgtcgatggcaccgacgatttgaatgcctttctcgtgcatatagcgaatcgtgtacttcgccattttgccgcagccgtattgaatggctttgattggttgcataccgcatgctcctttgcaacagtgcatattggccattggagaagtctcgccgtcgagaccaagccaatagcctttactctaccgacatcaggctgggcattcactgatatcggcggcactggagtgtcggggagagtcggtgtagcggtaccactaccgaacagaagggctggggccatcacgaggtctcccgccgaatcacggcatctcgctgattttctgcccgccgggcaggggcccatgcccatcggcgtatgcgccgctgatctggccgaatccaacgacccgagagaacgacgcgcaggggctcgaaacccttacagaactcatcacggcatacaacaaggaaatgagcaatgatttcccgcattgcaatccccagcggcgctcatccgtggaatatcgtatacatggtggccgagcgcattgccgaatcatgactgctcaccggcggtctcatggtgcagttgcacgccatcatgggcggtctcgacgtgcgtcccgctaccgacgcggatctgcttggcgcgttgattcttaagagcgccgcataccaagcagaccatgccggatatggagatagacatctgtacgatgccgcaatgctcgcatccctcatcaccgaccctgatgccgaaactcggcgactacatagccacacggatcgcagacgtatcaagctcccgtacgacatgctcaccgatgaatcaccttactggaacaaccttgacgaacaacatcgcagaacaggattcgatgccatagagacactggccgattggtagccgctctaccgaacccggctgtggcggataccagtcagaccaatcccgcctacaacctacttccggttacgtagggcgtggagcatggcgacgaacacgataacaatgaccacggccatgatcgtacagatgagtttgccggggatgcgttcgtcgcgggccgattgcatcacggcgtctgccgctgagatagtgcccgaggtctggggctgagtcttcagagttgccgattgttcaaaagtcatactctaacgataatgctgcggaaagcggttaccataaagcgtgctcacagtcgcccgtcatgcgaacttttcgaaaactgttgataaatagccattttccgcagaagcccttgcaaaacactatgatttagaatatctattagtatgacgtaaaccatattacaaactacttaaggtaagcgcttacagttcggcatgagagactcctcaccacgatatggatgcgctacagtcactatgattgatacgcacgccccatcgactacgcgatttcaccgtcgccgtacgcgcgttcggaggctcgcagacacggcttgccttgcaccacctcgacctgcgagggcggcgcgtcatcgccggcgcgcttggcctggatctgttcgaacagcattcggaaggaccgctcccccatgtccaggaagttctgggtgtaactggtcagcgccggattccacatggcaccgaagttgcggtcgtcaaagcctacgacgctcacgtcagcaggcacgcggcgaccaacctcccttagaccccggatcacagcgatggcagtctcgtcgttgccggcgaaaatcgcagtcacatcaccacgacggcccaaggtgcgtccagccttgaccgactcctccaaatcatcgtcgggcacgatgattgggtcaggtgccgtgacgccgcgctccttgagcgcgtcacgccacccattggtgcgggtgttatcggtcggaccttccggacgccccacatggaacacggtgcgatggccgagatccagcagatgcatggtcatccaacggccgccatccctttcggcgttgatgacctggtattcaccgtcgccgaagctgccacccaccacgaccatcggcatatctttgggaatgtattccagtgcggcgatgccggcccggtcgtactcgtagacgatcacgcccgccggcctgatcgacaaacccatgcgcacgcgagccttgacggagtccatgtcggactcgtccaaagaaacaatattgagcaggaaccgacgtttacgggcggcggcctccaccccatggttcgtttcggacgtggagaaggcggaaggattggccgcgaacaccaccacggagtccatctcccggttcgacagagcgcgcgccacaatgctcggctcgtagcccagctccttgatggccttggcgatgcgttcacgcttgtcttcggtgacgttgacggtgccgttgagataccgggagacggtcggtgccgagactccggccagtttggccacgtccttgatcaccggccgggtgcggcccgcacttctcgccatccttgtctcccctgttgttgtcagttgttgttattgcgtatgttagagaaccggcatcactatgacagccatccagtcacacccatatccgttcagccgcgctccgacttcggttctccgtttttcgccgcgattcattgtagttcatgacggggaacctatacccaaatcgataacttcgtgaaaaccgtacgctgagttgcggtgagtgtacggtttccgcgaaatcatccctaatttcgtgaagaacgtacactgaatcgtcgtcaacgtacggttttcacgaaatggggcctcatctcgtgaagaacgtacactgagtcattctgagcgtacggttttcacgaaatggcagctgatttcgtgaagaacgtacgctgaagatgcccccggtgtcactgatgactgttttcggtatggaaggcggcgcagcaaggtgtcctaggctaatatcgcctccgacaagaccgtcggcaaagccgtcgacgtcgattcaagttatccacagcaacaattcgcgtgacatagtatccacatttgccggttgagcttgtgcaacgatcaaaatcacccttagcgtcgagatatgaaagaacacaaggaagtttctgcactgctgcagcaggcgaagcaggagcgtcgctgctgctatggcaccagtgatgcgcaacggcgcgccctgaaacgtcgcctgcatgccggggagctggtgtcaccgtataagaacctgtacgccgaccgaacactttggaacaccatgaccagagagcaacagtcattgcaggtcatacgtgcgttgtccgcaatccaccctcagtgggtatttgcggggttgagtgcggcgtgcgtatacggactgcagcacaactattccctgcacgacggcacagtgcacatcgcctcgaagtccggcatcggcggcggagacgaggcgcgtctcaaccgcatctatatcaatcggattccgacgcggaagcataacggcattctcttgacgactccggcgcgaacgctgctcgactgcgcggcattcccattcccacaggcgctgcccatatacgattcggctctgagaaagtccctgacgaccatcgaagaggtgcagtcgctgatgattcaaagcgtctgcgacgaggtctccgtgaccaagctgctgaagtacgcggatcccctgagcgaaaacggcggcgaatcattgatgcgtggccagatcaccgaattgtctttcggcatccccctgctgcaggtgcagttcatgaatcccgacaatcccgcaatgtcatatcgcgtcgatttctgttggaagctcgcagacggccgcatcatcgtggcagaatacgacggcatggccaaatacgccgacatcagcaacaagaatcgcgcaagcctccaggcgaaaatggagtacgaccgcagacgtgatcggcatctccgggaacagggcgtcaccgaaatcgtccatgtgttctatgaggatctgctacgccccatcaatcttgagaccaagctgctcaaggccggtgtgcccaaaatccggtgaagataggccccatttcgtgaaaaccgtacgcttacgacgactcagcgtacgttcttcacgagatgagaccccatttcgtgaaaaccgtacgcttacgacgactcagcgtacgatttccgcgacatgaggccatacctcgtgaaaaccgtacgctcagaacaaggccgtcagaaggtcgactagacaacctcttaactaccgaatggtatctaaagaacggcgatattccgccagaaacgccgagagcggaatagtccccttgcgtttgtcatcggactgcgttattctgaaaccggtttcagaaagaagccgataaacaaaactcaaagccccaaggttttgaccaacgaaaggaaacatgatgtctctcaaggattccatgattcgcggtctggctgtgtacggcctgagctccatgagccagtgcggtcgcgccaacagcagcacgctcgtcgacctgatcaacgaagccaacaagaacgctcgctgagccatcggctccggtccggcaatccaatcagattagccacggaccccataacaacaaagcttaaacaacaatcgcaaagccgctcacggcgatgcgcaaacgaaaggtaatgattatgtctctcaaggattccatgattcgcggtctcgccctctccggtatggatgccatcgcccgcgccggctacgccgactccaagatgttcgccgacatcatcaacgccgccaacaaggacgctcgctgaatctagcgaacaatcccgttcatgagattgcacgacacatacgaaggcaatcccccgcaggccgcaatcggccggcacaccacaataattgaataacgcaataattcaacacagtaaaactgaacaataaccgggacaacggggtccatatattctttcttttcccatcgtgcgtacgccgcgccagcacaggttcacatacgatgcacacggccgccaatacacgatgcgtcatcatcaacgccctcaccgcatcatgagatactcccccgtccgttgtccacactgttgcctctacaatgcctgtgatgcacgccgaacggcatcctgcacagtgactgaagaacgaaacaccaagggacggaaatggataacgaactcttcgaaaaggcgccgattccgaaggcgtatttctcgctggcgatgcccgtggtgctcagcatgctggtcaccttggtgtacaacatggtcgacacctatttcatcgcgcatacgggaaacaccgatatggtggcgggcgtctccctcaccgcgccagtgttcaccgtgatgatcgccctcggcgacatcttcggcctcggcggcagttcggtcatctcgcgcttgttcggccaacaccggttcgccgacggcaagcgactcagcgcgttctgcttctatgccgccatcgccaccggcctgctgattctggtgctgggcctggcgttccgcgacccgatgctcgcgctgctcggcgccactgacgacacttggcagtatgcctccgacttctacacgctgatcatcgtcggctcgccgttcatcatcgtgtcgatgacgccgtccaacctgctgcgcaccgaaggccacgccgtgcagtccatgatcggttcggtggccggcacggcggtcaacatcgtgctcaatcccctgttcatccacggattcggctggggtgctgcgggttcggccggtgccaccgtgatcgccaacatctgcaccgacgcctatttcgtctggttcacgctgcgtcacagcagcaacctgtccatcgacccgcggaccgtcatcgaccgcgcgcgccggcgtctggcggtcacggcccgggaggtcgggggcatcctcgccatcggcatcccctcggcgatcacgaacctcacgcagagcgtcggcatcgtcatgatcaacctgttcctgctcccctacggtaccgacgcggtagccgcgatgggcatcgcgctgaaagtcatcatgatcgcggtgctggttttcgtgggattcgcgttcggcgcgcagccgctgatcggctacaactacggcgcccgcaatatgcctcgactgcgcggcattctgcgtttttcctacctgttcctgtccctgttcgccctggtgatgaccgtggtgctcagcctgtccgaccgtctactgatgggattcttcatcgaggacgccaccatcatcacgctgggcgccggcatgctgcgggttcagctgctgagcctggtgtgcgtagccgtcgtgatggtcacgacctgcaccttccagtccgcaggcaaggcggtcggcgcctttgtgctgtcgatcagcaggcagggtgtgatgctggcgattaccctgttcgtcggctcccggctggccggctatcagggtgtaatcgccgcgcaggccatcgccgatctgctgaccgcgattgtggcggtcatcctgttcgtcgtgatgttgcctgagctgcgcagtcggaaagctcgctgatagagcaacacgaggtttagcagacacgcattcggagagccaatacgctgcgtaatattgcgcgcgatattgcgcaatgggaggcggtgccgttttgttggactcatcgttgattccatcaccaccaatcatgtcacaagaccgagctcgcgtcgacgatccatgataccagttccacgatgccggtgtcgctatctttgcgatacacggcggtcagttcgccgcagctcacggtttccagtgtggcgcgcacgtcttcctttccggtactcgctcccgctgcgggagctgtctcgcatagcgagactgagggtggttctcagcgctgcccccccagtcgggcgaagcccgccagggcgggttctagtgatcgttgcaacacctgacctaccgcaaggagggtcaggtgaccagaagccaccgaaacgaagaccgtggcggggaacaccgttggacgttcaacggcgtcgaatatccgacgaggaagctgatgtgcgaggcgagacgcgccgagtacgtgcgcctgctggacgaggaaggcatgaacttcacccaggccgcgcacgcggtcggcgtctcgaaacgcaccggcaaggcgtggcgcaacggcaggacgcgcgccacgggaaggaacgagaaacccctggtggactggtatcgttccaccatggacaaacccaagaccctccatccgcgctacctgagccaggaggagcgcatccagatcgcggaccgtctgcgtctgggcgattcgatccgcgccatcgcccgcctgctgggccgcgaccccggcacggtcagccgcgaggtcgagcgcaacaggaatcccgagtccggcggttacgagccttaccgcgcccagcagaaggccgcggaccggctcaaacgccccaaaccgcgcaaggcggccgagggcacgcgactgtgggacgagatcgccgccgggttgcgcaggcattggagcccggagcagatagccaaccggctgaggctggacttcccggataatggggatatgcacgcgagcgtcgagacgatctaccaggccatctacctgcaggccaggggcgaactcaagcaggagctgaaacgcgccatgaggcaggggcgaaccgcccgcagaccccaaggcggccaaggccgcaaaccccgtttccgcgaacccatggccatgatctcggagcgacccccggagatcgaggaccgggcggtcccgggccactgggagggcgatctcatcaccggcagccgcaacaaaagcgccatcggcacgctcgtcgagcgcaccaccaggttcacgatcctgctgcacctgcccgacgggcacgacgccgaacacgtccagcaggccatcatcgacaagatgcagcacctgcccaaactcctgcgcaacagcctgacctgggaccagggagcggaactcgccctgcacaaacggatcggcgcctcgctggacatggccgtctacttctgcgacccgcactccccgtggcagcgcggcaccaacgagaacaccaacgggctcctgcgccagtacttccccaaaggcaccgacctatccgtctacccggaggactacctcgacgcggtcgccgaggaactcaacgaccggccacgcaaaaccctcgggttcatgaaaccaagcgagaagatcatcgaactgctcgacgccgcgtgataacctcaacaaccgacaacgtgaccatggaaggccgctcaaacctcaggtgttgcaaccaccactagaatctgcccagcccccgccagcgggagcctgctcacagttgtagggttcgtacgatttgttcggtggtgcgggtcacgttggcggccgcgtcggccagcagttcgctgaggctggcggctccgggcgcgatgccgaataccgcgtcgatgccgacctcatgcagctcatcgatgccggtgccaatatgcccggctactgcgatgaccggcttgccgtggcgcttggcggtttcggccacgccggccggcgtcttgccgaacttggtctggaagtcgatggagccttcgccggtgaacaccacgtcagcccattgcgcggccgcatcgagtccggattgttcgatgacgatggcgatgcccgggcggaattcggcgtttaggaagcccttcagcgctgcaccgatgccaccggccgcgccggcacccggcacgtcgttcacggcaacgccgagctggctgtcgattacctgcgcaaaatgcgcgagggcggcgtccaatgtggcgacatcatctttggacgcacctttctgcgggccgaacacggcgctggcgccggtggggccggtcagcgggttggtcacgtcgcaggcggcggtgatggcgacgttcttgagagccgggtccatcgtgctgatatcgatggtggtcagattggcgagggccgctcccccgtgtgccaagtcgttaccgttcttgtccagaagacgaacgccgagggcctgcagaagtccggcaccggcgtcgttggtggcgctgccgccgagcccgacgatgatgcgcttggctccggaacggacggcggcgagcatgagttcgccggtgccgtaggaggaggcgatcaacgggttgcgttctttggcttcaagcagtgccagtccgctggcttcggctgtctcgaccacggcggtcgtgccgtcggcgagcagaccgaagtggccttcgacaggccggccgagcgggtcgtggaccggcacggcgcgcatcgatccgccggtggcgtcgacaagcgcgcgtgcggtgccttcaccgccgtcggccatgggaaggcaacggacctcggcatcgtggtcggcattctcaatcccctgagccatcgcccgggccgcctccatggcggtcaggctctctttgaaggagtcaggggcgcataagtatcgcgtcatgcttcgagcataccgcacgacacgacgaaacggtaaacgttttccgtaattcgcgtgattatttttttgttcagaattcaggctttccaatccacaatgctactattgcaagcaaaaatgcgatatcgttgcggtaaacgtttagacacgttttccgtttcagggaagaaaaggatcgattcgatcgtggctgtacagaacgataaggcgcaatcgccagcgacattgatggatgtcgccaaagaagcccaagtctccatcgccaccgcatcccgcgtgctcaacggcagcacccgcaaggtacgcaaccaatcgtatgtcaaggtgatggaagcagccaccaagctcaactatcgtcccaacgcctatgctcaggcagtggccaaaggcaccgcaccgaacatcgtgctgctggtctccgatatctccgatccctacttcgcatccgtatcgcaaggcgtggtcaaggcggcggccgaacgcggcatttccgtgaccatcggcgtggcagccaccccgcacgaagagttggaggcggtgcgtaagtccgtatccaccaggccgcgcggcatcatcatctccgaaagtgaatacaccgacgcgccggaacgccaggcgttgcagacggaactcacccagtacgaagcatccggcggacgtgccgtgttcgtgctcaaccgcaacctgcccttcccggccgtggacatggcgaacgatgtcggcgcgcgcgccatcgcaaagctgatcgtcgattccgggtatacgcgccctgcgattctcaagggcgatgacgcacatcgctcctccaaagaacgactggccggcgtgatggaagtgttggacgaggcaggcatcaccgtggatccgaaagccgtggcgaatggtaagttcagccgtaccgacggctatgcggccgtcatgcaaatggcccgatccggactgctgaagccgggcgaaggcgcactgtacgacggcaaaggcatcgattcaatcatcgcgctcaacgacgtgatggccatcggtgcgatgaccgcgttgcgcgccaacggcatcgagccgggtcgggaaatcggcgtcaccggtttcggcgacatcccctactccgccgacgtgtttccgccactgaccaccgtgcatctgccgctggccgaaatgggccaggccgccgtggacagcatcctgtccaaccgcgatgacggggaggccaccggcggcactgccaaccgcctgatctacgtgcaaagcgccccggacgtagtcctacgcggttccctcccccgccggtaaaacaaaaatagctccctctgacggtgtaaccacaactagcgaacaggtaatggcgactgccgcgcaccataccaccgactcatacaccgacgaaatcgaagaactgttcgattaccgagtcattgagcaaccggccacgacgagtgggcaccactcgatgattatcggatacggtaatcaggccttcgctgaccattggggcgagttggtcaagggaaacattacggagagtctggggcgtgctgctcatacccgcatcgttgatggcgcggttgatgcggtcgaggtcaaggccctcgtgcaggcgcagcccgagcatgatgagctcttcgaggttttcctcgggagtgatcgtctcgctatcggcccacggcacacggttctcgttgatggccgtgccccacaaacgcgggtgcgcgatgtcccagctgcgcagaccgtgtgagacagaaaccacccccagtccggcatccgccggacaacccccgccagcgggggcatgaatttcttgggagttgttcccatgcgcgttgatcatacctagttcggcgttggcctgtccatcagctgaggcagaggcaatggcttcggacttgctcccgccagcgggggctgtcagcgaagccgactgggggtggtcagcctcggtcaccgcgttgtagtgggagtgggcacctggccctagaccggcccaatcaacgttgcgccagtagccgaggttgtgctggctttcgtatccggggcgagcccagttggagacctcataccattcgaggccggcggcggcgaacaggtcgtcagcgatctcgtatttagcggcctcgtcatcgtcattgggcttgggcagagtgccggccgcgatttgacggcccattttcgtggtgggttccacggtcaatgcgtaggcggagatgtggtttacgccaagatcgatggcggtcgtgaccgaggtgcgccaatcgtcaaggctctcccccggagcgccgtaaatcagatccacgctggagcgcagcccagccttgttcgccgcattgacgcctacggccacgttggccggcgtatgcgtgcggtcgagggttttgagcacgtgcggcacggcagattgcatgccgaaggaaacacgggtgaagccgccggcagcgagctcattgatgtaatactcgttgaccgtgtccggattggcttcggtagtgatttccgcgtcgggcgcgatgctccagatcttgcggacggcatcgagcatggcgaccagatcgcgggcggcgagaattgtgggggtgccgccgccgaagaacacggtggaaaccggcggctcctcgatgccgtggtcgagctgccactgcttggtcaatttcatttcccgaatgaccatattggcatagttgccgcgcgaggcccccgcaccaagatccgtagccgtgtaggtgttgaagtcgcagtaaccgcagcgccgcaagcagaacgggacgtggatgtagacctcgaacactagccctcggtcttctgagcggcgcggatcttgtctttggtgtcgcggtcgttggagtcctcgccggtggacagggctgcgatgaacgcctcctgcggcacctccacatggccgagcatcttcatgcgcttcttgccagccttctgcttttcgagcaacttgcgcttacgggtgatgtcgccgccgtagcacttggcgagcacgtccttgcgtaacgcacgaatgttctcacgtgcgatgatgcgcgaaccaatcgcagcctgaatcggaatctcgaactgctgacgcggaatcagactacgcagtttcttggtcatcatcacaccgtacgaatacgccttatcgcggtgaacgatggcactgaacgcatcgaccttctcgccctgaataaggatgtccaccttgaccaaatcggcggactgctcgccatcctcatggtaatcaagggaagcgtagcccttggtgcgggacttgagctggtcgaagaagtcgaacacgatttccgccagcggaatgcggtagtgcatctcgacacgatcggtggagatgtactccatcgtgcccataatgccacggtggtcctggcacagatccatcaccgcaccgatgaattccttgggcgtgatgatgtcggcggcaaccatcggctcgacaatcttcttgattttgccgtccgggaattcgctcgggttggtcacatgatgctggctgccgtcctcggcggtcacgtcgtaggtgacgttcggggcggtctggatcaggtcgaggccgaactcgcgggagagtcgctcgttgacgatttccatgtgcagcagacccaggaagccgcagcggaagccgaagcctagggccacggaggtttccggcgtgtagatcagggcggcgtcgttgagcttgagcttgtcgagtgcatcacgcagttcggggaactgggcgttgtcgatcgggaacaaaccggcgtagaccatcggcttcgggtcgcgatagccgggcaacggctcggcggccgggcggacggccgaagtcagggtgtcgcccaccttggactgactcacatctttcgcaccggtgatgatgtagccgacctcgccggcaccgagtgccttggtgcgggtcatatcggggctgatcacgccgatttcaatgggatcgtgggtcatgccaatgcccatcatgtggaccttttcgcggtcgtgcagttcgccgtcctccatacggatgtaggtgacgatgccgcggtaggagtcgtagacggaatcgaagatcagcgcgcgggcgggggcatcggggtcgccgtgcggggcgggcacgtccatgacgatctggtcgagcaggtcggccacgccttcgccggttttgccggagacgcgcagcacgtcgctcggctcgcagccgatcagacctgcgatctcctcggcatgcttgtccggttctgcggacggcaggtcgattttgttgagcacggggatgatggccagatcatggtcgatggccatatacagattggacagggtctgcgcctcgatgccctgggtggcgtcgacgagcagcaccgcgccttcgcaggcggccagtgcgcgggacacctcataggtgaagtccacgtggccgggggtgtcgatcataccgagcgtgtattcggtgccgtcaaaggtccacggcacgcgcacggcctgggatttgatggtgatgccacgctcctgctcgatatccatacggtcgaggaagcgatcgcgcatctctcgctcgggcacaatgccgctcaactgcaagatgcggtcggccacggtcgacttgccgtggtcgatgtgtgcgatgatacagaagttgcgaatcaccgactgatccgtggaacccggctgattgtgttggacgaccaacgcattcctcctcttggcatatactcaaacttcacctagtgtagccgagggactgtattcggcgtggcattgcgcgggtttttccggggctcatgctatcctctaacttttgtatgtccttataacacacatcgtttggagtaaacgtggcaaacattaagtcgcagaagaagcgcgtgctcaccaatgagaaggcgcaccttcgcaacgtggctgtgaagtccggcctgaagaccgccatccgcgccacccgcgaagccatcgccgccggtgacaaggctgccgccgaggccgcctacaaggttgccgcccagaagctcgacaaggctgctggcgctggcgtgatccacaagaaccaggccgccaaccgcaagtccggcctcgctgttgcgatcaacgctctgtgagcataagcctcttaaggttttagaaagtcccgcaagtcatctggcttgcgggactttttgtatctccgttcaaagaggtacattggcggtcttgcgaaatgacatctccgttcagagaggtaccgaatacgggaaaaaccaactataaacgccatcattgcaacacttatactcagcgtttcgtgcttcaggtacctctttgaaagcagttagcattctgcagaaggccagatgtacctctttgaagacagttagccctgaggcggccttgaaccatcctgaggcttgtcttcttcgtccttggtggtatcgccgggatcgacggtatcggcgtgcggatggatgaccgggcgcttgagatatcggctttcgctgggcaggtagacgcgatgacgttcgacggctccgggcagagtgacgttgaagcctaccgagagcagtcgcagcgccaccacgatgatgacgatcagcacgtcgagcagcatttccgagcgcatgtcgaaccagccgtagcttacgccgcgccataccagcacggtcaggatgcagccgatgaacgaaggcacagcatagaggtgtttgtctcgaataatcattggcacgtcgccaatgaagatgtcacgaatgaggccgccggccagtgctgtgaacatgccaaggaatacggctgtcatgcctgaggaaccgtaggccagagcttttgcggtgccgctgactgcgaatagtccgaggcccagagcatcgatgacagtcatcgtccatttgagtttggtgatctccgggtgggccaccaccacgataatgccggaaaacagcgtggtgagcacatagcctttgtcggtgatgccgaccggcggcagggcaccgagcatcacgtcgcgcacaagaccgccgccgagtgcggtaagccatccgcacagcatgatggtgaagatgtcgtagcccttgcgaatggcggcaagtccgcccgacaatccccaacacaggattgctaaatactcgatgaccacaaaaacgatgttgttctccaacgccacctgcatgagccactcccctctggtaccgcttcggttcgtctcagtccgtcttcgttctgttcccgttcatccttattcggcgctacagcccgtcgtacccgagcctacaacaggccttgcctgagtagtatggccggggaggaaggggccactaagacgtgaataggatggcaatgacgccagcttgccggtagtcgttggcaactcagcccctctaggttttacgatctgtaatcaaaaaacatgtatggacttaatcgttgttgatttctgattcaatcaaggcgactttttcttcgacatcacgcaagcgattgcgcagtgcggactcgatatcgatgccgtcaacgcgggccttgcgcacgacggcgaggatttcatcggcgtaggcatcggccttctcccgttcagcggaattgtcgccgcttgattcggattggttcgccgcttgaggatgtacatcatctcgctgagcatcagccgcagccggctcatcaaacgccgcgaacaatctatcagcattcggcgatttggagatgcgagaaacgactttggccgcgcgaggcaacgcaccttgagcgcgggaaatgccctcaagcacggatttacgatgcttttcctgctgtttcatcttttcccatagagccagcacagcttccggggattcgggttgggcagcttctcccccgtcgttactgtcagcatcaaaagcatcagaagaatcagaggaattgccggcatcatcagccgcaaacacatgcggatgccgagtgatgagcttgttcaccaaccgatcggcgacctcatcaataccgaacgggtcctcagtatccgattcgcagacccgcgcctgaaacacggattgcagcaacacatcacccagttcctcgcgcatgttgtcacggtcgtgagtctccaccgcgtcgacgtattcgtaggtttcctcgagcagattcttgagcagcgacttgttcgtctgcttgccgtcccacgggcagccgcccggcgaatacagcacatccaccacggccttgacccggtccagcgccgtcgctgcctcagccaccggcttcaatttcgagcagtgttcgaagcctgacggcaaacggtaggctgaagcatggtattccgtcatgtcactcatcttgctcataggtttgctcctgttctcatctggatgaaccataaccaccccccgcaacgtgcagaagacctagatcatattatttgttgcggaatgttgctaaatccatctgtatctctctagccaagaacatttccaatacgccaagaccccttggaattgttgctgttccaaggggtcttagtcagaaacaaaaggtgctagttcagcacaccttccacatccagttgtgcgggtcctcgacttcgccgagctggatgccgagcagctcgtcgcgcagttcgcaggtgagcttgccggagccgccgtcggcgacggtgacgtcgaacttctcggacttgaagcgaccgatcggggtgatgatggcggcggtaccgcaagcgaacacctcggtgacttcaccggacttgatgtcctcgagcagctggtcgagggcgatcatggtctcgaccacgtcgtggcccttgtcctgcagcagctgaatcagagagcgacgggtcacgcccggcagaatgttgccggtcagggacggggtctccacgtggccatccttgtgcacggccatcatgttcatgccaccgagctcttcgaggtaggtcttggtggcggcgtccacgaagcacacctgctcgcagccgttctcaacccccttgtactcgccgagcagggaggcggcgtagttgccgccgcacttggcgaaaccagtgccgccagggccggtgcggaaccacttgtcttcaacccagatgctcaccggcttgacgccgcccgggaagtacgggccggacggggaggcgatcacgcagtagtcgacttcctgcggggcgcgcacgccaaggaacggctcggaagcgaacatgaacggacgcatgtacagcgtgtactcgcggcgggacggcacccagttggcgtcgcgcttgaccagcgcggccacggaaccgaggaagtcgtcaatcggcagctcaggcaggtacagacgcttggcggagttctggaaacgctcggcgttcgcatccgggcggaacagccaggtggagccgtcggcatgacggtaagccttgaggccctcgaagcactcctgtgcgtagtgcagcacggaagcacccgggtccatcttgagcggtgcgtacggttcgacgcggcggtcggaccagccttcgcccttggtccaagtcatgtgggtcatgttgtcggagaacacctggccgaaagccggcttgtcgatgagggactggcgcttctcatcggatgcggggttgtcgttcggcagtacggtgaacggttcggtgagcttgtcgagtgctgccggatcgtggtgcgtgttttcagtcatcactagctacttcttcttgactttggcggcccgaaagccaccatatggggtgtgtgctgtgcgcttgtggcgcgaactctgttgcatacttttgcacacccatgtgttactcgtgtggcagagttcacatggtgaaaaacgaagaagcccacaccgttctcaacggctgcgggcttccacgtttcagttatgttctgaattgttcgctatcgaagcgaccgactcacttggcgtcggcagccggagcagcagcgtcggcagccggagcagcagcttccggagcggcggtggactcagaagcatcttccggcacctcaacggtgacgacggactcttccgggtcctcaacgtcgagctcaacgccttcaggcagaacaacgtccttagcgaacaccttggtgccgtcggttaggccctcgacgctcacaacgatcttctcaggcaggttggcgacgtcagcgcgaaccttgagctcctgaatgtcgacgaatgccacagcagcgcccttcggggtgccttcaacgaagaccggcacctcgacgtcgatcttctcgccggccttgacctcaaggaagtcaacgtgctcgatgatgcgcttgaccgggttcttctgcacgtccttgacgacggccatcttggtgttgccgtcgaaggcgatggtgaacagggcgttggtgtgacgcagggccagggtggtctcgcgcatcggcaaggtcacgaaggcgggctcttcgccgccggcgtagatggtggccggaatcttgttggcaacgcgcagacgacgagcaacgcccttgccgaactcggaacgggcctcgccctcaagcttaatggtggtagccataatggatactccttgtatcttcgtttcgtactgtctcgctcagacgccacgacgcgccgaaagacaccctacaaggagtgaaatacgccgagtcgataacggaatctgtgtcatgtgtcagcatgccacttccctcgccaaagcaacaattgtcaagtatacgccaaccccggaccttgcgtaatgatgcttcgatgacactgcatataggccgtcccagctacgtcaacgtacggtttccgcgaaataatccctaactttgtgaagaacgtacgcttacccgttctcatcatacggttttcacgaaatcgttcgccatttcgtgaaaaccgtacgctcagcgacactcagtgtacggtctttcacgaagttgtggatgatttcgataataacgtacgatggtgagtaccatatcgggaggttgatatgactcgttcggacgacgtcatcaatgaggatggccatgacgtcatcgccgcacacactcgcgttgtcaggggcatggctgcggcacttgccgcgatagccgccacaggagccggcgtcacagccgcggccgccaacgtcatgttcatgttcgcgctggacaccaaggccaaacgttcgatgttcaacatgccgcacgaggagacaccgaaaggcatcgaattcgacatgtccgagcagcttgaggccgcccggtggttcgaggaggccaagcaatcggtcacgctgcgcagccatgatggattgaaactccacggctggctgttggacccggattgttccgacccacagccgcatctatacgcgatctgctgccatggctatgccggagagcccgcggaaatggccaaatgggcgcatcgctatgcgcaactcggttttacggtcctgctacccgcgcagcgcgcccatgagttgagcgaagggcgttacgtgggtatgggattgctggaaagcgacgatctgttgggctgggtttcgctgatcaccgcagctgatccggatgcacgcattctgttgcatggcaattcgatgggcgccgccacggtgatgatggcggccggcgatgcgcgactcccccgcaatgtcatcgccgcgatttccgattgcggatacagttccgtggtttcgcagtttacggataatgccgaggagatgttccgtttgccgcactcgttggccgcgctgctggtcaaagtggccagtcatgtgtctaaacgcaaggccggataccggtttgaggacgcctcctgtgtgaaggcattacggcacgcgactattccgatgatgttcattcatggtggagcggatacttttgtcaatccgaagtatctggacatcaattacaacgcctgcgccagcatcgaccgcgagaagctgctgattcccggcgccgaccacacgatgagcgccagcaccgatccggaccgctattggcgtcgcgttaacagctttgttaagcgggtgtttgggctgtagtagatatagagctcggctcccctctgtgaggggagccgccagcgaagctgactgaggggagcacccgtgtatgggctactcccctcagtctcactccgttcgacagctcccctcacagaagggagccaagaatggttacgcgagcaattccttgacggcggcgatgacggactgcagactcttcttcgcgtcaccgaacagcatctgggtgttgtcttcgaagtagagctcgttctggatgccggcgtagcccataccgcggccgcgcttcatgaccacgacgttctgggacttgtcgacgtcgagaatcggcatgccggagaccggggtgccgggacggcgagcagccgggttggtcacatcgttggcgccgacgaccagagccacgttggcctgcgggaactgcgggttgatctcatcgagatccacgagctcctcgtagggcacgttggcctcggccagcagcacgttcatgtggccaggcatacggcctgcgaccgggtggatggcgtaggagacttccacgccgtggcccttgagcagttcgccgaggtcggcgagctcgcgctgggcctgagcctgagccagaccgaagccgggcacgaagatgaccttctgcgcgtagacgagctgaacggccagatcgtccggcgtggtctccttcatggtgccttccggaccgtcgccagcagcggcggcgtcagcaccaccgccgaagccaccggccaagacggagagcagcgggcggttcatggcctgagccatgaggatggacagggtcacacctgcggaaccgacgagtgcgccggccacgatcagggcgacgttgtcaatcgccagaccggacatagccacagccgtaccggtgcaggcgttgagcacggagatcaccaccggcatatcggcgccgccgatcggaatcacgaagaccaagccgtagcacagggcgaacacggtggtcagaatcgaccacagcagacgctgttcgggctggacgcacagcatgaccagcgaggcgacggacagcacggcgaacagaatgttccatacgcccttgcccggcaggttcagcttcttgacccacttgataccctgcagcttgccggcagcgatgagcgagccggtgaaggtcacagaaccgatgagaataccgagaccagcggtgatgagcaccacgatgtccggggtgccttccttggtcaggatgtcgttcagggccacgagtgcggcggcgccaccacccacggtattgaacacggagaccagctgcggcatatcggtcatcttcaccttcttggcggagacgacaccggccacggcaccgatcaggatgccgacgaccagcaccaccacggcgacaatgttcacgaagcccttggcgaagagcacgatgaacgccatgagcacggccacgaccatgccgaacgcggagatctggttacccttgcgggcggtcttcggcgaattcatgaaatgcagaccgaccacaaacaggacggcagagaacaggtagacgaaccaagcgacgatgtcgatggcgccaacggttgcggaggtcattacttcgactcccccttcttctcgttcttgctggacttgaacatctcaagcatgcggtcggtgaccacgtagccaccaacgacgttcatggtgcccagcacagcggccaggaagatgaacacgtaggccagcgggctattggcttcggctgccacgatcacaacgccgacgatgacgatgccgtggatggagttcgcgccggacataagcggcgtgtgcagggtggcgggcaccttgccgatgacctcgatgccgatgagcagcgcgaggacgaacagggtaatggaaacgacgagagtaggcatggtattccttcttccttacttctcggacttctcggcatcggcagcagctgccggggcggcggcgcggccggcaaccaccagcgcgtcgtcgagttcttcggtgagatcctggccgagcttgccgtcacgcacgaagtgcacgaggatgtcggccacattgcgcgaaagcaggttggatgcggtggtggcgacgccggaggccaggtagggagcgccgatcagcttgacaccgccctcggtgacctgctcaccaacggcggagccttcgacgttgccgccgaggtcggatgctgcgcagtccacgatcacggcaccacgcttgagacccttgacgccggctgcggtgagcagcaccgggggcttacggcccgggaccttggcggtggtgatgatgatgtcaaagccggcggccttttcgtcgacggcagcctgctgctgagcctgctcttcggcgctcagcgcgcgggcataaccgccctcgccctggcccttggagaagtcaagtcccagatcaaggaacttcgcgccgagggactcgacctcgccctgggaggcgggacgcacgtcgtacgcggtgacgaccgcgccaagacgcttcagcgtaccgatggcctgcaggccggcgatgccggcaccgagcaccagcgccttagccgggcgaatcgtgccggcggcggtggtcatcatcggcaggaaggaaccgtaagcatcggcggcggtgatggctgccttgtagcccatcacggagttctgagaggtcatctcatccatggactgggcgctggaaagcttacggggcagcttttcgatggcgatgcccaccagaccggccttctcgagcgcggccacgtaatcggcatcggtgaaggaaccgagcatgccaatgacccactggccggccttgagcttggccacggtctcggcggacggtcggtccacaaaaccgagcgcgtcggcttcggcgagcacctcgtcacggctggtcaccttcgcaccggccttttcgtaatcctcatcggtgtagtcggcagcaatgccggcacctgcttcaatcagtgaggagacaccgctcctcttcagccgggtgacgatatccggcgtcagcgcgacgcgggattccgtttcggacgtttcgttcaaaacgccgaacaccacggtggcttctgggttttgcgccatgagagccctttcttgttctacttcaaaatggacatggttatccgcatggtaagtgtagtcgaaaggtaaagaccatgacttgagattccgccaatcgaaacagaaacgaacccgaaattagtaagaaatacgaatgtgtccatgtgcattgcggatgaattgctcggaagccgtccaacaatcacccggcatcgatcagcaaccaaccgctcaataattatcgacaatcgccgtttcgcagctcacggttactcaacaatatcggaacctgtgcaatattttgccacgcactcccctaacccgccagaatcctacggttgcgtaaggtgacgagttcggtttgggcgattacaatttgaactttgagaagcgttcgcctcatggctggacgacactgaaaggtttacaggagcaagacttgtcggttatcaattccttcacgcagcacacgatcaatctcacccgtaaggcgctcaggttgggatccgacttcgtccacccggtccacgacgacaccccggacgagcccgattacctgtccaacgccgacgtgccggtcgaggccaatatcgctttgcctcacagcgacgattgggacgacggccacctgaccgtcaccgacatcgaccccgccaccggcctgctcaccacctccaccgaaggcaatccgccgctggacgaaggtacgtccatctacgacctgtatgcggaccgcgccgaacgtatgggcgatgagccgctgtacacctacaagtccggcaacgattgggtgaccgtcaccgccaacgagttcctggctgacgtgcgtgccgtggccaagggcctgattcattacggcctgaagaagggcgatgccgtggcattcatgtgccgcacttcctacgactgggacctgaccgacgcggcaatcatggcctgcggcggtgtgctggccaccgtctacgacaccgattcggccgagcagattcgcaatatcgtcaacaactccgatgcccgactgctgatcgtgcaggacacggacatgcgtaagaaggcggatggggccgtcgaagagtgcccgtccctggagcacatcatcaccatcgagaccggtggcttggacgagatcaaggcctacggcaccacggtctcggacgaggagctggacgagcgcatcgattcggtcaagaagaccgacctgtgttccatcgtgtacacctccggttccacggccgcgccgaaaggcgtggagatgacccacgagcactactgccagaccgcgctgaatctgccggcctacatgcccgatctgctgcacgacaagaggaacaccatcctgctgttcctgccgcaggcccattccttcgcccgcgccatcaactacatcgtcgtctcctcgaacgtccgcatctacatcgccaccggcatcaagacgctgatcagcgatctgcaggtggccaagcccactctcatgatcgtggtgccgcgcgtgctggagaaggtgtacaacgccgcgtcccagaaggccggccacggccccaagggcgtggtgttcgcctccgccgtggtggccgcgcagaactatatgaaggaagtctccgccaatggcaaggcgggtgcactgacccgcactcgccgcgctgccttcgatccgattgtctactcttcgctgcgcgaagtgctcggcggtcgcgccaagtggattgtggccggcggtgccccgcttgacccggaactgctggctttcttccgtggcgcgggtgtgcctgtatacgaggggtatggtctgaccgaaaccaccgcgccgtgcgcgttcaacccgctgggtacgccgttccacgctggttccgtgggcatcgcattccccggattctccctgcgcatcgccgaggacggcgaaattcaggtcaagggtcgtgccgtgttcccgcgctatcacaagaacgacgaggccactgagctgtcgttcaccgaagatggctggtatgccaccggcgacttgggccgtatcgacaacgatggcttcctgtacatcaccgggcgcaagaaggatctgatcatcactgccggcggcaagaacgtctcccccggcccgatcgaggaagtcatccagcgttgcgagttcgtctcccaggcgttggtgctgggtgacaaacgcccgttcatctccgccctggtgacgttggacgagaagtcgttgcgcccgtggctcgccgccaaggggcttgacgagaacatgtccctcgaggacgcggcaaggaacgccgccgtgcgcgccgaagtgcagcagtgggtcaatcaggccaacgagggcgtctcccgcgccgagtccgtgcgcaagttcatcatcctgcccgaggagttcacccaggagaacggcctcatgaccgcctccatgaaggtgattcgtcccaaggtcatcaagcgctactccaccctcctcaacacccagatgtacaccaagcggaagtaaaccgtatagcaaaagctccctctgacgagggagcttttttcgtctatacgccctagaagccgaggcgttctagttgcttggggtcggactgccagcctttggctaccttgacgtggaggtcgagcttggctttttggccgacgatgcggttgaccggggtgcgcagcttcttcttgacgtaggtgaggttcgaggcgcccttgccgatgatgatcggcttctgggagtcacgctccacgtaaatggacacgttgacctgcgccttgccgtcatagccctgaccggtctcgttgtcttccggatagtcgatggaatcaaccaccacggccagcgaatgcggcagctcgtcgtccagggtctcaaggaacgcaccgcgcacgagttcggcgatggtgtcttccggacgctcctcgctgatctgatcgtccgggtacatctgcggaccctcgggcgtgtgctcaatgagcacgttcttcacttcagccagattgtcgtgcttcagggcgctcaccggcacgatgtccgagaaatcggcgaaatcgttgatttcgatgagcttgttgatgagttgctgacggccaagctcgtcgatcttggtgacgatggcaatcagcgggatgcgccacttgaacgtaccgtcctcacgcttggtggcgaagtcggtacgcagtcgggagagaatacgcttgtcgccggggccgatttcctgatcggcgggcagcaggaaggccaccacgtccacatcggccagagattcgtcgaccacgtcgttcagacgctggccgagcaacgtacgcggacggtgaataccgggcgtgtccacgagcacgagctgcgcgtggtcggcggtcaggatgccgcggatcgccttacgggtggtttccgggcgagaggatgcgatggcaatctgcttgccgatcaacgcgttgatcaacgtggatttgccgacgttcgggcggcccaccacggccacgaatccggagcgatacggcacgtcctgcttggtcacgttctccgtctcaccggtcgcgtcgacttcggcaacgccggcaacatcggaagcatcggtaacgtcaatgtcatcgacgtcgttcgtgctgttgttctggtcggtcatatcactccttgctggcggtatcatcgccttcgacgggctcgccgtcagtttcctcatgggtcttgttattttcctcgccgccctcgacgtgcgccggttctacgacgatggtggacaccttcttgcggcgtccggcggagtccacggcggtcagtcgcagaccgcgcgtcacggccgaggcaccgacaatcggcacgcggcccagaatcttggtcagcaggccgtacacggtatcgacatcgtcctcatcaatgtcgatctcgaagatctcctccagatcggcaatcggcgtacgggcgggcatcttccacttgttgtctccgattttctccggctcagtacgctgggtgcggtcgtgctcgtcttccagctcgccgacgatctgttcgatggcatcctcgatagtcaccatgccggcgatgccgccgtactcatcgaccaccacggccacatgctggcgggaacgctgcatctcatggaacaggtcgtccaccggcttggattcgggaacaagcagcggctgccggacgatggattcgaccgcgcgctccatggccgccgggttgaaggcggtggcacgcacggcgtccttcaaataggccacgccgatcaggtcatccacatcctcaccgatcaccggcacgcgggagaaaccggagcgggagaacagtttcagcgcggaagacagtgtggagtcgcgctccatgcagatcatatcggtgcgcggcaccatgatctcgcgagtcaacgtatcagacagggtgagcacgttgcgcaacatttcggagacttccggatcgaagtcgttggactccaccagtcggtcgatggcggccttgccctgctcgagctgaatcttctcaagctcctcgtcgtcggacagatcggagtccttggagcggcggcccggtcccttggaaccggacttgtcgccaccgatgcgtgcgaacggcgtgagcttggtggccaacgacacgatgcgcgagttggaaatcatgatgccgaccggcttggccatgccggcggtgcgcgggcggaccagtacggagaccacggctacgataatcgcgaacaggaatccggagagcagttcaatccacagttccgcaccccacagggatgcgatggaagacaccagtacgccgtcgagcacattgcaggcgatgcggaagaacgcacagctgccggcggtggcgtaacggtcggcgatgagccgttgcacgcgatgaatcttgtcgatcttcttcatcttgaggaactggcttgcttcggagtcggtctgcacctcgaggatgagattgttaaggctggctcgcgttacgcgggccacggcgccttcagcggcggccatggtcagcgagagccagacgaacagggccgccacgagtacaagaatgacggtgatggcgatcggcgtggtactggaatactccataatgatttttcggtgtccttgaatgtccttgaacggtatcgaataatccggatttggtgtgattgatttgggagcttatttggaatcgaggtcgcggccagcaccgtgcgcggcgtcgtacagggccagcgcgtcgggtgtgccggcgggcagcgtggcctgcacgttggcatcgtggcgtagggcgaagaaggtgagcagcagctgtcgctgcaggccgaacatctggcgctcctgctcgggggtcacgtggtcgtagccgagcaggtgcaggatgccgtggatggtgagcaatagcatctcctgcatggtgctgtgcccggctgcggcagcctgttgggcagcgacccacgggcagatgacgatgtcgccgagtactccttccatcacggttttgccgtcgccggggcgcagctcgtccatcgggaagctcatcacgtcggtcgggccttcgaggttcatccaacgcatgtgcagttcggcgatgggatcgggatccacgaacatgatggtcaggtcggactgggtgctcacgcgcatctggtcgagtacccaaatacccaaatcggagaagaccttggggtcgatgacccactgggtttcattggtgacgtcaacgctcatcgtctgtctcgctttggttggttgaatccgcttgctggcgggcatcgaagtcggtatggttgcggcggcccttgcgttcgatgtcgcggtggtcgccggcgatggcggagtgacggtcgtaggcggccacgatctgtccgaccagctggtgacgtaccacgtcctcggttttgagatgcacgaatgcgatgtcgttgatgccgcccaggatgcgttcgatggtggccagtcccgagcgaggcacggtcaggtccacctgcgagatatcgccggtgatgaccatcgtggtgttgaagcccagacgggtcaggaacatcttcatctgctgttcggtggtgttctgagcctcgtcgaggatcacgaacgcgtcgttcagcgtacggccgcgcatgtaggcgagcggcgccacttcgatggagccgtcgtccatgtaccgcttgagctggtcggcgccgagcatgtcgccaagcgcgtcgtacagcgggcgcagatacgggtcaaccttgtcattcagcgtgccgggcagaaagccgaggctttcgccggcctccacggccgggcgcgtgaggatgatgcggcgaatctgcttgtcctggaaggcacgcacagccttggccacggccagatacgtcttgccggtgcctgcggggccaatgccgaaggtgatggtgtgcgattcgatggcgttcacgtaggccacttgtccggcggttttcgcacggaccggcacgccggcagcaaaggtgatgacgccgggaaccgtgggcttgcggtacgtcgggtcgtgggagccggcagaacgtgcatgggcgcgttcgtttgaggtcgattgcgccagtttgtcacgcaccgggccgtgaccgggatgttcgaggcgcacgtggttcttgagcacgttctggtcgagcatgcgacgcacggtgtcggcgtccataggcgcggtgtaggcggcttggatgatggtattgaccaaatcctcggcctgtgcggcctgggcttcggtctgcttggagcgggagacgatcgccacgcggttgccgcgcacgataatcgtcaggtccggaaaggcgcgctctacctcgcgaatgacctcgtcaaccgggccgagcacggcgacggggtcaagttggggcgggatggtgatggtacgtgtagtcgttgccacgaagcggatattcccctactactcgtcgagcttttcgccggtcatcacgtgcgcgtgcacgtggaagacggtctggccggcgtcgagaccggtgttgaacaccagtcggtaggcgccgtgaaattccttgtcggcgatgttctgcgcaatggagacgatgtgggccagctcggtcgggtcaccggcggcaagttcggcgacgttggcgtagtgcttcttgggcaccacgagcacgtggaccttggccttgggattgatgtcgttgaatgcgtaggtcgtctcgtcctcgtagaccttgctgctgggaatctgccctgcgatgatcttgcagaacaggcaatcgtcggattcgctcatcatgctccttggtttgatgttgctacgcaccagcttagcgcgtgggcgttactcgtaacgtcccaacacccgagacaacagcgacaacgctacaggaccggccgtcgcggctctcagaatattgcgccccagtacgcagctcaccgctccggccttgacgaaatcagctacctcctgctcactgatgccgccctcaggcccgaccaccacactgacagtccgcggcaggccgtcctggagcgtgcgttccaccaactgcgcaaccttctcctccacgccggaccacgtatcggtagcatcctgatgcagcacaatcaccacatcgccatgcacgcaggccctgcggcagatggccacgacctccttgctggacgcacacgcctccagttgcggcttaaaggcgcgccgcgactgctcggtggcggcatccagtaccgaattccacttcttgtctgtacggccgaccttccacttggcaatggatcggtccgcctgccatggcaccacttggtcgacgccgatctgagtagccatatcgatggcctgctcatcatggccggttttcgccaatgcctgaatcagcgccaaccgggtgagcggctcgggttcgcgccccacttccacgacttcagccagtccggcttcaggatcggccatcactgcctggattctcaagccgctgccgtcggaaagttgcaggctgtcccctgccttgaatcgcatggcctgcacggcatggcgcttgatgtgagcgggcagggttagcttccagccggcgtggagttcgtcgctgttcaccgggacgtcgtcgacctgcgggtcgaaaagaaaaagggcatcagtcatgacttcaaggctacacgcgacacgccgggcacacgcgcgaattgcatcccggtaatttcatgctaagctatctactcgttgtccaaacgacacctgcccgggtggcggaatggtagacgcgctagcttgaggtgctagtgcctattttatacgggcgtacgggttcaagtcccgtctcgggcacagataaaccccttgcattgcaaggggtttttcgttatctgcacacacgaaaggccaccaatgcagttcatcacgctggacaccgtcgacgacccgcgcgtcgaagcgtatgtgagcctcaccgaaatgcagttgcgtaatcgcttggaaccagccaagggcgtgttcatcgccgagtcccccaaggttatcgaccgcgcgctggccgctgaccgcgaaccgctgtcactgctggtcgaggaaccttggctggagggcatgaaagacaccttcgacttcatcgacgggcgctggggcgcggatattcccgtctacgtggcctcacctgagcagctcaagcgtctgaccggctaccgtttgcatcgcggcgccctatgcgcgatgcgacgctggccgttgccctccgtagccgaggtctgcaagagcgcccgccgcgtggcagtaatggaaaacatcgtggaccacaccaatgtgggcgcactgatgcgttcggcggccgcgctcgatgtggatgccgtgctggtcacaccctcctgcggtgatccgctgtaccgacgcgccgcccgcgtgtcgatgggcaccgtattccagattccgtggacccgtatcaccgggttcaacgacgacggcaccgaaaacaagcattactggccgttccagggcatcgacgagttgaagtcgctgggcttcaccaccgtggccatggcattggaggatcgttcgatttcgttggacgaactgacacgccgtctgcacgcgcctgccgaagatccgacgcatatcgacaagctcgcgctgatcttcggtaccgagggcgacggcctgtcccaccatacgattgcccgcgccgatttgaccgtgaagattccgatgagccacggcgtggatagcctgaacgtggcggcatccagcgcagtggcgttctacgcgacacgctaaggaatcgcacgcgctccgaaaaggccggatccttaacaaatctacgaaactgttcatcgcaagttcacggcacgcgggggcgaaagccttgcatgttcgtttttttctgcaattattaactatgtaaaccgaatgcaaggaagcatccggcccggcagtgcggtgtcgaaagacgctcagtaacagagaggacagttacgatgaccaagaatcccaagattctgtcgattgtgcttgcaggtggtgaggggacccgcctgatgccgttaacccgtgatcgcgcgaagcccgccgttcccttcggtggtgtgtatcgtctgatcgatttcccgttgagcaacctggtgaactccgggtaccgtcaggtcgtggtgctcacccagtacaagtctcactcgcttgaccgccacatctcccaggtctggcgtttctccccgctgcttggctcgtacgtctcccctgtgcccgcgcagcagcgtctcggcaagcactggtatctcggctccgccgacgccatctaccagaccatcaacatcatcgaggatgtccagccggacatcgtggtgatcgtgggtgccgatcacgtctaccgcatggacttcgaacagatggtacagcagcacatcgagtccggcgccgagttcaccgtggccggtatccgccagcccatcgaggaatcgaaccagttcggtgtgattgaggtcgatcccgatcacccgaacatgatcaagaacttccaggagaagccgcccaccaccaccggtctgccggacaatccgaaccagattctggcctccatgggtaactacgtcgccaacaccaaggccctgttcgaggctctggctctcgatgagaaggctgccgacaccaagcacgacatgggcggcgacatcgccccgtacttcgcttcccgcaacgaagccggcgtctacgacttcaactcgaacgagattccgggctccacggccactgatcacgcttactggcgcgacgtcggtacgattaagcagttctacgatgcgcacatggatctgatcgcctatgtgcccgagttcaacctgtacaaccaggattggccgatttacacgatgtccggcaacctgccgccggccaagttcgtgcacgccggccgcgaccgtctgggccacgccaccgattcgatcgtctcccccggtgtgatcgtctccggcggtgaagtgcaccactccgtgctctcccccaatgtgcgtatccactcgtgggcacagattgtcgattccgtgctgttcgacggtgtagtcatcaaccgccgcgcccgcgtgtacaaggcgattcttgacaagaacgtggtgctcaccgagaactccactgtcggcatcgataccgagcacgatctggcccgtggcttcaccgtcacgccggatggcatcacggttgtcccgaagaacaccatcgtcgatgactgattgaccagtccagacatggaaaagccccgcatcatgcggggcttttctcgtatagagctccctctgatgagggaacttactaagcgctatcagtactttggcatattgtcgaagctgaagcctagggcggcgagctggtcgcggccttcgggcgtgatgcgctccatggtccagcgcggatcccacgtccagtcgatgcggaactcctcgaccagaccggccagcgtggatgcgcattcgtcctcgataaggtcggtcagcgggcaggccggcgtggtcagcgtcatcgtaataatggcgcggcctagctcatcgatctcaatgccgtagaccagacccaaatcgatcacgtcgatgccaagctccggatcaatcacctgatgcagtgcctcgcgcacgtcttcggcagtggcgcggccgatatcgtcaatcgccttgatcggaatctcgctgccatcggactgttcgtcatcctggcaaccgcatttgccgtggtgaccgccacacgcacaggtgtcatcgccggacgcagcagagtgctcgatcgggcgtccgttcgggaagcccttggccaaggccgggttggccatcacgcggcgagcggcctcctcgtcctgcaggacgccgttgacagcatcgaaaacggacggctgtggttcgggaaccaaattatcgttggacatatttcctcagttctttgcagcgagggctttggcgatggagtccttcagcccttcccagcctagcagagcgcatttgatgcgcatagggtatttcgacacgccttggaataccacggcgtcgccgagcttttcttccaggttctcgtcgtccagaccggcaccgcgcgattccatcagcttgtggaatgtctgttccagatccatggcctcgtcaacggttttgccgtccaccagatcgaccatcaccgacaggctggcctgcgaaatggagcagccgtggccgtcccacaccaatcgcttgatggtgtgcggttcgtcatcggagacttcgacatggatggtcgcctcgtcgccgcaggtcgggttgaactggtgcgattcaccgggcgtgcagtattcgtggctggcttgtacggtgacattggccgctgcgtccgcggactgttcgaccgctgcgttgggcgcaaaggattccttgccatgcggatgtttcgacgcctcgaggatgacctcttggtacatctgttcgaggtcatccccgctcataccgaattcgttcatggtgttctgttttactccactccaaagaacttacggatgcccttggccgcttcgaccaacgcttgggcatcttcgaccgaattgtagacaccggaggaggcacggttggatgcgtataggccgaagtggcggtgtaccggctgggcgcagtggtgtcccacgcgaatcgcgatgccctgggcgtcgatgaactggcccacatcgtgcggatgcacgccggccacgtcgaacgccacggtgccgatgcggtccacgttttcgcgcggcccgaggatgcgaatgccatcgacgtcgccgagcttgagcagttcggcggcgatggtcttctcatgggcttcgatgttctcgagcccgatgttcatcatccattcggcggcgacgcctgcggccaccacttgggcgaccggctgggtgccggcctcgaagcgggccggaggggccatgtattgggcctcgtggtccatgtaggcgagctcgaccatggagccgccgaagttggccggcggcagggcttcgagcaggtcgcgcttaccgtacaggaaaccgacgccggtaggaccgtacatcttgtgcgcgctccaggcggcgaagtccacatcaagcgcgtggaaatcgaccttgaggtgcggtacggactggcaagcgtccaagatgaagatcgaacctacttcatgcgcacgcttgatgatcggggcgatgttggtgatggcacccgtggcgttgcccacgtgggtgacggccacgaccttggtacgctcggtgatgacttcgtcgaggttgtccgtacgcacacggccgtcctcggtcaggtcgatccacttgaaggtggcgccggtacggtaggacagctcctggaacggcagcagcaccgaatgatgttccgcacgcgagacgacgatctcatcgcccggcttcagggcaaaacgcttggcggcttctcccccacgccccagcgatgcattgccgaatgcggtggcgagcaggttcagtccggccgtggcaccaccggtgacgacgacctcctcttcaccttcggccgcattcgcgccgaccagcttggccaccttggctcgggcctcctcaaaggccatggtgctacgggcggccagctcgtgcgcaccacggtgcacgccggcgttaattgtacggtagaagttcgcctcggcgtcgatcaccgcattcggcttctgcgaggtggccgcagaatccaggtacacgagcgggtgcccgtgaatctcctgatccagaatcgggaactgcgcccgaatcgccttaaaatcaaccattatgttccccctacttacgtaacaattgtacgaaacgagtgggagtctgacatggcctgttcgcgaccgtaaagacctggcctaagcggcccggagcgtgtcgagaatagggcatgtcagactcccacggtcacggactcaggccagtgcggactcggagtcggcgccttcgggcaggtactggtcgtagccgttctcttcgagttcgtcggccagctcagggccgccggtcttgacgaagtggccgtcggcgaacacgtgcacgatgtccggcttgatgtacttcaagatacgggtgtagtgcgtgaccatgaggatgccgaactggttggcttccttggcgcggttcacgccttcggacacgatgcgcagggcgtccacgtccaagccggagtcggtttcgtcaaggatggcgaacttcggtttcagcagttcgagctgcagcacttcggcgcgcttcttttcaccgccggagaagccttcgttcacggaacgggaggcgaacttcgggtccatcttgaggcgcttcatggctgcggacaggtccttggcccactggcgaataccgggagcctcgccgtcgatttcggtcttggcggtgcgcaagaagttggtcatggacacgcccggtatttcgaccgggtactgcatggccaggaacaggccggccttggcgcgctcgtccggagtcatcttgaggatgtccttgccgtcgaggagggcctcgccggagtcgaccacgtacttggggtggccggccaacgtgtaggcgagagtggacttgccggaaccgttggggcccatgatggcgtgggtttcgccggagtggacggtcagggtggcacccttcaggatcggcttgatgccttccttggtttcgacgtggacgtgcaggtccttgatttcgagtgttgacattgttgtgctcctaaaaatgctgttcttacttgtcttcgaggacctgtgccatggcgtcgttttcaccacgggccagtcggcggtcaatcacggtcatcagatgttcggagatggcgggaatgccgatctcctcgacgagttcgccgaagaagccgcgcaccacgagcttgcgggcgtcggtttcggggatgccgcgggattcgaggtagaacagttcctcgtcgtcgaagcggcccaccgaagaggcgtgaccggcaccgatgatgttgccgttttcgatttcgaggttcggctcggaatcggcgatggcgcccggggtcaggaccaggttgcggttgagctcgtaggagtcggtgccgggggcggtgggctggatgagcgcgttgcccacccaagtggagtgcgcgcccttgccgtcaagcgcgcccttgtagaccacgcgggacttgcagtcggggtggttgtgtaccaccatcgtgcggtgttcgatgtgctcgccggggtccacgaagtagatgccgagcatgttgaggtcgccctgttcgccgccgaagtcctgatccatgcggatgcggacgatgtcgccgcccaaggtcacgacggagtggcgcagggatgcgccttcgccgacgtggatgcggtggttggccacatgcttggcggttttggcccattcctgaacgaacgtggtggagacgtgcgagtccttgccggtggtgatttccacgccttcggccagtcgtgcgtcaccgtcgtgttccacgacgacgtccgcatgagccttgtcggcggcggcgatcaccagatggaaagcgtcgagatcctcccccgcgccgtgcaccttgacgagcacgggctgggcgatctcaccggacagtcccagaatggttgcggtgcggccggattcccattcgactgcggagacgcggtcgttgggcttggacacagtgccggacaggccctcaccgagcttgatctggctgagcttcacgccttcggccaacggcgagccgtcaatcatggagacttcgatctgcgtttcgccggaaggcttgaacacggtgaagaactcgttgatgcgctcgataggcgtgtagcgccattcgtcctgcttgcggctgggctccgggtagtcgcctgcgttgaacgagcgcacggcatggtccacggaggacggcatagcggccggaatcgcgtacgggtcgttggggtcggcgaccggaatcttgatttccttgacgggtgttgtgttgtcggtcatcggaatcagcccaccgatccttccatctgaagttccacaagtctgttgagttcaagcgcgtattccatcggcagctcacggctgaccggttcgacgaagccgcgcacgatcatgcctcgcgcctcttcctccgtgagacctcggctcatcaggtagaagagctggtcttcggaaatcttggaaacggtggcttcgtgggccatcgaaacgtcgtcttcgcgaacgtcgacatgcgggtaggtatcggagcgggagaagtcgtcgaccagcagggcatcgcacacggtcgagttggacgaaccgtacgcgcccttgacgattttgaccagaccgcggtaggcggagcggccaccaccacgggaaatggacttggcgacgatggtggagctggtgtgcggggcgaggtgaatcatcttcgcgcccgtgtcctggtactggcccttgccggcgaagccgagggacatggtggatgccttggcgtacggttcggcgaggatgcaggccgggtacttcatggtggccttggaaccgatgttgccgtcgacccattccatcgtgccgccctcgcgcacgtaggcacgctgggtgacgaggttgtagacgttgttcgaccagttctgcacggtggtgtaacgcacgcgggcgtgcttttcgacgatgatctcgacgatggcggcgtgcagcgagtcctcggaccagatcggggcggtgcagccttccacgtagtgcacgtaggagccttcgtccgcgatgatgagcgtgcgctcgaactgacccatggccggggtgttgatgcggaagtacgcctgcaacgggatgtccacatgcacgcccttcggcacgtatacgaacgagccgccggaccatgccgcggtgttgagggcaccgaacttgttgtcttccggaggcacgacggtgccgaagtacttcttgacgagttcagggtattcgcgcacagcggtgtccgtgtcgacgaagatgacgccctgcttcttcaggtcctcctggatggagttgtagatgacctccgactcgtactgggcggccacgccggagacgaggcggttcttctccgcctccgggatgccgagacgatcgtaggtgttgcggatgtcgtcaggcagttcgtcccagcttttcgcctgcttgtcgattggcttgacgtagtacttgaagtcgtctgcgttgaagccggagagatccacaccccaatcgggcatgggcttttcgaggaacgccttgaatccacgcagacgcatgtcgagcatccactgcggctcgcctttgtcggcgctgatcgcgcgtacgacgttctcatcaatgcctcgttttgcggcttcgccggcggcatcagaatcatgccaaccatagttgtagtcgccgaactggctgatgatctcgtcatccttcttgatcttgtcctcgttgacgcgggtacgatcagccacatactggctcatctccacgtcagcggcggcgtttggtgctgtgttttcggtcaccatcctgccttccttgtatcacacttaatcctatgaaaacctagcagaacccaagtgcaaacactagccgccctgacgcatattggctgtgggcttgattacacgaatgcgatacagcgatattggagccgggcaagcttgtcccatgcacaccgaacatcgcgtatgcggcattatgtgtcgcaccactgcatgccgtatttgttacatatcacactgttgcatatcacacttggatatgcacgctcgtgcccatattgcaccagttgtagaaccattcggccacatcccatccgatacccacgcaaccatgagatccgttggcaatggagggcattacggcatccgctacatatccgccggcaatacggtggattgcgcaaccggaggagaagtaattgacgaagcccacgtctttgacatcccatgtttccaccgtgccatcggcaagattcagcgtgccgctcatatcttgactgggcaacttttgccatacgttgaagtcacctgtcggcgtacacatcatgccaacgcattcgccggtgacgttgtcgttgccctccgcgaccacgacattcaatgtcttgaccaccgtgtcattctcataggcatagagcttacggtcggacaggtcaatcgccacgcgatgagcgaccttgacttcctgtttgggatctaccttgccgtccacattcactgagccagttcccgtggccagcacctgagccaagcgagcaccaacctccgtatccgcgccatcggcaatcacaatgccatcatggccttctgtttcagtgctcagcacctcgccagcattattgacgacgaccttcttgtcttcacgttccaatttgagattcggcttgatttgctcgtcatagtattgctgcagcttatcggcatcaaagaccacgtagccattacgtacttcattgtctttcagctttgactgctggttggcgtcgatgcgcatggccgaacccagcatggacgcattcacggtggcgatgtctttatccgccaccttgatggccacggcattgttcactagggtttccagcgtggttttcgcctcatcggcaattgcattggtaatcgtcggttcggttacgtcgagttccacccgaacggtctgtggctggacactgcccaatgactccactgtggaaatggcttgcttcgcaatgctggtggcgttggctccctggccattttctcccgcaataacgttgaagccactgttgttatcgttcaatgcgacttgcgcgtcaacaggttcttgtgcatcaatgttcagcgccttatctaccacactgccatcagcgagctcgggattgatttgcggggccacatcatgcgtaatccagaacgcatactgttgccaccatgcgtcaccgcgttgggcattgatgacatcggatgcgattgcttcaccatcaacttcgatgccgagatctttcagcgtgaacgtcgccgactgcccctggtatttcgctcgtaccgcggtgttgtcgacctggtcgttgattaggtcggcaatctcctgctcggttttgccggtaactgaatttccccatagcgttgtgccaggcagcacgtgatcttggaagaaccaaacaccgccgccacaggcagcccccaaggcaaccagcagacaagcaatcaccacccacggccagatgcggcgcctcctcatctcatcgccctgaatggaatctgatgcagcagcatccacactgtctgccacagtgccgctgacggcattattcgcaccaaacagaggcgcaaactgctgggtcgagtcatcaaggtgttcggtcatggtcggtctttctgcgatggcctactaagcgttatctgcatactaccaacacaccatagaaacggtaatttttttaccgtcgccttccaatacatcatgctgcatgctgctcatacaacaaaaaagacgtggtggcgaaacatcattagatatttcgccaccacgtctttaccgtatgtcttgcactacgccgatgacggcagccagcacatcatgccgcgatattatgcacggcacgaaagtgcgtcagcgcgccgcctgatggtcgagcgcggccttgaccaggccggcgaacagcgggtgcggcttggtcgggcgagacttgaactccgggtgagcctgggtggccacatagaacgggtgcacgtcctgcggcagttccacgaactcggtgagctcgccgtccgggctctggccggagatgcgcaggccgccttcgcgcagacgatccttgtaggccacgttgacttcgtaacggtggcggtgacgctcggtgacatgcgtggtgccgtacagttcggcgaccagcgagccttcctccagctcagccgggtaggagccaagacgcatggtgtggcccatgtcgcccttgccggccacgatgtccttctgctcttccatggtggcgatcaccgggttggcgcaatcgggctcgaactcggaagagttcgcgtcttcaatgcccagcacgtggcgggagtattcgatgaccatggactgcaggcccaggcacaggccgagggcaggcagcttggtttcacgggcgaacttcagagcgccgatcttgccgtcgatgccgcggatgccgaagccgccggggatcacgatgccgtcgacgttgtcgagagcggcggccgcaccttcggtggtttcgcaacgatcggccgcaacccacttgacgttgaccttggcccagttggcaaagccgccggccttgatggcctcggtgacagacaggtaggcgtccggcagatcgatgtacttgccgacgatggcgatgttgacctcgtgcttggggtggtgcacacgctccagcaggtcggcccattcgtcccaatcgacgtcatggaacggcaggccgagctcacgcaccacataggcgtcgaggccctcctcgaacaggatcttcggcacatcgtagatgctcggcgcatccacgcagttgaccacgccttcggcatcgacatcgcacatcagggagatcttgtccttgatggactgattgagcgggcggtcggagcgcagcacaagggcgtccggggaaatgccgagctggcgcagcatcatcacggagtgctgggtgggcttggtcttgagctcgtgggcggcggaaatgtacggcaccagggaaacgtgcacgaacatgcagttgtccgggccgagatcgcggcgcacttcgcgggcggcctcaaggaagggctgggactcgatgtcgccgacggtaccaccgatttcggtgatgatcacatccacgtcatcggaagcctgggcgcgcatacgagacttgatttcgttggtgatgtgcgggataacctgcacgcactggccgaggtattcgccggcgcgctccttgcgcagcacttcctgatagatctgaccggtggtgacgttggccttctggctcaggaagacgtcgaggaaacgctcgtagtggccgatgtcgagatcggtttcggcaccgtcttcggtcacgtagacctcaccatgctggaacgggttcatggtgcccgggtcgacgttgatgtacggatcgagcttttgctgcagaacatggataccgcggctgcgcagcaaacgaccgagcgaagatgcggtcaggcccttgccgagagaggagacaacgccgccagtgacgaaaatatgcttggtgacgtgttcttgagaattaccatgtgttcttctaaccatggaatttcactctatcatccgtgtatgacccggcgtgttcaccagacgtgtcggccccgacatggcgtacttgaacaatacgaatagtaggctcgtcaaaaagcatacgcaaggtcataatcacgtcaaacgtcttatccgccagctattgcaggtattggtcgagacgcactaggcctaacgcatataggacaaacgctgttttcaggtttttcagcgaggcccattcatcggcaccgtgcgcgttgccggcacctggtgcgatgaatggcggggtctccaggtcgatgccgtcgaccgccggcacatggtcggcatggaattcgggaccgaagttgagtgcgcgcgggataaagcgggcgtgggtgccgtcgccgacagccacgggtcgagcctcgcaaccgagcacgtcgttgtaggttgcggtgagcaactggacacgcgggtcgtcagcctgcacgtagtatgggtcatcgttaaggatgtcgacaatgcggccgcccgccgcttcggcttgtgcttgaatacgctcgatgatttgttcgtgtgcctggcctaccgcataacggatgtcgaagtgcaatacgatggcatcttcagaagtctcacctgataccgcgcctaataccttgtctgcttcagcgaactcattcgccggtataatcaaaccaccattggcggtagtcggtccgctttccgcattctcgcaatcgatacccaagccggtgccatatgagtcttttgtccattgggcaatcgcctgtgctgcagtgaggtcacggccttcgagcagaccggaccgggcaagcgccgtagtgagcaccgctatagcgtttacggtaccggacggctggcaggcatgaccggcaacaccggtggcctcaatcgtgacgccttgcgctgttgcgttgatatgcaatcgctcggcgatatctggagcgatgttgccgctctggcagaatgcttgccgcacggtagattcgtcgacgccggtgagggtgattgcggcggccccgggaaccgtgttagtggcggtgccggcatgccaaccgcgcaattgcggcccgaccggcagttcgacatccacatcgagcagtcctttttggatattgttcaccgggaagggaccatcgatgacgatggcctggtacggcgcgccgatgttggcgacgaaccatttgatgtcgttgagcgcgatctcttcggagccgccgaacagtatacgtacgcggtggcggaaacggtggtcgtgttccttgaagaaacggagtaggaaatagctggtcagcgcgacgcctttattgtccaatgagccgcgaccgataacaatatcgccaatagcctgcggatcgaaggcatcgtgcgtccaaccgtcgtcggcggggactacgtcgaggtggtcgacgaaggcgatgtcacggtcggtctccacgttctcctgtggataaacgacttccatgacgtggccggtgtagtcgcgcgtaggcagcccgtctcgtcctgccttggccagcatatggtcgaatacacggcgtacttcgggtccataaggcgcgcccggacgaggattcgggtccgattcgtcggaaaccgacgggtagcgcagcagctcacacagctcatcgacgaactgtgcgcggtgggcgtcaaaccagcgtgacgcggcatcgacgagatcacgttccgtggcggtgagagtcatggcttcctttacttggacgcttatggtttcctcaggtaacaggaatcccgggcgcaacgtcgactgctacccgggattggctggagggcttggttctattcgctcagcaagtgcgccacagcatcgagcgcgagcttgtagccgtagaaacccatgccggtgatggtgccggtggccacagggctgattacggaacgcttgcggaactcgtcgcgggcggacgggttggagatatggacttccataagcggcaggttctcgtcaatgaccatgtgcgcggcgtcggcgagagcatacgaatagtgcgtgaaggcggcggggttcatgaccaccggggttttctcgtcggcggcttggtgcatccagtgcaccatttcggcttcgtcgtcggtctggcgcacctcgacttcgaggccgaggtccttgccccattcggcgcagagcttgcgcagggtgtcgaggtcctgacgaccgtagacgtcgggctggcggacgccgagacgtccgaggttagggccattgacaacgatgactttggtcattgggactccttttgtttgtgcttctctccctccaccccttcggggcacctccctcatcagagggaggtagaaggtagatccgactccggggcacctccgttagaggggagccaagtacttttttctgaggggatggcgaacggcacggcctacggccgttcaattactgctggatacgacggaatgcttcttctacggcttcggcgggcgggttgtcgaggtgtacgacgtgaccaatctcgtcgaggaccacgaagcgcagttcgttgccacgggctttcttgtcgcgatgcatcaatgcgagcacgtcgtcgaacgagccgccattccacgacgtcggcagacccagcgaagcgagcaacgagcggtgatagtcaaccagatcctgatcgatgtaaccgatcagatgggccagctcggcggcatacaccataccgacggccaccgcattgccatgcctccagcggaagtgctcgagcctttcgatggcatggcccatcgtgtgcccgtagttgaggaattcacgcagccccttctccttcaaatcggaggagacgtggtaggccttgacctttaccgtgcgctcaatgagctcggcaaccacgtcttcgagcggcgagccgaggaatgtagagccgtcgaaagcgcgcagttcagctgcgtggtcttcgaggatatgcaggatttcggggtcgcggatgaaaccggatttggcgacttcgccgagaccctcgatgaagatgtcattgggcagcgtagccagcgtcttggtgtcggccagcacaccggcaggcgtgtagaacgagccgacgaggttcttgccctgcggggtgttgatgccggttttgccaccggtggaggcatcgaccatggccagcagcgaggtcgggcagtttacatagcgcacgccgcgcatccacgtggcagccacgaaaccggccaaatcggttgcggcaccgccgccaagccccaccacggcatcggaccgggtgaaaccttcgtcgccaaggcgttcccaaatgccgttggccacggtaatggtcttgccgggttcggcatccggaatcacgatgtcggaaacctcatagccgccctgacgcaacagggcgcgggcacgatcggagtgtcgctgcaccggctgagtgtggataagcgcgattttggcgggtttgggtcccagcacgtcgaccagatggttcatggcaccttcgccaatgaccacatcatacggctcaattgccgctccggtaacatgcactgctcgctcagataccatatcaatcactttcttcgctgcgccctgaggcgtaagcccccgggtatggacatgaacgttggcgacctcgcggaatactgggtcacgctgcttgaacagttttttccaacgggagttggcgttgccattgagcatgggccggcctcccccacggttcgcgcgttccatggcttccgccggatcggcatcaaggtagaccacacgaccgccatggtcgatgtaggaggcgagggcatgctgggtggatggcgtcatgggagcgccaccgcccagcgaaaagataccgtcgaaatcctcaagcatatcggcgatgagatcggcctcgacctcgcggaatgccggctcaccgtattcctcgaagtaggagggaatcttcatgcccacttcacgttcgatctccacatcggcatcggcgaacggcagacgcaacatatgcgccacttccttaccgacacgtgttttgccggctcccatcatgccgatgatgacggcgcgggggcgtgcggtcataatctacgaatcctctcgacgattggtgggtacagttgctgatggttccgcggcagtcgtcacgaaaccatacgcccttcgttcagcgcatgtgctccggccacgaggcgagatacgactcaaggttgcgccgtgtttcggcaacactgtctccaccgaacttatccagcgcgtacttcgccaaagtcagacgcaccatggcctcggccaccacggatgccgcaggcacggcggtgctgtcggaacgctggttgatggcttgtgcggattcgccggtcagcacgtcgaccgtacgcagggccttggggatggacggaatcggcttcatggcaccgcgtacgcgaatcacctggccattggacataccgccttcaatgccgcctgcgcggttggacagacggtcgatgcggccgtcggcgttgaccacgatctcatcatgcgcctgcgaaccggggcgggaggcttccaggaagccgtcgccgatctccacacccttgaacgcctgaatgcccatgatcgcggaggccagagccgcgtccagtcgacggtcggactccacatacgtgccgatgccggcaggcacaccgtaagccagcacttcaatcacgccgcccaacgtatcggaggcattcttggcctcgttgatgcgttcgatgatgcgggcttcggcctctttgtccagcgtacggacaggcgaggcgtcaagcgcttccagatcgtcaggtgtgggcaacggcaaatcagggttggtctgcacgccaccgagcgccaccacgtgggctacggtgcggatgccgaacgcctgatccaggaactgcttggccacctcgcccaaggccacacgggaggcggtctcacgggcgctggagcgctccagtaccgggcgggcgtcgtcaaaaccatacttgcgcatgccggtcagatcggcgtggcccgggcgcgggcggctcagcggcgcattgcggccttcgcgcggcaggtcatggtcgagtgcatcggcgctcatgacctcggtccacttcggccattcggtgttggcgatttcgatggccaccggcgagccgagggtcaggccgtggcgtacaccggtcagcagacggaccttgtcttgctcgaacttcatgcgggcaccgcgaccgtatccaagtcgacggcgtgccagtgcggaaacgatatcgtccgtgctaatacgcacgccggccggcaacccttcaatcatggccaccaatgcttctccgtgcgactcccctgccgtctgccaacgcagcataacttccctcgtttcatgtgtgtacgcctatgtgtacgtctaactaggggttaatgttaagccatgccatacctgttcacgctacccggtctgctatgtgggcttgcgctgtccattgaggatgttcgtcaccggcgggtgccgatcgcgtgggtggctgcgggcgcgttgcttcagctggccgccgatttcgcgtatggagtggtgatgaacgacctgttcgtgctgttgcaggcgctgttgttcaccgtgctatgttgcctgatccagttcgcgttggcattgctggtgccgcggtcattgggattcggcgatgtgaccgccttgatacctatgggattgtctgtcggactgtttggcctgttgcctgtggtggtctggtggctggcgatgggcgttgccggcatcacatggattgccttgtggacgcgattcgatccacaacgcacatcaccgacacatgcgggcaaggtgccgtatgtgccggtgatattggcgggcgcgattgtggcggtggctgttggggtgttgtcctagatttcttccatccgcttcgcgggagccccgggcttaagttgagcgttacattccctgcagtgctcccctcagtccgcttttttgcggacagctcccctcggcgagggagccaatgaagagaccaacgtccgatcagcttccccaagcgaaggaagctaacgggatgactactggttttcggcttgccacttgcgtagttcggccacgttctggtcatgttcatcggcggttgcggcgaacttggtttcgccggtgtccagattgaccgtgcagaagtacagccaattgccgctttcggggtgcagtgccgcttgaatggcgttatcgccgggattgctgatcggcgtaggcggcagaccggagatcttgtacgtgttgtacgggttggactcgtcttgggtcatctcggtggtcacctgcgcgggcttgacgttattgccataggccacggtggaatccatgcccaacgacatgccctgctccaaacggttctcgatgactcgcgtcactttgccgtagtaatcggctttgttgacctcggcctcggcgatagaggcgatgatcatcacccgttcgcggtcaccgccggccggcacgcccaattcatccaacttggcgatacgcttatcgaccatggccttgaggatttccgaagcgctcttcatgctcttgacgttgtaggttcccggctccagccatccttcaaagctaccgcccgcttcattgggcagaatatccttaccctcgttcttgataatcgtgtcgaattcgctttgggcaatgccggaaagcttcgcggcgttggcgaacacatcggtggcacgttcaccgggacgaacctcgaggaagcccgccgcctggttggtgtcggagagaacgtcgatcactttggatgcggccatatgcttcttcaatgtgaacgttcccggatagagtgtcgtgctattggcgttgaccacgctggtgaacgcggcagtagacttgatgacttcggccttgagcagattatcggcgatctccgccgcgccttggccctcgctcacggtgaattcgacctcgccatagcccggtcccggatagtccgcgatggccgtcgactggttgctccgactgtcacgccatgcgatgagcttggttacgccgaaatagccgccgccgataagcagggcgacgatgacgatagcgatgataatgccactgatacgcttgcgcctgcgctgtgcacgtcgcttgcgcatctccctgcgggatttcggcggttctggcggctcggccccgcgcattggttctgacccctgttcgacccaatgcgtgttgtcatcaaagaactcgttaaaatcatcggtcataaccgatacctcactgctcccgggtacggtcgagtgccgtctgcaaaatcaccactgccgactgctggtcaaccaccggcctgtgcttgttcgaagctttatgggcctcgaacagctgacgatgcgcactgactgttgtcaatctctcatctatcaatgatacctgcggaatctgatactccgtagaatcactgtcttcactctctgcttgcagcctcttctccagattggccgcccacctgcgcgcttttttggcgcttttgccttctgtaccgtccatctgcaggggcagtccgacgattacatggtccacatgttcgtcttcgatgacgttcaggacctcgtcaatagcaaagaaatagtcgccggcaacatgaatgttgccagcaggatgtgcaaaggtaagctccgggtcggacagtgccagtccgacccgggcattacccaaatcaacgcctaaccacaccactggcggaatcaggctttctgcgcctcgtgcttgagcgcttcgagggcctcgtcgatcttggaggcatcgacaccgccaccctgggcgaagtccgacttgccgccgccaccgccgccgaggaccttggctgcgccacgcaccagatcaccggccttgatgccggccttgcgggcggcctcgttggtggccacggcgaccatcggcttgtcatcctcgttcacgccggcaagggccaccaccacgggggcgtcttcaccgagctgggcgcgcacgtcgagtacggtcttgcgcagggcatcgaccgcgccaaagtggcccacgttcttgacggccaccttgaccggggccgcggagttcttggtgtcagcaaccagcgccggaaccgaggcggccagctgggactcgtacatggaggccaagcgacgatcggattccttgagcttggcgagcagggcgttcacacgctcggcgagctcgtccggacgagcgttgagcttgtcggacagctgggagaccagcgcgtgctcacgagcgttgaagtcataggcaccctggcccacgacggcgtcgacacgacgcacgccggagccgatggaggcttcggacaggatgttgaccatgccgatcttgccaacgtggtccacgtgggtaccaccacacagctcgcggctccagccgtcttcgccgatggagaccacgcgtacgatgtcgccgtacttctcgccgaacaggtgcatggcaccgagggcgatggcgtcgtcgaacttcatttccttggtggtcacggcgaggttgtcgcgcagcttgtcgttgacgcgctcctcgactgcggagatcacggacttggccggggccttggaccactggaagtcgaagcgcagacggttcggggcgtcttcggagccgcgctgggtggcctgcgggcccagctcctcacgcagcgccttgtgcaccatgtgcgtggcggtgtgcgagcgggcgatggcgccacggcgggccaggtcgatgttggcgttgacttcggcgccgacgaccagcgtgccttcggtcagacggcactggtggacgatgaggtccttgatgggcttctgcacatcgtcgacttcgagcacggcgccgtcgtcggacaggatctcgccctggtcggcgagctggccgccggcctccgcgtagaacggggtgcggtcgaggatgacctcgacgttggccgggccggtcacggcgggcacggaacccttgccttcctgcatgatgccgatcaccttggcgcgggcggacatgtcggtgtagccgaggaagtcgatcgggctgacgagcgtcttcttgaagtcgtcgtaaacggaaagatccacgttgtgacgcttcttgagggcgtcggcgcgggcgcgggacttctgctcggccatgagttcacggaacttggcctcgtccaccttcacgccctgttcggcggccatctcgagggtcagctcaatcgggaagccgtaggtgtcgtgcagcttgaaggcgtcctcgccggccacgacgggctcggcggaatcgctcttggccttgttgacggccacgtcgagaatcgtggtgccggtctcaagggtgcggcggaaggcgtcttcctcgccatacgcggattcggacacctcatggaaggtgtcgttgagctccgggtagctggcctccatggcggccttggaggtcgggaagagggtgggcagcaccggatcggtcacgccgagcatgcgcatggagcgcacggtgcggcgcagcaggcggcgcagcacgtagccacggcccacgttggacgggcgcacgccgtcggacatgatcatcagggcggagcgcacgtggtcagcgaccacgcggaagcgcacgtcggcgtcctcgttctcgccgtacttcaggccggagagctgctcggcggcctcgatgaccgggaagacctcatcggtctcgtagatgttgttcttgccctgcagcaggtaggccagacgttccaagccggcaccggtatcgatgttcttgttctcaagctcgcccacgatgtgcaggtcggtcttggacttgacgttgtcgacctcgtagttctcgaacacgaggtcccagatctcgatgtagcggttctcgtcggcaatcgggccgccttccttgccgaaggcggggccgcggtccacgtagatttcggagcaggggccgccgggtccggggccaccggtggtccaaaagttgtcttccatgcccatcttctggatgtgctcggggtccacgccctcgttgatccacatggaacgggcttcgtcatcgtcggtgaacgtggtcatccacagcttctcggggtcgaagccgtagccgccctcatcctgcgaggtggtgagcagctcccaggcgtagtggatggcctcttccttgaagtagtcgccgaaggagaagttgccgagcatctggaagaaggtgccgtggcgggtggtcttgccgacctcgtcgatgtcgagcgtacgcacgcacttctggttggaggccatgcggcgcttcggcggggtctgctcacccatcaggtacgggatgaacggcaccatgccggcgatggtgaaaagcgtggtggggttcggggaaatcagggatgccgagggcacgatgagatggtcgtgcttggcaaaataatcgaggtatcgctttgcgatgtccgcagtgcgcatgagcggatgaactccttgtttgggtaatgggcgcagttgcgcctggtattggtggaaaagactggattatgaggattagtttgttctagctgattcagtgactagatggcaaggcggcatgcgcgtgtcagttggcgcgctcgatgtactgacggttgagctcagcctcgcgggctcgacgggtggcattgaactcgttgaccaacccttcgagtgttttcatcggcacattgtcctgatcggggccaagcaggaactggcgtgccgcatcaggcgtattggccttgacataggcctgtgccttggtgacggcaacgattccgatggccacgccgacgccgacccagaagatgcgtttgaacatcactcccccttctcggcggtgtcgttgacggtggttttcgcggcgttcttcgcaaggaaggactgacccgtggttttcagcgcgtagaaggtggaagcgatcttgatgatgggcttaccgaggaaggagccatacagatcggtcaacgcaccaacgttgttggcggtggtggaagccgcggcggaaatcttgttcacgtcttcgagcgacttgttgacctgcttgacggtggtcacgccttcgtccagcgcggggatggcgtgttcaccggactcccggaccgtctgcgatatctgatcaaacatcttgcccagcctgatcagcggatagatcatgaaaccggccaatactgcgaacgcgatggccgcgatcaggccagcgatctctccgactcccattgtttcctccttgcggtcacacttactcgcctaagggtagcactccttccctatttcttggcataccattgcatgcgcagggcgaaaaccgtgcgcgtgggcgtatgcggctataggcgaaaggctgtcctgctgacgctttcgtttgcggcgtgccgccgtggaccgtacgtgctattcgatatgtattgcttgctatttgctacttgccgtacgaaacgatggtcacggcttcgccgaacggcttgtcggtgtcgaagtcgatcacggttaccgaaccattggccgggcgttcgttcagatcgaggtcagggccgccgaaccggtgaccgaggctaagcagtgtgttgccatgcgaaatctgcagcacatcgtcgccgtccttgagattcgggttgtcggcgataagacggaacgcaccttcgacgcgcgtccaatattcctcatcggattccgcgtcgtggaagggatcggcttccttgagaaaatcacgcgaggcccccaacccgaacttctcgacgatttggttgtaggttttgacgccgtggggcgctcccgcggcgtaccaggccatggccatgtcaagtccctcgtagtagccgtagaactgctcgcggaagtgcatgtccgtcacgagtgcggggcgcgggttacccgcggcttcgttgatgtcgagaattttctcggccgtctgctgggcacgcgtggtgtccgaacagtaggcggcggcgaacgtcaatcctttcagtcgctcaccggccttgacggcatcggcgacgcccgactcggtcagcggcgaattcgaccatccctgcagacggttgtatcggttgaaataggtctgtccgtgacggaccagatgcagatgaagaatcatggttctgattatgtcaccattccggcggtttcggtgcgggttgccggaagtcataagtcataacggcataggtcactacctgagatatgcgtaatccgggcagtatacctaacgattcctgagagtacacttagaatactgtgagcataaccttgaaacctgcaccatctcgatcgtctgtgcctgcccatttcaggggtatcgatggactgcgcgctctggcgattcttggagtcatagcattccacacccgcccgtcgctattgcagggcggattcattggcgtgacgatgtttttcgttatcaccggttttcttgccacacgttcggtactgaacatggtggaccgcaccgggtcctttggatatggccgatatctgatccgccgcattactcgtttatggccggtgatgctggcgaccattgccgtggtgccttggctcacttggatgttcgctcccagcctgttgcagaaagtggtttccgattcgctgccgagcgccttgttcgccagcaattgggtgtacatcttccgcaaggtgccgtatttcgaggcggccggattgccttctcctctgacccatctgtggttcttgggcgtgacgatgcagttctatctggtttggccgttgctgatggtggtgctcggcaaaatcaccaagtccaaatgggtgcgctccatggcgattcttgtcatcatggctgcttccaccgccgacatggtgctgctgtttgacccggccaatacctcccgcgtgtattacggtaccgatactcgcctcgccgagctggccgccggcgcgctgttggctatctggattgcgccttcctcgcgaggtacggaagctgcggaagctggagcggcttcgcaaacagtgcagatcgaacgtcaggccggcgacaagacgggcgcccgtctcactatcgtctgcaatgttcttggcaccgcggctttggcggcactgctgaccggattctggttcgccaacgggtatctgtcgtacatgtaccaaggcgggtacctgattaccgcgttcatatcgttgtgcgccttggcctgtgccgtgaacaatgactcaatctggtcgcacgtgctgggttgtgctcccctacgctatatcgggtcgcgatcgttctcgctgtacgtcatgcattatccgctgctgcagttcatgaacccggcgacacgaacgcaggcgttgccgtggtggggttgggttcttgaggccgtcgtggtgttggcggcgtcggaagccttctaccagctggtcgaggcggcccgtaaatcggtgcagatgcctcgtagccaacacgccaagccgctgccgaaagccggctaccggctgcgcccgggcgcgtgggtcatgtcggttatcggattggtgaccgttgtggcgctgacgtgggcaccggtggactggaatggcatcgctcaagcgcgagccattcagctgcgccccgaactcgcggcacccgccaagccggtcaagaaaccggcgaagcccgagcccgagtcttctgccataaatgccgcgaacggcgaaaccaataccgctgacgcgaataagaacggttcggattctcagccgcccatcatcaaaccgattgcggaaaaggtgccaaacaatcttgacatttcgaagtacgcctatgatccggcaacggaaagctgcaacgcggatatgatgatggtcggcgattcagtgacgtcgggtacttcggacgccatccaggccgcattcccgaacgcttttatcgatggcctgccgaaccgtcagctgccgcaggcggtggatgtgtatcagcaggacaccgctgccggccacagtggcagtgtggtggtgtttggcctcggcacgaacggcgtgatttcgaatgagcaggaagtgcaacagctcattgacctgaccggcggcaagccgacatacttcatcaccatccgtatgccatacccgtggcaggagaacaacaacaatacgatgctgcgtgaggccgccaagaagaacaagaacgtgggcatcatcgattggcatgggtatagcgaaggtcatagcgaatacctcaacgatgacggcattcatccgaatatgaccggtgcctatgcgtacgcgacgatgattcgccaggcggtgtgcggccagtaatcgccctacaacgcaggaaccccgcggcttctcgaaagaagcgcggggttcgagcggtatgtcctggatttgttgaccagagggcccggatcagcgggcgtagaattcgaccacgtactggatgttgacctgcaccgggatctcttcgacctccggcttacgggtcacagtggccttcagggacggcaggttcacgtcgaggtagccggggaccgcaggcagcacgtcacggtgcacgccttcggcggcgatctggaacggaaccatggtctggctcttggccttcacctgaatggtctggccgggcttgacgcggtaggacgggcggtccacgatgttgccgtcaacgaggatgtgacggtgcaccacgaactgacgggcctgggcggtggtgcgggcgaagccggcacgcagcaccaggttgtcgagacgggtctcgaggtcggtcagcatggcgttaccggtctggccggcagtacgggtggccttctcgtaagcggcgcgaagctgcttctcggagatgccgtactgagcgcgcagacgctgcttttcgcgcatacgcaccgcgtaatcggactcggtgcggcggcggtcacggccgtgctcgccaggagcgtacggacgcttttcgaagatgcgctgagccttgggggtcagtgcgatgccgagggcgcgagacagacgcacctgacggcgagaacgctgaacgttcgtcattggattaatccttctgtcgttatctgaacggaacgcttgccttgcatatgcctaacaagcgctgagtcgggcctccccagcgcttcgtcgtgaataaacacgaacgggttggttttcttgcgattacctaccgccgacccgctgatgggctatgactccagacggtatctacctgttggcagacaccagcagaccatattacaccgaggctatggacagcactccggcgtccatgcgatacacccgatctgcgtattcgagtgcatcgggatcatgggtgaccatgagaatcgccgtgccgttgttggcttggtctctgagcagacgcattacgatgtcggtgctctcttggtcgaggtcgccggtcggctcgtcggcgatgagcaagctcggctggttcatcagcgcgcgggcgatggagacgcgccgcatttcaccgccggacagctcgcgcgggtagctgtctgccagatcggcaacaccaagctgggtgaacagcgtgcgagctcgggtggcgaacaggtccgaacggctcgcagccgtgtttgacggcgtgttttcctggtctgtgattggcgcaatgacatccggcatgaacgggtcggcggctgaatcggcggccgcttcatcattggtggcagcggcttgcgccacggcatccgttgcttctgcgttttgggcgaacggcagcggctccggaaacatcgttgcgggcagaatcacgttgtcgagcacggtcaggttgccgagcagggtctggctttgagtcacgaatccgatggtgcgattcctcagcacggacagtgctttatcgcccaagtcggccacattgcgtccagccacgctcacggttcccgaggtcgggcgaatcagcccagcgaccatgttgatcaacgtacttttaccgttgcccgaccggccgacgatggcgatgaattcgccggcatcgacggtgaggttcacgtggctgacggcgtcgaacggcgtgccgcggcggacgaactggcgggtcaggtccgtcaaggtcagcagatggtccggggagggcgtctcggttacgtgcggcgaatccggcgcagtcggcgcgttcggctgagctggcgtggtcggctggagcttggtcggctcaaccgtggtcggctgaagcggcgtagttgtctcagtcatatcactccccctctcgcagggtcaggtaggcttcgggccggccgagacgccacatggtggccagcgaaccgatgatgccgatgaccgtagagcacacaatggtcacggcaatgaatccgatcaccgcaaccgggctggcttgcagatacggcaattgaagctgtttgccgatcagcgaactgaatgggaaaatcaccaggctggccgcgccgacgccgattacgccaccgatcagaccgatgatggcggattccttcagaatgatggcattcaacatgccgcgcgtggcgcccatgatgcgcagggacgcgaattcgcgtttgcgttcgttcaccgacgaggcgaatacggcgagcagcacaatcacgcccattacccagatcaccgccacgaaaatcttgaggtaggtgacaagcgcggtcagcgaagttctggtgttggcggtgatgccgccggggtatacgtaccccaaatcggcgaatcgggaatcaagacgcttgatgttctcagctacggtctgcgcttcgtacccctgctgcgtcttaatcatcacggtggagacggctttgccggcatattcggcggacatgacctgcttggagaccttggccgaggcggcgaccatgtcgggcacggtgttttggttgatgaacaccgagttgtcgaggctggtgccggtgttggcgagctgggcgacgaccggccatgaacggccgtagagttcgatggtgccgtcggtggacacgttgacgtttgcgcctgcaatcatctgaccgtcttcaagggggccttcgaactgggaggcgacccatggttcgatgacgaagtcagtgtccgggtcgtaaccgatgatctgcagcttttcggcacagcaggcggcggccagcgatgatatataggtctgttcggtggcctgtgcgatgccgtcggcctgcatgacctcgtcggcgatgtctttggtgaaatagaaagtgctgggattgccgttggtgagcagcgcttcggccttctgcacggtgttttgcggcacgaccatgaggtcggcgcccaggcgcttttccatactggtcatgccagtgttgaggttcatggtcagcatggtgccgccgaagaatgtcagcgcgaggatggtgacgacggcgagcagtgcgccggtgcggaacggcttgcgtttgaggttttcaatcggaaggccgcgcaatgcgatatgggatggcacgatgaatccttatgttgcttatagtgcggttgcaataagcgaggccggagtccagcgttcggaatggctgggctccggccgtctgctcgatcagttgcgcttggcggcgcgagagtcgagccagatggcgatggccgcgaacacgatggtgagcacgccgagcacgatgagcgtgggcagcataaccatgcgacagtgcatcatcgcgcccttgcagatgccgatcagaaaggtgggtacggcgagtagtagcagggcgtcggctgcggcggcgatattgaggccgatgcgaatctgcggggcgacgaacaaagccacgacgccgaacacgaggatgacgacgccgatgccggtggccgcctgctgcgagtagtggcaggcacccggcatgtcatggccggtgcaggcgtgcgcaaaggtctggggcgcgatggtgatcagcgcgccgaacagaatattgggcacggatgcaaacagcttgttcttcataactactttttcctctcccctgttcccagggctcgtaggcacaacctccgcattatgcccacactgtgatgaagaacacaagtcttgttttttgcgaatttatttggtatataactcagcccctcgtcagaggggccaatttatctacaacttctcaatcggcgctacgcggagcatgaggcgtttgacgccggcggagccgaagtccacggtgattaccgaattgcggcccttgtcttgtgcgtcggtgaccttgccgagaccgtactggtcgtggctgatcatgtcgcccacggcgaagtcggcgatattcaggccattgtccttggtgagcttcgagctaggcacggcagagccggtcgaatcggatttcggtgcggtacgacgcgtggtgactttgccgccacgggtgccaccatatgaaccggacgaagaaccggaacgggaacgcgacccgtaggacgacctcgaaccggagcctgaagaaccataggacgaacccgaacgggagcgggaaccataggaggacgagccggagcgggaaccatacgacgatgaacgggaaccatacgacgaagagccggaacccgagccatacgacgacccataccgcgaccgcgacccataggacgaacccgaaccggacgaaccacgcgagccgaacgtcgacgacccgccaaacgcggcgccgccaaaatcgtcatcatcccagccgcccaaatcgtcggcgaatccatcggtctcccagctggcgcgcatacgctccacgccggcttcacggcgtttccaatcaatcagcgaatccggaatctcgtcgaggaactggctgggcatcatatcggcggcctggccccactgggagcggacggcggcgcgcgtgacatacagtcgctgcttggcgcgcgtgatgcccacataggcgagtcggcgttcctcctgcagttcagtggtgtcttccatcgaacgcgaatgcgggaaggtgccctgttccatgccggtcaggaacaccaccgggtattcgaggcccttggcggtgtgcaaggtcataagcgtcaccttgccggagtcctccgcctcgccgggtagttggtcggagtcggccacaagcgcggtggtctccaggaatgcggacaacgtggcgtcaggcgtgttctgttcgaattcggcggcagtggactgcagctgggagaggttctccagacgggaggcgtcctgcgggtccacggatttctcgagttcggcccttaagcccgacttctccaatacttcggccacgatctcgctgggcttggagtcgtgcgcgcgcgtgaactgcgagagcgcgcccatcagatcgcggaatgctcgtagcgaggtggcggtgcgtgtcggcacctcgatctcatccaagtgcatgagtgcgtagaagaagctggtgccatgctcgcgcgcgtaggcgagcagcacgccttcggcgcggtcgccaagcccacgcttgggcacgttgagaatacggcgtagattcacatcgtcgtccggattgacgagcgcctgcaaataggccagcgcatccttgatttcgcgacgttcgtagaacttggtgccgccgacgagctgatacggctgattcgtgttgatcagcgcctcttcgagcgagcgggattgggcgttggcgcggtacatgatcgccatgtcggagtaggcgatgcccgcttcggcgtgcaggcgcgcgatttcggtggccacccactgggcctcctgctgggcgttgtccgccgcgtagccgacgatcggctcgcccttgccgagcgcggtccacagtttcttgggcttgcggccctcgttgttgctgatcaccgcgttggccgcatccagaatggtctgcgtcgaacgatagttctgttcgagcatgatggtcttggcgttcgggaagtcctgctcgaagtcctgaatgttgcggatgtcggcaccacggaacgcgtagatggactggtcggaatcgcccaccacggtgatccaggcggggccggacttgccggcgttaggcgcgcccgggatggccttctcccccgtgtccacgccggccagctcgcgcacgagcacgtactgggcgtggttggtgtcctgatactcgtcgaccagaatgtaacggaagcggtgatggtagtactcggcgacggccgggtcagtgcgcagcaactcgaccgtgcggccgatcagatcgtcgaagtcgacggcgttggccagggccaagcgatgctcgtattcggcgtagatcaccgcgtagatggcttcaaggtcgcccaccgtgccgaactggtagccgcgctggccgggcgtgaagtcgggcgcgtgaacggcgaggttttccttccaaccggtcagattgttcttgaggtcggagatatggccgagaatcgagcgtggagtgtagcgcttgatgtcgaggttgaattcggtggcgatgattttgacgagtcgctcggagtcggcggaatcgtagatggagaagccggacttgagtccgatggacttgccgtcgcgcctcagaatgcgcacgcaggcggagtggaaggtggagacccacatgcgctgggccaccgggccgatcagcgagccgagtctttcgcgcatttcggcggcggccttgttggtgaaggtgatggctagaatctggctcggccatgcgccgaactggctcaagatccaggcgatgcggcgggtcagcacgcgggttttgccggagcctgcaccggctccgatcagcagcgcctgaccgcggtattgcacggcttccgcctgctgcgggttcaggtcgcccacgagttcctgtgcgctgcgtgcgatgacttccggctcgtcgtacactgttgcctccctttgaatcgcgacattcatgtttaccacatgcacgggtcagcgcaggacaacgtacacttacgagtatccatatcattcactgacatacaacaatgggaggttcaatgcaggaacttgaggagcgaatccaaagcgagggaacggtgaaggcgggtaatgtgctcaaggtggacgcgtttctgaaccaccagtgcgacgtacgcctgttcgaccgcatgggttcggcatgggccgctcatttcgccggcaagcacatcaccaagattctgaccatcgaggcgtccggcatcggcattgcgtgtgtggcggcccagcatttcggcaatgtgccggtggtgttcgccaagaaggcgcagtccatcaaccttgacggcgaccagtacaccaccacggtctattccttcaccaagcagaaggagttcccggtgatcgtggccaagaagtatctgaacgccggcgaccatgtgctgcttattgacgattttctggccaacggcaaggcgttgcgcggtctgatcgatctgtgcgaagcagccggtgccacggtcgagggcattggcatcgccgtggagaagggcttccagggcggcggtgacgcgctgcgcgctgaaggctacgatgtggattcgctggccatcgtcgagtccatgaatcccgagaccggcgaaatcacatttaggcactgagcacattggctgctcccgccggcgggagcaacagagagaagaagagaatcatgtcagagaagaaaaccaatcattccgtatcctttgaggcgttgtcttcgctggacgcgccagtatccttctggaagggcattccgttcggcctgcagcatgtgatggccatgttcgtggcgaacctcgccccgatcttcatcgtcgcctcggccgcgaagatgaccccggcccaatcggccaccatcatccagtccggcctgctggttgcgggcctgggcacttgcctgcaactgtacggcgcgtggctcatcggctcgcgacttccgatggtcaccggcatctccttcacctacgtggcggccgccgtggcgatctgcgcggacaagggctatggcgcggtggtcggcgcggtaatggtcggcggtctgctggaacttgtgctgggtttgacggccaagtattggcgtcggttcgtgccgcccatcgtctccgccatcgtggtcacgtcgatcggcttctcgctgctcaacgtgggtgccacgagcttcggcggcggcagcggagccaaggacttcggttcctggcagaacctgacgctcgggcttatatctttggttgcctgcctggcgttccagctgttgatgaagggcacggccaagcagctgtccgtgctgttcggtctggtggtcggctatgtggcggctatctgcatgggcaaggtcgatttctccggtttccagaacctcgccatcgtgtccgtgccgcagttcatgccgttcaagcctgagttcgactggggctcgatcatctccatcggcctgctctacgtcgtctcctcggtcgaggtgctgggtgacaccgccgcgctgaccaaggtgggcctgaaccgtacgcccaccgaacgcgagaccgcgggcgccatcgccggcgacggcctgatctccaccgtatccggcctgttcggctgtctgccgctgacctcgttcgcacagaacatcggattggtggccatgaccaaggtcgtcaaccgcaaggtgattctctccggcggactgattctggtgctggcgagcttcgtgccggccatcgccgaggtgttcaactcgctgccgcaggcggtgctcggcggctgcacgatcatgatgttcggcaacatcattctttcgggcttccagatgattgccgaggcgggcttcacgcagcgcaacatcacgattgcggcgctttcgctgaccatcggcatcggcttcacccaggtgagcgacatcttcacgcagttcccggcactgttccaacaaatcttcgcctcgaactgcatcgccgtggcgttcgtggtggccgtgatcctgaacaccgtgctgcccagcgaggagcacttcctctctgcgcccaaggaggcaccggccgcggacgccgagtgataacaacgcaacatatcagctgcgcataatcacatgatgatgccctatcgtcttgcaggatgatagggcatcattgattttgggagagactacaagttgaaccatgagttcgagccggtggcgtgtcgatcaatcgtcatcttcccattcgaggatgtctccgggttggcagtcgagtgccttgcagatggcgtccaacgtggtgaagcggacggctttggcacgtccgttcttcagaatggacacgttggcgggagtgatgccaatttgttcggcgagctcgccgacgccaatcttgcgtttggccatcatgacgtcgagattgatgcgaatcgtcatctcaaatcacctgctcgagttcgcgcccgagccggacaaggagaacagtttccatacggccacgaacgccgcttcgatgcagaacaggaacagcacgcccataatgagatatggccagcgcatcgacgtctggctcgggtagaggccggccagcgcgccgctcaatcccggtacggcgaatagttggccccataggcaggccagccagaccagaatcacgatggctttcaacgcgagcaacacccatcggttcatgtagtttttcatagcccggtcctttcaggtgccgacgtttttttggcgacaccgcgaacatcgatatgactatatcgaaaaacgatataccttgcaaggcgtattgcgtcaaccggcattggtcgctcgtatacatataggcttcggcagactgtcagcagaccgtcagctcaacggagtgaacgccatatgagccacccattcgcgcacgagcgtgatgacggcttcgggttggtcgatgtgcgcgttgtgaccggcattgtccagcgtcacgaaggtggcgttgggatagtgcggcaacagggcttgctgatcttcgtatccgacgatctggtcttgcttgccggtgacgatgagcaccggacccgcatatgtgccgagcatttcctcgggattatcggccagccaatagcgctgatccagtcgttcgtatgccgcacggtcgcacaacgccacgccgggcaggatgaaccgttggtagcgtcgccacgcgtcgaatgactggttgacgcccatggtaatgaaatcgaacacctgttcctgcggcaaggagtgcgtcagcttgggattgggctgtgcaaccacatgttcggccacatgccggccggcatgctgcgggtccacgaccggcgcgatcaatgccataccggccactcggcgaggttcgcgcgccaatacttcgcggacaagcgcaccgcccatcgagttgccgaccatggcgaatggagccgctttaccgacaagaccgtcaatggccgtttgcagccaatccgccatttccggcagcccgcaggcatgctcgggcaatgccggcgtacggccgaaaccgggcagatccagatatatacggcgaattgaatcattgccgtcaaacgccttgtcgagcatcatcagcgaacgatggtccacacccatgccatgcacgaacacgacgggcaatccatcatcattgccctcaatcgcgcagtacggctgcaattgcgccatgtgttcctctccttcaacccggtacaaatcgcctttcacacaatagcggcagcagctcccttggtgtcggagcaatcccgaccgccattctcggtttcgaggggctgatttgcgcggatgtcatgaagcgtgaagacttgtcacaaagtcgcgtgatgacgcagccgccgttcaggtggatatgccacgctgtcatgatgacggccgagccggaacacggcaaatcccgcatgctgcataggccagccggtcacggtcagccatgacaccgaaatattggaggcgcaatgggacaacaggtgcggtacggcagacgccgctcccatggcgcgggcgcgctgattgcagccgtcatacttgttgttgcggcgctgatcgcggcatggacgctgctgccacggctattcacgcctcgcgagaccgcgcgcacggccgaggaagcatattgcgcggcggtgtcgtccgacggagcccgccgcaccttgacgcctgatcaggcgcagaacgcggcgctgattgcgaacatcgccgtcacgcgcggactgccggatcacgcggcgacggtggccatcgccacggccatgcaggagtcgaggctgacgaatctggactacggcgacttggattcgctcggcctgttccaacagcggcccagccaaggctggggcacggcggagcaggtgtccgacatgacctatgcgacaaacatcttctacgatcatctgctgcaggtgccggattgggagacgattccggtggaggacgccgcgcaggaggtgcagcgctcaggctacccggaactatatgccgcatgggatgcgatggcacgcgcttgggcctcggggctgaccggtgaacggtcggcgggcgtcacgtgcgcgttggagccagcaacctcctcggacgcggacgggttggttgccgccataggaggtacactgccgaatgtcaatgtctcggttgtgcccccaaatggcaaaaccggcacgaacaacggcgctgcgaccaatacggccagcacaacgttgacgatcacgctgccggacggcctgtccgccgacaaccgcactcgactttgctggcagacggcaggctggctggtcacgcatgcacgtcaatacggcattgacgcactgcacgcggacggcatggattggaaccgcaaagccggcacatggatcggcaccgaaaccgccgagcagaccatcaccttcacgcttgcgtgatgtgacctataccgccgttgcgaccacaaatccgactggttggagcctacgccgtcgatgccgcctgaggcacgatacggatatgtttttactcgttcgaatgagcccaatccacgacggcttcgatgttattgccatccgggtccagcacgaatgcggagtaatagccgggatggtacgggcgcggaccgggagcgccgttgtctcggccgccggcggcgagcgcggctgcatggaacgcctgcacggcttgctgactgtcagccaagaacgcgatgtgtgtgaccggcgtgaccggcggagcctccgcctccagcccttcaatcggtgacacgtagaaatcggagtgcagggttccgtcatccacgccgaatccgagcgtaggctcatgatgcgccttgacgatatagccgagcggtgcgagcgcctgtttgtagaatgtgatgctacggtcgatgtctttcacgtgcaacgtcagatggtccagcatggtcttggtcgccctcccctggttcttgtattcgattgctgcttgcagtgtaagcccgaacgtttcccacagggccgcgcatggctatgatgagagcaatcgcacgtcgagttcgagacaatattcaaaacgaatccaaggcaataaggggaatgacgatgaccaaggcactgattgtggtggatgtgcagccgacgttctgtgaaagcggcgaactgggtgtcgcaggcggcaacgcggtcgccgagcggattgccgattatgtgaacgcgcatcgcagcgagtacgcgtatatcgcaaccacgcaggactggcatatcgagccgggcgcgcactggtcggcggagccggatttcgtggacacgtggccgaagcatggtgcggccggcacgctgaacgccgaattgcatccggcgatcaaggcgctgaatatcgagcatcatttcaagaagggccagtattcggcggcatattccggttttgagggtatcgaggacaataccgaccgtatccagacccgcgaggaggtcgaggccgagcaatccgccggcaagacgctggccaacgcgctgaaggccgccggcgtgagtcgcgtggatgtggtgggcatcgccgaatcgcattgtgtcaaggacaccgcgctcgatgccaagaagctcggcttcgaggtcaccgtgttcgaggatctgaccgtgccggtcagcgaggaacttggtgttgcggcccgcaagcagatggctgcgggcggcatcacattggctgagtcccgctgatcgggccggatatacccagagcgaagcacacagccgtagcatcaatcacgcgcaagattcccacgccacccaacatagcccgcccgcctcgaccggccgatatcatcggcgaacacgcggaaccgaaccctacatcgacgttcgtttcgtctggtttggcccatgaattctgcatgaattggggtgaactggcggggctggaggcgagcgggcggcggattatggggcacaatggtttcaaggaggccgccatggtcgatgactatactgccaaaatgactgagctgatcgaactcatgcgtctgatcggcaacgatacgcaacagtgcgaggtcaaggaatgcaagcgcaagatctcctcgaccatcaccgatacgctgtccgcgttctccaatggctccggcggctggattatcctgggcctgtccgaaaagaacgggttcacgccggtcgagggattcgacgcgcgcgccatgcaggaggcgctgagccaggcgtgcgagaagatgacgccggtggtgcggcccgtgatcgtcacctgcccgttcgaaggcgcgaatctggtgttcgcgcgcatcgacgagatgctgccgcgcgacaagccctgcttcaccaccgcgctcggaccgcacggcggctcgttcatccgtaccggcgacggcgaccggcgcatgacctcctatgaggtcgaccggctcatcgaggagcatctgcagcccacatacgatctggatatcgtgcccgacgccacgaccgatgacctcgacccgcagcttgttgccggactgttggcacgcgtgcgcgaacagcatccgcgcgtgttcgccgaccgagacggcatcgatgtgctgctggatctgcaggtgttgcgccatgatgattccgacgagtcggaggtcggcggaatcctgcgccccaccttggccggactgctggcgttgggccgctatccgcagaagttctatccgcggctcggcatttcgattgccgtgtttccggggacgagccgggacgatgtgttccggggtgacgaacgattggtcgcctcgaagtcggtggtcggttcgattccggtgatgatcgacgatgcggtcgactcgttgatgcgttggattggcgcgaagaagcccgactatccgccgctcgtgttgcgcgaggcgattgcgaacgcgctcacccaccgtgattattcgcccgatgcgcgcggcacgcaggtgcatatcagcgtgttcaccgatcgcatcgagatcaccaatccgggtggcctgtacggcatggtgacacatgatgtgctggcgagccctcatccggtgacgggcgcgccgttcgtctccacccgaaaccagttcctgttcacgctgctggagtccacgccgtatccgggcggcgggtttgtgaacccggaaggcggcgacggctaccagcgcatcgccgccgcgttgcgcgaggccggcatcgagccggcgaccacgcgcaacgacatcaacacgttcacgatgaccatcaccaagcagcgcacgatggcgaacagttcaccgggcgacgtggtcaaggcgattatgaccgtactggagcggcattcggccatgagcgtcaaggagatcatgcgcgaactgcagttgacgccgctggccgccacatccggtatgcgcgagctgatgaaggaagggcgggtcgcccaagtcaagttcgccgacgacccggtacagcggtatcggttgaaaggctgatttctcactcggccagctgcgtggtggcaggcgcggccagggcggggcgggatcggcggaagcggccggcggccaggccgatgcagatgaacatcacgccgaacagtgcgaccaatcccagcgagccggaccagccggcgacgcttatgccggtttccgccgccgtgccgaagccgagcgcgttgtcgatcgcggtgcaataccaccagccgggcaggaacttggctatggtcaccatcacgccgggcatcatgtcaatcggcaatgcgacacccgacgtgaacatgatgagcaggccgaagatgttggcgaacccgttggccgcctcttccgagagcccgaactcgctgagcatgaatccgcaggcgacggtcatcagcgcgtacacgcaggtcgcgccgaacgtcatcagcactcccccgacgctcaggtgcaacggatcgagccccgccgccatcatcagaccgattgacagcaccaaatagccgacgcatacgacgagcgcgaatccgcccaacgtcagcaaccgctggagtcccatcaggaccatgcgtcggggcgaggcggtgagacgccgccgcacctcgccggtggtgaacgcgcccaggatcatcgatccgcagatggtcatcgccagggacagcgggtacagcgcggttttcatggtgccgccgaatccgctgaccgccgtatccgcagcgcttgccgactcctcggtcggcgtatcgaccacggcgatctgatggttcacgtctgtatcgctggccgattcggcggccattttggcggcctgggacagatccttgatatccggcttgtcgacttgcccttccggcagcgagtccagcatgtcttggtccagactcgcgccatcaaaaccggcggcccctcctgtagcgttcatcatgccggcgagcgccgcctggtcgaccctcgtctgcgcgccgatcagtgcggtgcgggtgagcgagaggaacccgccgacgttcatccgcgccatcgacccggagccggatgcgtagctggtaaccgtgtccacgttcggcggattgtcgccgtccgccgccgcggcgacataatcgtcagcgaatccgtcgggaatgatgacgatcaggtccacccagttcgaggcgacggcctgttgcagcgtttcgctggtgtcgtcgaggtccaccagttcgctggaatcgcgcaggtaggcgcgcatcgacgtggcgatatcaccccggtcggagtcgcggtcgatgatggcgacgcgcgtcttggtcgattcgaacaccgcagacatggagccggatgcggaggtcagcatcgcccagctgatggacatcatcaggatgcctatgaatacgaggtagatcatcaggtagacccggtgcgcgaacagcacgcgcagcgtggctttacaggtgttcataacgttgcctcctcagcattgcgatgccggccaagaggaataccgcgctcatcgccagcagaatgatgcaggtggtgatgaacggccggtagctgtcgtagtacaggatgtcgtagaacaggttcgtcacctgctgtgcggggttgatggtgccgagtatgggcgcgttgcgggctatccagtcgctgatctgcatggcaaacccgccgtacagtccggtgaacagcgacagcgtgcaggagatgccggtcgacagcccgtatttcgtgttgtacgagagcttcggcaccgcaccgagcagggtgcctgctgagctggtcatgaacgaggcgatgatgaccgcgaggatcgccgccggttcgcgtccgccgagcgagacgttgcaggcgagccggatataggccaatgcgatggacagggcgaccgacgagcacagccagcaggagaggaagcccgcgacgagctgtttggcccggctcagcggcgctacggtccgccgtatgcccagcgcggacaggttcgcctgtgcggcggcgactgtgctgatggagtatcccatggccatcatgcaggacatggccagcagcgcgtaatagtatcgggcgatctcgtcaggctggaaatgcgtgagcgtcgtctcatgggtcatgtcgacgttctgcccgacgctgttccagaagttccggctgagcgcggcctgtggattgtcggcgatggtctgccgggtaacggcgtcggtgcggttgtacaggtcgatgacgctgcgcagggccgcgaggctaatgtccagtccgctgttttgcgtggagtccttggctgtgacggcggtttcccggctcacggtcatcgccaatcggccgttattgtcggcggtcagatagccgttggcagtgccgtcggcgagccgttgttcggcctccttcacggtgtcgactgtggtgatggtcagcagcttttggtcgatttcggcgtaggtcgtgtcgtctgaggccgattccgtttccccggccagcgcgtctacgaaggtgcgggcaccgtccgcctgctgccaacgggtgtcttcgatgacggccatcggcaccggcttgagttcgtatgcttcggccagcccgccgaacagtccgttgaacatggtcgccagcacaatcgggaacacggtcatccagaacaacgccgaccggttacgcaagttcgctttcaatgcgaccagaaatgtggtccacatgatgtctccttactcaggaactcccctcagtcacctttggtgacagctcccctcggagaggggagccaagttatttgcttgccgactgaggggagcatggtcagtccctcagtgctttgccggtgagttcgaggaacacgtcgttgagggtgggcgggcaactggtcaggtggccgatgttggcgccggagcgtttcaccgcgtcgagcacgtcggtcaggttgtgttcgccgcgacggcatcgcacgtcgagttccttgccgtcgtaggtggcttcgatcacgcacggcagcgcacggacctcggccatcgccgaatccgccagatcgagcgtttcgatggtgatgcgctcgcccgtgtcgatcatgttcttgagctcgtcggcggttccgagcgccaggtgccggccgtggtccatgatgaggatgcggtcgcagatctgttcgacctcctccatgtagtggctggtgtagatcaccgtggcgccggcctggttgagccgctggatgccttccagaatcgaattgcggctttgcgggtcgacggcgaccgtgggttcgtcgaagaagatcaggttaggcttgtgcgcgatgccgcaggcgatgttcaggcgtcgcagcagaccgccggacagtttgccgggccggaacttgcggaagccctggagtccgacgaattcgatggactcctcgaccagcggcgcgcggtcggttttcttcggcacgtacagcgagcagaagtagtcgatgttttcggtgacggtcagttcgttgaacacggccacgttctgcggcacgatgccgatacgacgtttcagcgcgtaggaggtcggcgtcatcggctggccgaacacgcgaatcgtgcccgaatcgtaggtgagcagcgcgaggatgcagttgatcgcggtggttttgccggacccgttcggtccaagcagcccgaaaatctcgccctggttcacgtcaaggtcaaaatagtcgagcgccaccatgtcgccgtagcgtttgaccagttggctgacgtgcacggccagagccgggttggttgtcgagtcgtgttcggaagctctgttgtcggttgtcatagtcactcccttccttggcgattccatcatcccaagaaggggccggacgccgccacaggcaaacgtcacgacttggccgtacaggcgtgacatttgtcattacagtccttcggcgtcggtctgcatggccttgtacaccttatcgaccggcatcaggctgatctcgtccatcgaatagttggacgccctgtggctttgcgtaatcatcggtatcatccctttacggttgtgtcgacgacatccgacgcttgtgcctcatctattcgggaagtgtaggcccgttgtcttggaccgtcatgcgggtaattccgcacgcccgtcaagttcgtcgtgttccgcacaccgctagactggtggtggaagagcgtcgagccggggaggtgccatgcgcgtgttggccgagatgggcttgctactcgtgttgggcctggctttggcctggcttgtcgggctacggtccgatggcgtgttcatcgccggcctgctgttggccgtttccgtcgccggattggtggaatggctgcgtcccgcgcaatggtcttgggtcttgtgtacggcgtatctcgtcatcgccgtggcggtgccttcatggtgcgcgttcatgccgctcatcgcctacgatactgcacggctgccggccctcgcctcgaccggagcccgggctggggcacggactgcggcaagtggccgctcccccagtgtctcgcggaccgcggcctctcgccgttcccttgccgatgcaatgcgttcggccccgtggctttcggccgccgcgcgctggatatgggtgttgccgctgatcgcgctctggttcgcccgtggcaccgaccgtctccagacgctggtgatgacgctggtcgccctgcttggattcgttctgggccgggcccgcgcctcctcggacgaggcgcggcgcgcgttgctgcacgcgcaggacagggcgcgcgaatcctcgcgggccactcgttcgcgcatcgccgacatcgatgaggaacgcgcccagtcgattcgcatggcgaccctcggcgagcgcacgcgtatcgcccgggagatccacgacaatgtgggccatctgctgacccgcgcgatcatgcaggcgcaggccggcaaaacggtggccaaggcgacgaacgatacggtcgctgcgcaagggttcgccacgttgggtgcgacgttggatgatgcgatgacgatggtgcgccgttcggtgcatgatcttgaggatgatggcactgatttcgccgcgcagatcgatgatgccgtcacgtcgttcgacggcatctcccccggtttcgccgtgacgctggccaacgatatcgccaaggcgcctgcgccggtctcgcgctgtttcgcgaccgtgattcgcgaggcattgtcgaacgtggtgcatcacagcgcggcgcgcgaggcgagcgtgacgttgcgtgacttccccgcgttctggcagttggtcattcaggatccggggccggccgtgtccgagtccgatgggtcccggacggccgctgcccgcccgcgtgcgatgcgcgccacgcacgtcggctcgcgactcgccgccgacggcgttgccgatatgcgtggttcggccgatgagctgatgcgcggcatgggtttggcggatatcgaatcgcgcgtgcgcgcccttggcggcaccgcggtctgcgggccgtatgaggacggctggcgtgtgttcgtatccgtgccgaagaagcgttggaccatggaatcgagggattgatgagaatcgcaatcgtggatgatgatccgatcgtctgccagtcgttggagacgattctgacggccaccggcacggccgaggtgctatggatggcaaatgacggagacgccgccgtgcgccgttatttcgagacaccggcgagccgaccggacgtgctgctgatcgatattcagatgcccggcaccagcggtttggatgccgcgcgcgagattctggccacggacccggccgcgcgcatactgttcctgaccacgtttgcggaccagtcgtatatcgcgcaggcgatgggacttggcgccaagggctatctcatcaaacaggatgtggcggcggtcgggcccgcgctgcaggcggtgatggccggtcaggtggtgctcggcgcggaagtgctcggcaagctcaccgaacgaactccggatcctgccgattccgacgattccagagataccgccgattccatcgagggcctgcttggcgagcgcgaacgtgagatcaccgcgctggtcgccgagggcctcgataaccgcgacatcgccgccagactgttcctgagcgaaggcacggtccgcaatcgcatcagcgcgatactggacaagctcggcctgaccaatcgcacccaactcgccatcctctggctcaacgcccataggtgagggggcttttggtcaagtaggcctctccctccgacatcgcttcgcgatgccacctcgaacgcgattcaggacagcttgcagctgacctcttattcgctcgttgtcactcaccctcgcctaaaaacgcctccggcgttttcttcacggctcggctcatcagagggaggttgtgaaaaaccaacctcagctgtttttcatgacgatactgtcgatggtgttggccacgcgctcgcagtcgtcggagcactgttcgaggtgacggtagacgtcatgccaggcgaacacctgcagcggatcggtgcaggtggtgtgcagcgtgcgcatcgactcgatgaacaggtggtcggcgtccgtttcgatcgtgttgatggcgaacaccagttcgcgcaacgtcttggaatgccggaatcgcggcagttcgttgaccagctcgcagatgctttccgtggcgcgcaccaccatatccgacatctggaccgcgtcgtcgcgcatgtcggtcacgttgtcgtagtacatgcggttgagcacgccttcgatgctgtcggtcacgtcgtcgagcacgtggccgagctcgtcgatgtcctcgcggtcgaacggcgtgatgaacgcggtcaccagttcgtccatcatgtcgtggcgcacctcgtccgctgacttctcaatcgcgtgcatgctgtccatgcgttcgcgcagctggcccggattgaagtcgtgcatgacctcggacagcagcttcgcggcctggcatgcgtagtccgcgctgcggcggaatccgtcgaagtagaacgtgtctttttgtctcgccatgatgggtggattcctttctagaacacgaccatgaacagtttggccattacgaagctgatgagaccgcaaccagggaaggtgaacacccaggtgagcatcatgtcgcgcaccacgccgaagttgatggcggagaggcggcgtaccgcgcccacgcccatgatggcgctggtcttggtgtgcgtggtggagacggggatgccgagcacggtcatgacgagcaggcacagcgcgcttgacagatcggccgagaagccttggtatttctcgagtttcaccatgtcctggcccacggatttgatgatgcgttcaccgccgacggacgtgcccacgcccatgatggtgctgcacagaatcatgagccagatcggaatcatcacaccggtcacgctgggttggccattgcagaacgccatgccgaggaacagcacgccgatgaacttctggccgtcctgcgcgccgtgcatgaagctcatggccgccgcgcccacgatctgcgcgtaggtgaagaacccgttggtgcggcggcggtccatgccagcgcaaatcagggtcacggccttgcataccaaccagccgacggcgaagccgaacaggaggcttgcgaccagaccgtagagcaccttgacccattctcccatgttgatgccgccgatgccgccttggatggcgatggccgctccggacaggccggcgatcaggctgtggctttcggaggtgggtatgccgagcagcgaggcgcccacgctgtatacgacgatggagaacagcgccgcgcatagggcgatgagcgccgcgttcgtgtcgccgccgaaatcgaccatgttgctgatggtggaggccacggaggcgttgagctgcgtcatgatgaagacgccgaggaagttgaagatggccgccatgatgacggcggagcgtacgcgcatgcatcgcgtggtcacgcaggtggcgatggcgttgggtgcgtcggtccagccgttgacgaagatgactcccagcgtcagcaacgttgtgacggtcagagccgggttggaaagcacttgttggaggaaatgcgccagtgagacgtccaaggggaattaacaccttcttcttcgggggcggaagccgtcacactgattgtaacggaagaatggctacgtagttcccatggcgcgcgggttttatggtgttgttatgctattgcggcctgtcagcagcaacaactggtattggggtggagacggtcgtattcctcgcgggcgcgaatgaattcgacctcgctcatcggtgtttcgccgggatgctcggccgcgaaatgctcaagataatggtcgtagcgggcctcgccgctgatctcacgcagataccagacgatgccgtgccatacggcaacgagtttgccgagcattttgtctcctttcgctgattattggctccccttgaaaaaaggggagccaatgacgcactacgctgcaacctgcccgttccgcacaagctcatgcagcttggcgctgtattcgcgctgcaccttcttctcaagcgcggtggcgaccaggctggagggcgcgaaccactgggattccacgaacggctcctcggacgtcgtttcggcaccgtacttgccagcggcgaacgtgcgcgccacgaccacgatgccgactaccacgaagacgcccatcatgaccaggaagaacacggagagcacgccgtccagatacgcgttggacagcgcggccttggcgttggtcagcgcctcgccggtcagctcgccggagtcgatctgcgcctgatacttggaggcggtggtgaagtagctcagcggcccgaagatcttctggaagtcggcggtgaaggtcacggcgatgtcccacacgagcggtaccaccggtatccacaggtgcttccagtagcccatcttggccacacacacggtgatcagcacgaagcaggcggcggcgagcagctggttggagatgccgaagataggcaccatcgcgttgatgccgccgttcgcgtcggacacgcccatccacagcagtccgccccacagcgcggtggcgatcagcgtggtgatgatgttgccgggcttccaggtcgggtcggcgaacttcttgagcttgcgcacgttgccgagcatttcgccgatctggtagcgggccacgcgggtgccgttgtccacggtggtcaggatgaacagggcttcgaacatgatggcgaagtggtaccagaaggccatcgagtcgtggccgcccaggtaggacttgaggaagttggccatgcccatggcgaacgtggtggcgccaccggtgcgggagacgatggaggtctcgccgatgtcggcggcggcctgctcaagcgccgcggcgccttcgtaggtcttggccgcgccgttctcgtccacggaatcccaggtgacctgcatctggttgccttcgatgtcggagaccttcatcgactccacggccttgacggcggcatcggcctgttcgcccggcgtggaggtggcggagatgctcacgccggatgcggcggtgatctgtgcggcggacatgttggtggagaagtacacgccctgcgagatggtgatcgcggcgatcagcgcgatgacggcggtgaacgattcgacgagcatcgaaccgtagccgatcatgcgaatctggttctccttctccacggccttcggggtcaggccggagctcaccgcgccgtggaagccggagagggcgccgcaggcgatggtgatgaacaggaacgggaataggttgccggagaaggtcgggccggtggaggtggaggccagttcggtcagacccggcaccttgacggacgggttggcgatgatgatgccgatgacgagcagcacgagcgtgccgatcttcatcagcgtggacaggtagtcgcgcggggtgacgagcagccagtgcggcagcgcggcggcggcgaacgagtagatcaccagggcgatgacgagctgcttggcgtccagtgtgaacacggcggccacggccgggatagaggcgatccatccgccggcgacgatgtcgagcacgagcagcacgaaaccgagcagcgtggtctcaatgacacggccggggcgcaggaaacgctggtagcagcccatgatcagggcgatcgggatggtcataccgatggagaacacggcccacggcgaggcggccatggccttgatggccacgagcgccaggaatgccatggcgatggcggtcatcaccacgaggaagatggataggatcataccgccgaacttacccatttcatcagtggccatctggcccagagagcgaccgcggcgcttggcggagatccacagcaccagcatgtcctgcacggcgccggcgaaaatcacgccgaggatgatccacagagtggagggcaggtagcccatctgcgcggccaggatcgggccgacgagcggtccggcgccggagatgccggcaaagtgctggccgaagagcacgcggcggtcggtgcgttcgaagttcgcgccgtcatgcacgcgctcggccggggtggcgttcgcgtcgtcggtgcgcatgatcttgatctggatgtaataggcatagaagcggtaggcgatggcgtaggagctcagcgccacgaccaggaaccagatggcggagatccgctcaccgcgcgagacggccagaatcgcccatccgcaggcacatacgatggcgatggcggcccacagcagggccttcttccatgtccataccattttgggacgcacgcctacgggcagtcccttcgaattgcgaatcacacgttcggcttcgtccggcgtgtaatcgtccttgaattccaacttgccaggtgccggggcctgggctgcggcggtggtcataataaccctctgttcctcttcaataacctttgcgggaaaggttctcttcattgcgacccttttggggtatctctcgtctgcttatggcactggttggaagcgtagccacggcatgtcgcgcctcaggaaaatgtcccaatatgtgagcttggccacatgttcacggactgcgtttcatgccgattacccgggattcgcaccgcgatgtgcgaaaatggacacggtgtcaatcaggaggtgcacagtggttgtaagcatggattcgagccgcacaatgcccgattgggtgaagtacggggtgttctggcacgtgtatccgctgggcttctgcggtgccgatatcaggcccgccggcccgcgccagttccatggccgcggccttgacgcgataattccctggctggagtacgtgcgcgatctaggcgcgtccggcctgctgctgggtccggtgttcgagtcggcgacgcatggatacgacacgctcgaccatatgcatatcgatgtgcgattgggcggggatgccgcgttcgatcagcttgtcgcggcctgccgggacatgggattgcaggtgatgctggatggcgtgttcaatcacgtgagccgcaatcatccggccgttcaggcggcgcttgacgagaccgccggacgcttgaatccggccgacaacccgtggcatggtctggtccgcgcgcatgtcggtgataatggcgaacccgctttggatgtgttcgaggggcacggggatctggtggcgctggaccattcggctgacgagaccgttgactatgtggtccatgtgatgagccattggctggatcgcggagccgccggctggcgcctcgacgccgcgtatgccgtgccgagcccgttctgggcgcgcgtgttgccgcaggtcaaagccgcacacccgtattcgtggattttcggcgaggtgatccatggcgattacccgcgcatcatcgaggaatccacgatggattcgatcacgcaatacgagctatggaagtcgatccagcatgcgctggagacggagaacttcttcgagctggattggaacttgaagcggcacaacgcgttcctggattccttcgtgccgcagacgttcatcggcaaccatgacgtgacgcgtatcgcatcgcagattggcccggccaaggcggcgttggcattggcggtgctcatgacggtcggcggcgtgccaagcatctattacggcgacgaacagggctatgtgggcgtcaagcaggagcgtttcggcggcgatgacgacgtacgtccgaagttccccggctcccctgccgaactgtccacgctgggagagccgacataccggctgcatcaggcgctgatcgcgctgcgccgtcgcaacccatggctgctggatgcgcgtaccgaggccgtgaagctggaaaacaagcacttcgtctatcgttcgacgagcgccgacgcccagcattccctgaccgtggacctcaacatcgagcaatcccccactttcaccatccgcaacgccgatggcagtacagcgtatcaatggtgagctccctcatcagagggagctaactcattcacctctgaatgcctcggatcagcaggtcgagcaggtaaccgtacgaccggtcgacccgttcgcggccgcgtgtgcggggttgtgcggaacgcagttcgaattggatgaacccgtgtatggacacccagatggaggatgcgattagatgggggtcatcgccgcggaatacagatgctgcctggccgtatcgaatgatctgcgtgatggcgtccaggcagtgctgggccgagtccgacgcctgccccatccagaccagcgcgtaaatgccgggggcgtccagcgcgtgttcacggtagattatgcccgccctgcgcaggcgcagcacggggtcggattcgtcaatggcgatgagctgttcgcgcagatcggtgaagtatgtgtcgatgagcgcatcgcacaccgcctgcttgccgccgatgtgctggtagatgctggtgggcgacacatcggcctgtgcggacagcgcacggatggtcagaccatccacaccgtcccgttccacgatccgccttgccgcgtcaaggattctcccgtggatttcaagggtgggcgtgcgtttggatcggggctgcgattgcgtcatatccgttattctagggtgcgtacaggccattaccgccgtttcggcatggccacgatcacaacgactgcggcgataagtgcaatcgtcatggccgctaggcaggcgaacaggcatccgcatcgcaaacaccggcctataacacaatcaggcccgacgaccatcaaaggtcgtcgggcctgattcatacgcgctgtcggactaacggcgtccagacttcatacggaatggcgcattgtggcgattcttcttggaatgacggcggttcgggccttccgtgttgccgtatttggcgatcatgcggcgttcgtgacgcttggcaccttctgaacgctcgtcgcgtacgatgcggttctcgttcttgcgatggatgcgcttgccgccttcgccctgacgggtgttgcgcatggactgtctgcggccgtcatgggagcgctcgtcataggagaagccgtaatcctcgtggctgcgttcattgcggcgaggcttgcgcggacgctcgaaatcgcgggaatcggaccgttcgaaatcacggcccgcattgtgcctgcggctgccgaaatcatcgttgcgaccgtatccggccctgtcgcgcttatcgaacttgtcgcccttgccgtaccgatcattgcgacggttcttgccgtgctggtcgcggccattgtcctgacgctcgtcgtaccggttcttgccgtatccgtcgcgacggtcgcccttgcggcgctcctcgcggcggtcatcgccatgctcgaacagatagtcgcggcgctcggcctcggggttgctcatgcctgcacggcgttccgcacggttgcggttcttcttcacggccttcttgctggccttgtcgccgtgcttgcgctgcggctcgccttcggcaacaaactcgccgcctgcgttctcgtgctggaactcggtctcggcaacgttctgctcgtcacggttgcgattgcgattgtgcttgcgcttgccgccgcggccggactcgtcgcccgccgcgttcttggcgcccctgttcttgcccttgcgcgggttgcccacgggctgcgacttgtcgaggctccaaccatctacgcgctcggcgcggtcgcccacaagctcaagcacttcgggcgaatcgtgggtcacttcgatcatcttggtcttgatgccggcctggttcagcaagcggcgcgtctcgcggcgctgctcgggcagcacgagggtgaccacgtcgcccgccttgccggcgcgggcggtacgaccggagcggtgcacaaaggacttcgggtcggccggcggctcgacctgcaccacgagctccacgccgccgacgtctatgccacgggcggccacgtcggtggccaccatgacacgcacatcgccggaatcgaacgcagcgaggttgcgatcgcgctggttctggttcaggttgccgtgcagctcggcggccggaatgccgttctgcgtcaggttcttggcgagcttcttggcctggaacttggtgcgggtgaacaggatgcggcggccttcgcccgaggcgagcatgcgcacgagttcgtgcttgtcgccgcgcgtggtttcgaacacgtggtgggtcatcaggtcgggttcggcggtggccgaatcgacctcgtgcaccttgggatcgtgcaggaaggtgttcaccacttcatccacgccgtgatcgagcgtggcggagaacagcatgtgctgggcgtcgggcgaaatctgctcaagcagtcgcttgaccggtggcaggaagcccatatcggccatttcgtcggcctcatcgatgaccacgacttcgacggacgagagcgtgagcgcctgctggcgcagcaggtcctcaaggcggcccgggcaggcgaccacgatatcggcgccggccttcagatcacggatctggtggatgtacttgacgccgccgtacaccgtggtggtgttcatgccaaacgtgtgggccagcggcatcagcacgtcgttgatctggttcgcgagctcgcgggtgggggccagcaccaggccgcgcgggtgcggcaggaagtcgtcggcgcggcgctcttccaggctggccttcttgcggcgcttgatttccttgcggaactcctccatcgcgatttcgccgaacgaatcgtaggaaccgaggcgggtgaccagcggaatggagaatgcgagggttttgccggagccggtgcgccctcggccgagaatgtcgcggccggccagtgaatcgggcagggtgtcggcctgaatggggaatgcggtcttcttgtcatctgccgcaagcacgcgcaccagcggtccgggtacgccaagttcgccaaaggtaagggggcgggattccgcgctgtcgttcatctggaaatcagcggaatcgtcacgatcatcgaaattattacggggcacagtggcctttcatgtcaaaggttacgcaaattacgcaagctttccgagcttagcgtaagccccctactttgcttggtgctcgccacactgtcatcccactctttacttatgaccccatggggcggtaactcgcccatggggcggcaacttgcccatggggcggtttgaagaaattgtgaaaccgcagaataaagccattttcacctaccgccccatgagggttttaccaccccatgggatatttgccgccccatgggttttaccaccacgtaaggcgagcaccgctccatggaacacgcaaatggcccccacccgtgaaggtaggggccattgtgcaaaagggctgagccaagatacagcccagtagccctaaaacacactacaaaatatccggatcgtctttggcaatagtgccggttgccttgccaatggccttcaggccgtggtaggccacaagaatcacgatcgtgccaatggcaatgccgttgaaggaaatgccaccaacagtgaacgcgaattggccgatggcaatgatcatggtgatggctgccaccatgatattcagcggcttgtcgaagttgaccttgttctccacccagatgcggataccgatcatgccgatcatgccatacagcagcgtggtcacgccaccgagcacgccggcggggatcgtgttgatcacggcaccgaacttcgggcacaggctcaggatcagggcgaaggcggcggcgcaccagtaggcggcggtggagtacaccttggtggcggccatcacgccgatgttctcgccgtaggtggtggtgccggagccgccgccgaagccggcgagcgtggtgcccaggccatcggccatgagggcggtgccgatctggttgtcgtagtcgcggccggtcatttgggccacggacttgacatggccgacgttctcagccacaagcacgagcacaacggggatgaacatgggaaggatggagaaatcggcctgcggcaggtggaacttcgggaagccgatccatgcggcgtcgccgatggcggagaagtcgacctggccacggatgcaggcatatacatagccgatgatcacgccgaccaaaatattgaggcggcccagcaagcccttgaacagcacggccacgagcagcacggccaacagggtaaccagtgcggtgtcgggcgcggcttggaagttggtccacacggaaggtgccagattgaagccgatgatggccacaatcgcgccgttgaccacgggcggcatgatgatgtcgatccatttggagccggcgtaatgcacgagcacgccaaccagggccagcagaataccggtgaccatgatgccgaagctggcgaccgcaatgcccttgttggcggtggagaccgcggtgatcggtgcaatgaagccgaaggacgagcccaaatagctcggcagcacgttcctgttgataagcaggaacagtgcggtggacatagccgtgaagaacagggtggtggacgggtcgaagcccgtcagaatcggcaccaggaaggtggcaccgaacatggcgatgacgtgctgtgcgccgataccggcggtgcgcacccaagtcagacgttcatcgggctcgactacctcgccgggcgccagcgtcttgccgtcgccatgcaattgccattggaagatattggacattactactctcctcgctctcgcttggggcacggcattcacaaccagccgcaccacgcaccattctagctcacgaagattttgtgaagtctctcttccgggaaaggctatttgccgtaatactccagcaggtgtgggtcgacggcctgcaccacatccaccaaatcgccattggagagatacgggcgcttgaattcgcgccacggctccaccttgacctcccagcggccggtcgtctcgtcgagcacgggccgggcggtctgctcccagcgcacacgcttggaggtgcggccggtttccgggtcgcggcgcgtgtagtgcaggcaggtgcagttggtgatcttccagtcgtccgagtcggcgcgatgcaggaattcctcgtcggccagatcctcgatggtgagcatcagggcgagcatgaagtcgccgtgggtgaccatgaccacggattccgaatcggatttgcggctcagcgaggtcaggatgttgtgcacacggtcctcggccacatcggcaatcgactcgcctgccggcggacgccagtacagcggatcggtattcttgaagttccagttgcgtgcgtagttgtttttgaattcgtccttggtgatggtgttgatttcaccccaagaacgttcgcgcagcacacggttctcctcccatttggccttgggcagggccatggtggctgcggtttcgcgggtgcgcacgtatggcgagaccatgtaacggtcgaacagctgctgctggctgaccagccaacgaccgatgcagtcggcctgcttgcgtccggtggcggtgagtctccaggagcggtcgggtacggtgacgttgtcctgcgtatacagggagttgtcgccctgttcgcccgcctggacgatgacgttcgcttcggattcgccatgccggattacgtatagatcgagcggcatgctcatatggattcctctttcgttattggttacgttgtgttgttttctgctgtttcctacttgacctgcgttatggtgtcccccttgaccatgaacgcatgccgggccatgtcgatcatcggctggtcgaacttcgagtcggtgtagaactcgtcgacgacggcgtccggaccgtacagctcgcggaacctcctggccttgttggtgttgaagttgaggtacgtgaccctcatcgtctccacatccacctcgctggccacgagattcctcacgccgagtctgcggcaggcctcccccaccgtcagatcgaaggatgcggtgaggatcacatcgtccgactcaggctggtaccaaggcttgatacgtgcgtaatatcggtcccagaaatcgtccacgagctgttcgacgctcgccacccgtttggatcggctcagttccgtgagatagccttcggtcatcttgcccacgccgtattccatttgttcaagcgtggcccggccaagcttgtatttgaccgcgtaccgcagcacgggggcgatatagcggaacactttcgggtcgtggcgggcggaatacaggtacaagtcgaacaggctttcgccatcatagatggttccgtcgaaatcgaatacgcgcataccttctgcttctactctgttattccttgtctaaggctaatctcggtaagccggcgaaagcgcaaatacgcagtgaatttcacatgaacactgttttttggattgatttcggtacaggtaacgtacactggtgacagcgtggaaggaggtgcgtaatggcggcgtctgaaatcgaacaatggtggattgataagtttcaggagaacctgggtccgattcgcaaggtagccggatggacgactcagcaactggccgacgagctgggagtcgcgcgacagacggtgtctaacttggagaccggcaaaagcccgatgaccaaactgcagtatctcgctttacgtacggtgttcagcgccgagatcgcacgtcgtgaagaccgcgatctggcacgcatcatcaagactttggtcgacgatcccattgagcaacgcattcgcgaacggcgcgcccaagagcaggacggcgaggccgttgccgacaatgccccagtcaatacggacggtggcaacgttgccgacaacgccgccaccgagaaacgcaagcccagtgccgccacattgaaggcttcaaagactgccgcaacgggcaagcccacgctcagcacggcgatgcaggctctcgccgtcatcaccggcgcattggccagtggaaccgccgccggcatcatcacttacttgatgttcccggacggcggcccgaacaagcgctgagtcgccgaaatatcgaaacggattgaacaacccagttcgaagccctgagcaccattttgtccgtgtcgcaccagcgtttccctcattatcagctgtttcgagttgcatgaatgcaccgtttacaggccgagaatttcgtgcttttttgcatcaaattcttcttgggagagaatgccgatatcaaccaattccttcaatttcttcatcgcctcgacttgttcttccacagacatggatgccgtgtgagaggcgggagcagcggcttccggcgccggcgcaggcgccggcgcttgaaccggggcggccgtcataggattaatggcttgtgccatattcatgcccagcaacatgccaccatcgccaaagccgttgtcttggatgccttgcgcaatgcgctgctgggcagccatattgccagcttgctgggaaacgccctcgtatgcggcaacattcatcttattcgaggcgaactgctgcacgagttgacgtgattgctcggtgaactcgatactttcgatgcccacactggacacttcaaagccaaaacgatcattccacgtacctgcattggcccgatcgccacgcacgcatgctgcgatgtcattcgccttgccgggcaattgcgaaatacgatattcattggacagcaaattgatggccacaataaacgactgtacgaattcagacagaatctgcctacgtggcccttcatcatcgaatgaatacgacacggtagtggcaggcacaaagttacgaacgaatcgaactggatcagcgacctttagcgacatggatccgcgtgcgcgaatttccaaatcgacgccatagaaccggtcgttatacaccagcggcgcagaagtgccgaatttgatgccacgaatctcacgcaggttgacgaaggccacatatttggtgcggccaggctgacctccgaaggtgaatcgatcggcaacctgattgaagaacgatccgatgccgtctccggcgagcacgctctgctccccgttgcgatattcataaccgcccgactcggtgatgacgttttcgatacctgtttcagagaaaatgaacgccgcagtattctctggcacatagatacgcgaaccattggtgattattccctcggaaccgtattcattcgaaccgcgatcgttgttgcttccgcggggaatgcccggcacaacgacggtgtgttccgtgaacggaccagcggtgatgatatcacgccacaggtccgcgaatgtaccgccgagcgcgccggcgaacgccttaataactgccatctgttttttcctcgatatctcatgcatatggccgatcttgcgactatgcaatcgcaagaccggccgttatgctggcatgttggttatagctgcgtttcgcgatcgcagtattcgcatcgaacgacttctttgcgatgaccggaaagcggagcgccacaaccttcgcaattcaccgaaaccacgggttcggtaatcccaagcccactacggaatgcgccaaaagtgtccttcagcgccccggccagagcctccgttccggggatggccttgttgaagaccggctcatccattggcgtgtactgtctgccgcgtatacccatgtatcgtcatcgttcctttcttggaaaaccgttacctcgatacgccagtctgatcactggcccaccgatgcgagcttctgcgtgcatcgagtcatgacctcggtgtagtaggccaaatcctcactgctgagggagttttcgtcaatggcgtctaccttctgggagaactcagagtaacgcttcatcatgctggcatagtcggtagccatgctgaccacgttgtcggatttctgatatttgttcatgaaggcaacatactcatcgataaaggcctcgtagctgtccatcgtggccttgaagtcagcactgtcattggtgttctgctgcgccttctgatccgaagactggtcgctctgcttgttggcatcgctggaatcagtgcccgtaccagtgctcttatcatcctgtttcgcggcgtcgccgtccgtagacgtatcttccttcttttccggaacctggatagtgatggacatgatggtctcgtcgtcagtgtcacgagaaacgctcacactgtatccatcggcgttcttggcattgaaactgtcagcggacttgctatagtccacggtgaaaccgttgtcttgcacggacttgacgtagtcggcatactgcttggcgtcggtaccgcacacctcgatggagaaatagtccgaagactcgcttttaatttcaccctttgtggatttcggctgcggcagcagcgccgcgatatccgactccggccatgaatatgcttcgcacttggtggcgagcgatgcttccaattccgcccgatcagccttggccttcgcatcgtcacgaattacgaacacgccaccgattaccagacccacaacggtgataccgactgccacccaggccagcactcggccttgcaccttgccactcgggcgggtcacgtatacggcgaagcctgagagcagtgccggaatcaccgtggcgaacagcagtccgccccaggatcggccagaaacatccacaaattgggcgagtacgaacaacactccccaaataatggcgaacacagccagcttggaagtcttcttcaccccttgtgcattcggagcaagcacggcaggcgcagcggcaccagcaaaaccagtggcagcaccggcaccatgtgtggcgggtgcaggagccacaccaatacgcttgtccagagcggcgaggaactcatcaacgcgcttggcgctttcgtttccagtcgcctccagacgaatggcggcccctgccgcaccctgcgggactacggttagcgtgcagttcaccccatcataggagtggaaggaaaacgctccggtctgggtgttttcgttatccaaggtaaacgtggcgccagtagtcagctggtcgtgaataacttggaacagctgttgcggactgaccgcatatacacgatcaaatggcgcgccggcgggccgctgcgatgccgtagccggagccatcggagtggtggtagcaccatcagacgctacgttcggttggccagccggtacagtattcggcacggtaggcgcattcgcgcgatcttccggtgcgtcattcgtgccttcggacggtggaaccggctgaggttgttgatcaaatggcgttgtcatgatgcccttctttccttaagcagcagcattaccagcacagaagaggcaagcccggcaaccgttacggtcaatccgactgccatggcaagccggtatcgttcgctcatcattgcgtcccttcttattgctcgcgttgctctgcgatacatcgaaaccagtgtatggcgttgttattatgtacgcaaattagcattttgtattcatgttagctttattgtcgatgcttgataccgcgcatgaacatcctttccgccaccgcacctacacggatggcatcgaccattgtcggcgacacgcgcgggccatacatcagctgacaactgaatttttcggcgtgtttccgaaaagtcggcgtcctgtacgctgggaatcgagcaaccgcgtacgatggcgcagcacagcacccgcaacacagcgacaaggagcataggcaatggcagacatccccgaagaacatttgaccgaggaactgctggatcggctgctcgccagcgccagcattgagcagtatctcgatgagggacttgtcagcgcacgcacgctgaccgactatctgttcgaccgtatggaagcccatggcctgaaacgagccgacgtggtgcgggcatccggcctcaacgccacagtggtttatgacattttctccggcaaaagccgccccggccgagatcacgccatcatgctggcttttggtctcaagtgcacattacgcgaaacccaacggctgcttcgtcttgcaggcgtttccgaactgtggtgcaaacagcgacgtgacgcgattatcatctggtgcatacgcaatggattcgaccgcattgccacggacgacgagttgtatcgtatgggagaggcgacgttgctgccggccgattgacgacattcggcccaacaacactcaccagtgagacgcaagtaagagggcatcaaggagagacatggacgataagcaagcgatgcatgcgatgagcatcgacgatgcgtaccatgttgagcgcacgcttgctcgcggaccttccggcgtcaccgaactggtgagcattgacggcaacggcccgttcgtacgcaagaagattccctctcccctagcgcaacgcaatgtgtgggcggcgctcagcgcctgccagagtaatcgtctgccgcgtgtggaagcgacgtacgagctgcccgaccggttcgtcatcgtctacgattacgtgccgggcagcacgcttgcgcaaattgcggaggaaaacgggcggcttgcgccgaatgtggccgtgcagcttatcgaccaaatttgcgaagccgtgcaggagcttcaccagcacggcgttatccaccgcgacatcacgccggccaatatcatcctggctcgggatggcgcgcatctcatcgatttcggcattgcgcgcatccggtcagaggcaagcaaccgttcacgggataccacggcgcttggcacctacggattcgcctcgcctgagcaatatggctttgccaaaaccgacgcgcgttccgacgtattctcgctgggccggctactcggattcatgctgaccggcgtatatcccgatgccagcgactacgagcagcgacttgccgatgatgccgcagtaccggctcgactacgcgccgtcatcggctatgcgtgcgcattcgagcccagcaaacggccacagagcatccaagagtttcgccaggcgctgttctcccagtccaatccgcccataccgaacgcatcatcggcaaatccgccatcaacgagaacaacgaacggcagcgcgtcggcgtctcgactattccggcgtctgcacttgagcaaacgcgccatcgtgctgtggtccattgccggagcggcactgataatcgccgccattgcgggaggcattgtgttggcaggccaacttggcattatcgggtcggcaacatcacccgattcctcgacacaatccagcagccaatcaaccgataaggccgatggcgggcactcctcgaacgggtcaggaaccgacaatgccaatggcacgggcggagtaggcggcactgacggcgctgatggagacaatcaagacaccgtcaccgacaatcctctgaaaatagtggaatccggctggtcggcggaccagcaagggtatgtccactacgctttcgccctgcgcaacaccagtaagacccagcaggtgcagtatccgcagattaccattacggggcgggccaaagacggttccatcgtgttctcgcagacgcaagcactgaatatggcattcccgaatcagactgtatatgacgccggtcaagcaggcgaaggcaccgccccagaaacggttgattttactgtgctcaatccggatacatacaacgtcgccaaggctcagggaaccgccgccttccccatcagtggaatatccaaaatagacaacagggacggcggcacgacgttcaatggcgaggtccacgccgtggcagatggattcaagccatccgatgggcagcaaatcaagatttccctagtactgcgcaacgcacagaacgcaatcatctatggagatatcacattcgtggattggccgggcaatggccgatccgcaccattctcgatcaccgtttacgatctgccgaagtatgcatcttacgatctgtatgcgcaaatctggtagttgactttgcgcctgcgaggtggctgtcaggcgactgtcaggcttgtgtccgagtcacctgtgcactggtgttgtggcgcgcctggccgaacagatagatgccgatgggcagagtcagcacaccgccgatgatgaacaccagcgaaatcgggatcacgtcggccaacggcgcgaagatcaacatacccagcggcatgctgagtgtgctcatggtggtgtcaaggccgaatacacggcccaccatcttctcatcggcctcggtctggatgatggtgcgcatcgggcccatgcagatggccgaagccaaaccgttcaccacatcaatcagcaaatacgccagcagattgtgaaccacgccaagaccaacgacggagacgcccaccagagtgatgccgaaggcgaccacgcgcatgttgttgcggatgagcttggcaccgatggtagacatcagcgcgccgccgagcagcataccgatgctccatcccagctcgttggcggcgagtttatcggaggcggtggtcaggttgatgaatccgagattcaaatcgatgccctcatattcgcgggtcatgagcaacagcgtaaggttcatcggcgccacggccacgaagcacaccaaggcgtcaccgagcaccacgttgcgcaggttcgcccggcgccatgtgtagctgaaaccatctttcaagtcagcaaacacacgacggacgctggcaatcagcgaacgatcagcattggcatccgacatcggttcgagtgtgggttgcccgctattctccgcttcagccatacgcctcgcaacatgttccgcgctcttcttcggcgctttgatcgacgccacaaagccgacgccgataatggccgtggtcacatcgactaacagaatcgaccacagcggcactgtgttgataagcacagcagccaccgcaggtgccacaatcatattcgccgaattaatcacgccgtatattgagttgacgcgcaatagtttgcccgagggaacaacatccggtatgaacgactgcacagcgggcgtctgcaccccgcctcccgccgaacgaatgaacagcaccacgaaaatcatggtcagactcgcccatcccatcgcgaagctcagcgacagcacgacggtgaccacagcaatcaccatatccggcagcataatcagcaacttgcgactgtgacggtcggcccaggagccgccgcaaatcgagacgatggcctgcggcaccacgccaaacaacgtggccagcagcatggccgaaccggttttagtctgcaatacgatccaccaccagatggcatattgcacaatattggagcccagcagcgagaacgcctggccggtgagtagaagcactacacggcggatccacgcacgctcggattccccgttggccactgctgcggcataggcggcaccgggtttgttcgcgctatggaccgctgcgcgcgcattcgcattgtcatcgccggaaacctcgggtgtttcgcgcacagttggttcagttgttgtactactagaagacatacgagtgttctcaattcttcaattccactacaaaggtcacatcacggcatacgcacgccgacgcgcgtatgcgtgcacgactccagcaacgagccgtacccgccgttagatggcaggcttcagtatcgtgacgccatgcgttagcgtcaccatgcaacgataggaacacactattcgatagtataatcatgaaggcgtgacgttgcccttgcgcaggtgccgtaagactccgcggacaaagcaatgaggcttccccgcgagaagggaagcctcatattccattcattctattcagcgatgatggcgcctaatcaccgatcatcctttgggaacagcgcatcgaaggcatgttccatcacggacttacggcggatcacaccgacgagtctgccatcagcatccaccaccggcagtttcttgaactgcttcttggcgaggattcgggccacctctccgacatgctggtcgggcgtggcggcaacgaccttgcgcgtggcgatgtccatcaccttcttgccggaaagcgcctgcaccttggaggccacggtctcgtcgtcgaacaccaccatcgtcgaaccggtgccggtggaaaccgtacgggattcataggtggcaatcgatttcatgacatcgccgtcgctgacgaagccgacgagcctgccatcgccgttcaccacgggaaggctggagacgttgaggcggatgaactcgcgcaccacatgcgtgatgtcatcgctgtccaggcagctgtagggctgatcgtccatgattccgccgatggactgttcctgggcctgcttgaacagggaggcggcgggggccacgtatgcgccggcgtagtgatgctcggcgggctggccttcagtggtttcggccgcgacttcggcggaggcttgcgcctcggaggccttggcgttgcgtgcggccttctccttggcacggctggtgacggtgaagatgcagatgatcagggcgaccagcgagatggcggcgcacagcaggtaggagaacgcgatgccgctggccgtggcggacttcacaccctgggacatgtgcgaggcggtcatggatgtttctgcggtgaccagaagcgaggtcgcaatggctgccgcgatctggcggccggtgttggcgatggcgttgccatgggcgatcatgtcgttcggcaaagcgttgacgccccaagtgttgatcggcatgttggcgatagcctgaccggatgcctgcaatgcgcagaacacggcgacaaacagcactgatgtcccggtgttgatggtgccgagaagaccaagagagatggtcatgagcgcaaggccgccgatgcccacgcctcgcgggccgaatttgtcgaatgcggcaccggcgaccggactcaggatgatgccgaccgccgcggcgggcagcatgaccatgccggtgacggtggcggattggccgagcacattctggatgaagataggcaacgtcacgttggttgcggcgactgcggcgttgatcagagtgaccagaatcgcggagttgcggaagttgcgggtggcaagggtgtcaacgcgcaacaatggctcatcgagcttgacttgcttgtatacgaatgcgacgaaggccacaagaccaacgacgattgagataatgacgaccggactgctccatcccatcgtggaagcggacgagaagccatagagcaggccaccgaacgcgatggtcgaaaggatcacggacaggatgttgagctttgggttcttcaactcgccgacgttcttgagcatcatcgtgcctccgacaaggatgaccagtgccacgactgcgatgccaatgaacatcgggcgccatccgaaactgtcaatcaccagaccaccgacaaccgggccgatagccgggccggcggccatgacgataccggccatgcccatggcggtgccgcgcttatccggcggatagacgagcatcggcactacggcgaccaatggcagcagcacgccggagccggcggattgcagtatgcgtccgacgagcaacagcatgaaattcggcgcgacggcacacagcagtgtgccgaccatgaaagtggcaagagctccggcgaagagctttcgggtggagaatttatcaatcagatagcctgaaatcggcaccatgatgcccgagaccagcatgtagacgctggtcacccactgcacggtgccggtggtgatattgaaatcacgcatcagtgccggcaaggccggtgacatgacggtctggttgagcagcgcgatgaacgagccgacgacgatcacgcccacgatgatgaatcgggtgtgcggatcaataggctttacggaactggcggcggacccgaattccgcggttttctgtgaggtcacagcatttccttctgttggtaacgtcatgtatgggcgatccggccccatgcttgtgtcaagacacgaggacaccgatgagtccggacgtaaaggaaaagccgccatccgttccgcattcatatacggcaaacgattcgcggctttgcgtaagttgatggctatggtgagcgattcatgcgacgtcgactgcggatgggccatcggtacatccgcatgaggcacgtccccgctacaccagcatcgagaatagggccatttgtggattggcaaacagaacattgccgacgaacgacccacggcaggcgcgtgcgatgaacatcgcgtagcgatacaggttcatggcacctccttgatgggtcttcgtacggcggacatcgagaagcctatcatcattcaaatcgacggtgaaacccacgcatgcctgacaatacacaaaatcttcgcaaaaggattgggcttaccgcatacgatccgcctgaatagcggtccggggatgaatcaggggcgagctaagggttgcatctcgtgtttccgtcatgatttctggcaaaatagtgaagctgaacatgcgcggaatcgaccggaatcggaaagggactaatcatgcgagttctcggcaatatcctgtggatcattcttggtggattggccatcgcaatcggatgggcattggtgggactgattctgtgcatctccatcatcggcatcccgttcggcattcaagcgttcaagatggcgggactcaccttgacgccgtttggcaaaaccgtgcaatacggcggcggagtcggctctgccttggccaacatcctgtgggtggtgctggtcggctgctggatggcgctcggctatctgggtgcaggcgtgctcaactgcatcaccatcatcggcattccgttcggcatccagtcgttcaaaatggccaagctcgcgctctggccgttcggcgcacagatctacagtttgtgaattactcgaaatcacatacctacaaaaccaaagattgttgctgtaccaacgtctagtcgttggtacagcaattacggcaacatctccccttacaggaagaagtcgtcaatctctgcttcattgtgcaatatctcggtttcagagacaccaatgaatcttgccaaatcaacagatgcggcgaaacgtagctgtatatttaaatcaagattgaatgcataagtctgcagctcccctagtttccggtatttatcgagaagagtttccaatatttgcgcgtattgcacgtcgagattcgcgacgaacaagtccgctttgcgctgatattcagcgatgattgcccgctctcttgcactcaatatgttcttgccaagaccaagcacattcgaagcgacaattgacccgataagcgcgcccacaacgggaacaggaataagcgtctgaccaatcgccgctcctaccgccgcgccggtagcatcaagggcattgatagttaccaagctcaagaaaccgtcatcatcaatctctccggaacggaatttcatgacagcatctatgagtccaaaagttccggacgctatcgcccctgcgctcggagccgaaagatgacagacattggtcaatccataaattgcatagcccgaaaacccgcctttgaaggcaccctctgctgtcttgacgcctccttccttccaatcctcagcggtaaactgccatatttccttgccttcgtcgtgcttttgatacacgaaaatgccgaagttcaatccaccttggatagcagcacccaccccggcagctttgttagcctcgcctagattcggctgagctttgtgatatgcagcagccttatccgtattggccttattggagatttcgctcttttgctcggatgtctgccgtttaatattgtcggtttcttcagtaaaagtccggtcaatcgcttctctttggacctgatcatatttcaataccgatgattgcatccatttgtcccaggacagtccccggatgttactttcctcttcgataagctgcttaattttctgcacttggttactggttagcggttgtccgttgagaaagacttctttatcgccatgcatgaccgcacgaaaaatgtccatgtggtcctttgaaaacatcatatccatagaacggtattccgcagatgtcttcagctcgttcattaggttcgcatagaactttacctgcactggcttgccgttaatcaacaaatcagcaggaccattatcattaagcgttattgttgatttttccaacccttcaaatgctcgtctggcgttagcgattcccgtctgcgcgaattcagcgataaatccatgtataccattttcaccaccacgcccactgttgacaatgttcatgacattttgattcgctaaatcaaggttccttagcgcattagcttgtcgctcggcgagatctttcagctgacctgtttcattattaagaatctgtctcaatgtgtccatcagagtagacacacgtagctgattcaaataatcaatatacgcggcaatgccctgagcaacattgttatcgatggcgtgcttgtcagcagtattcttgtcagtcatcgagttccagttccttgttaatcatttgcgctaaggtgagcgtcatattgaccagtaatcccgcctgcattttctcttcgtgggagaactggctgtaatcggcgcctgtcaccgcagcattcgcacgctgtacaccatctatctgagtttgcgttgcctcagtcaatgccgcgacttcggcattcttcgcattgaatttgcgaattaatacttccacattctggcgctcaagcaaaagcttgtcagcagtttctttgtttttatgattcgcataaataccagaaccaattgccgcagcgcccgccacgccagcgatggtccatccaaccggaccagccaggcccaggaacgcggttccggctgacatgccaccgccacctgcagccaatgcaccgccaccaagccaagccagagcagcactatttgctgcagctccggataatgcagaaatggcagtaccggtcgaagctacaccgaaggtggtggccacacccattgcagccgtaggtcccatggttgctactgcgattcccaaagcactgagggtggcccctgctccagaccctccttcagctgcttttgcttgcttttctgcctccttaatctcatcctctttattctcgaacgtcgttacttcggtattgatcttatgcagttcaacggcaaattcttttggcgtattagccaattgattgatatgttgttcaacatacttgacatgcacaatagcgatttttctcaagtcatacagcgcttgcgtacttttagctaaatcatccgctacgttttcatagcgttctacggcattgttgtaatcctcgacagccttagctcttagtttggaattaaacaaatcgaccttatcggcactatccttgacgtttttagcgattgagacggtaccctttgccatgctgtcagccgctttgcttacttcgccacttgcgacggccgcagactgtgccacgctccctgcaacagctgccgtcattttgcccgcatcgccggcaagcttacccgcatcgttgacgatcttacctgcccctttggcaacatctttcgtgatttttcccgctgtgtcaccgatatttccggctattttaccggcttgtttggtgaaatcattaagacctttgcccaaattatcgaacatgttgcccatggttgttgctccccttttcacgcacctgccatgatgtccgtcatcgacggcaagtgcttcgttgcacttataggccaagtgtactcataattacgtagctgcggtacatgaccatacatgcacactgcgtagtttgacggattcgcgaagaagcccccatgaatgaccaaaacgtaacttgcttacacacaccgtgatttgacggatttggacgtaagaccttatggtgtgcacaccatgattcaacgtatcgcattcagcagcaacggcgtgaacgaacacgccaagcgccagcagacgaacctgccggcgatgctcgaatgcgccttcaaacagggtttgcgtactgctcagttccagccaataaccggaaacaagcgcagcctgctcgctgccaaacaaatctgatcagtacaccactcattggcgcatagctgaatcattgccggtgatatcgagccgactcgttcgcgccatgcctcatatacgcacctgtacgagcatgtgttcttggcatcgtcgcaactcaatgcaccgcaacaaaaccccattgcataccatcacatattcagaaagaacaacagatcatgaagtatttcactactgacacgcatttcgggcatccgctggtcagcgtgctgcgcggattcaccacgttcgaccctgggcacacgcagtatgacgctctcctctcctcgcaaggacgcaaggccgccgaggattgggcgaagggcgtggtgcttgacgattcccggctcaatttccgcaaggccgcggacaccgatgcacacgatgaagcaatcgtggccaatatcaatcggattgtcggcgaggacgacgagctgtggattttgggcgatatcggataccgaacatcggtccggcatctgaagagctgcctgcgtcagctgcgctgcaggcatctgcacgcggttatcggcaatcacgatgactggtggctggacaatgcacccgcgcgagatctgttcgaatcgattgagccgaacagcacggcggagctgaccggtctcggaattggccgcccgcaggcgacggagaccgtcaatctatcgcatttcccctaccgtgaggatcttgcctatggctggccggatgatgccgtacgtttccgcgatcaggcattgccgttcgacggacatcgtctgctgtatggtcacacgcaccagctgtctccggagggcgcacgccacgaagccctcaacgttggactggacgcatggaatctgcaaccggtaagcgaaacacagattgccgactggttccatgcacacgcgaccgattcaacgcacgtatcaccgctggatatgcccgactcccccgggccggcgcccattgactccgccgcacagcaggaaccaggcggctcggtttcggcagccgaatcataatacaagcaatattggggcgagcagaaccttatgccatcgctggcacctgtctcgccccacagcacaacgaaaggagcttggctatggcaaagctcattattctgcgaggactgcccgcttcgggcaagtccacgtgggcacgctcatggtgtgaggaccccgccaacacgtggccgcattgcgtgatttctctcgatgacattcggctcatgatcgccggctcggcacaggtccgaaaccgactgcaatccgagcacggcaagcgattcaatgacatggtggttgccatgggacggcacatgattgccgacgcattggatgcggggtgggatgtggtggcagatgcgcaacacgctaatccccggtatgcagccgaactggcgctactcgctcaacgtcatggcgcactgtgggaaacgagggattttgacgttcctctagacgaattgttgcgtcgcaatgcggcgcgtgataccgctgaccgtgttccggaagattacattcgttcgtcctggaagcattttcacaccgcgatgttccgcccgttggaaccgggcgatccgaatggaaacctgttggagcgtatgcgcacggacccttacgttcgggttattccggtgcgcggcgaaacagacgtgtatgcgtgcaatttcactgcagaggcatttcgtgaacatcggtggacggatcgcaccatcaatgcgcgagggctttttatcggcggcaacggtcaggtggtgcaacgcgggttcgagaagttctttgctgtggacgagacggaggagacatcgttcgcccaagtcgtcaatcacgctcaagaacatccagagtcgttgcccgtgcgcgttgagcgcaaggagaacggatttctcgggctcgtgggcgcggcgggaactcctggattgttccgcttctggtcgaagtcggggcaaacggattattccgcgcttatcgagcgcccgtttccttcagattcagcggtacgtgccgaattgtggcgtatgttgcatgagtggaatgtcacggcggcgtttgaagtcatcgatcgcgagtccgaccggcacatcgttggatacgaatcatccgggctgcgcttgctgcatttgattcgtaatgccgaatcgttctccatcgatgccgctcacgaggaaacgttcactcttgccggcggcttcgtgcggccggaaacggtggcgatctgccattcgccggaagaagtcgcccaggcaatcggcgacgccaaggcaagcccgcgtgaaggcgtggtgctatattttgccgacggttggatggtgaaggtgaagtcagaccggtacaagttggtcaaggcgatgcgccctcttatgcaacgcgtgctgctgcgtggtcgttccttcaacaagtccggcgacattgccgatttggctcgccgtatcatcgattacgcacacgaacaccacatcgacctggcctacgagcggcaggcattcggcgagcgcgatatcgatatgaccaaggtcaacgacatcgtggaccacgtgcggtgactgctgagttctagcgcaatatcttctgaccaacgtatgtatcacgaaggcatgtgtcgtgaaagcatgtattgcgctagaaccaaatcattctcgttgaggccggataatgaatctctatgctttgaacatgacgcaccatatgccggcatttccttgcgcgaacaactgttcattacgaacattgtactgatgccgttacagaacagaaaagggtgctgtcctactttgctgacgacgttgcattgaaactcgactcatgccatgtgttctacactccgaacgtggggatccgaggcgtatccagctacgagcacaacttcgatttcctgttccagcgtagcgctaaccatccgacccggttctgccaggcaccgaaccgattcgacaaggacgccgtgaaagacatcatgttcggttgggatgacacgaagaaggatcccaagcgcagggattcccggctgatagtcatcggcgacgaccggcagacgccgttgcagcgcggcgcgctcaccgcgttccgcaactacggtgtgccgttatcccctactccaaattggaagagcgggctcccgtggaactcgccgcgtagcttccgagccatataaggactcatcccgacgactcaccgcgagcaccgggatgagtccttggttcttgtgtttcgccatatgattgagtcatgtcggacgacaatgtccggcacgaagggagaccaatcatgaaaaaggcaatcgcgctgcttgttgcggcgatgttgcttaccggcctgtccgcttgcgggggaagcactacggccgatgcgccggccaaatccgatggcacgtcaaagaccgagaccaataaggaagagcccaaaccccagccggccgatctgaccggcacatggaagcagaccaattccaacgacccgagctcatacatggaagctaccatcagcggcgacaccatcgaggtcgactggatcggcaccgacaccaagagcctctactggaagggcacctatcaggcaccggccgcagccggcgattggaaatggaccagccaggacgacaccgagaccatggccagcgcgctcctcgcctcgcaggatgccaccaaggacttcacctacagtgaggcggacggcgtgagctgggagaccaccgcgctcggtaccaccatcaccgtcaagacggccaagcaataaatcccgtgtcgggcggatcaagccctaaacacgaaaccgccccggtcgctctttgcgagcgccggggcggccctgcgacatatcgacgattagacaatctgtcgcattttcttgactgccgcccacatgaccgtctatcatcatttatagatcagcgacaagaatacacaggtatccttcccctcgaaggatcagctggtcgtattattggattttggcctgtccttcatcgaaagtcggcttcatgccgtcgtcgtcacagcacgactagagttgagacgggccatctattccttctaccattcaggttgcgcccatccgtcgaagttgatggatgctctggtcagaggattgtatttcggccgataatagttctttgatttgaaatatctgctggaatcataaacatcatggaccagcacaatcttcggttcaagaagcccgaagaacttttcgtctcccttctcgtacactcgctggaccgtccatagactgtagtcggcgagcgccaagagaatttcgtgatcatacggttggacgttgaatttggtggtgtttcgcaattcatgcgttaccgtgccgcgacggctgcgctgttgcgcgatgtccacggcatgctgaaggttgaggttcgatgtgctgctgcctcgttccgcgacgtcgagaatcaacggatctatcttccctgagtatttgagtagatgggacatgaggtcggcgtagaattcacgtggttgttcgttgtgcctctgctgatagatcgccggtatcttacggcccacaactactcgtgcggagaagtcgatctcctgcgccatgagtttgaggaattcatagcgtagttccgcaggatctttgctggcatgcgggtagaagccgtgccatccctcctttgttctcttttggacgctgggaaagctctggaagaatttgctgctgttgatctcctcacaaaaaccgtcgatagtcgcacgagcatcgtcgaggggacttttcacatgtacgagcccgatcatgaagcatcgggaaactccgtccatcccgatggaggaggttttgcggccccgcttcccggaatggaaggtcatgtcaccggcctcatcgataaatcgatgatggtcctgtggcccgtctactttctttatgctcatgcggacaagtctactatgcgtcacgttcgtcatttcccctcctcgatgacctgcgcgtctatcacatccctctcgtcgtgcaggtcagggatggctcggtcgaggagcgcggcgagactggccgcgtccctgtgggtgtagtggttggtcacgctgatgctggtgtggcccatgatggcggttctggcgtcgtcgggcatgttggcgcgggcggtcatgctggcggtccagtggcgtgcgctgtggatggtgaccggcgggaggccggcggctttcaaggccttgttccagttgtagcgttcggtgctgctgcgcacggggttgcctcgtgagttggtgaatatgaggtcgcgtgggcctatgtcgagtcgtttgatgcgcgcccacaatcgttgccacaggctcgtggatatgggtacgaaccggtgggcggcgtgggttttgggtgtggtgagccacaggataccgtacaggtgctcggctttgagccaggcgggtatcacggcgtcctccggtttgccgtattgctggatctgctgctgcacgttgatgccgggcacgccgtcgcgttgttcgagctcgtagggcatgagcgcgtagcgttcgccttccctcatgccggccgcgaacgcgagttcgaacagcagcatccaggattcgtcaacgtccacggtcagggccggtccgcgtcgtttcgctccccggttgggcacggcctcgatcagctgcttcggctggtctggcgagaggatcctggtctcggtgggctccacccttggcggcttgaccctgcggcacggatccacggggatgagctcctcgagttccgcctggtcgagcatcatcttcaggctcacgaaatggtccttgagcgtggagggcgcgagccgtttggaaagcacgcgcatgcattggcggatatggtcaggggtcagctcggtgaggcggatacagccgatgacctccatgcacgcatgaatcctgccggcgcgggtgcggtacgtggtgggcttgacgttgagccggtattcctccagccaccgctccgcgtaatccttcaggtacgggctcttggcgccgggcagcaggccggtgcgttccatctcggcgaccttcgcgtcgaaccgttcgcgggcatcggccttcgtgcgacccttggccgagacatagcgtgtttgtgttcaattagttgttgcgggtttagtcacgatgatttttcgggtttaggcagagcatgccgaccacggaatggtcttaactggatggtgcttgtatctccgccagaaaggaccggaaaggattatgatcagcatgccccaagtacagtctatccgtcgtttgcggcggaacggggaatccgtcgcgtcgatcgcgcggaaaacacatgtcagcgagccgacggtgcgtaagtacctcgcgaaggaggatctgtcggccgtgccgtcggtgagaaagccgcgcgcgtcggtgatcgacccgtatctgcccgtgatcgagcagtggctcgcggaggatcgcgcgaactggcgcaagcagcggcataccgcgaccaggatctgggagcggttgagggacgagcatggcgcggaggtctccctgtccacggtgacgcgggcggtggcgcggctcaggcgtgagttcgcggcggagcgtgatgaggcgttcatggatctggtatggcatccaggcgaggcgcaggccgatttcggcgaggtcgacgtgctgttgcgcggcgtggtgcagcggatgcatcatttcgtgcttgatttcccgtattcgaacgtcggtctggtgcagttgatgccgggcgagaacgctgagtgcacgtgcctggcgttgcgcaacctgttcgagtggctgggcggtgtgccggagcggatcgtgttcgataacgccgccggcgtgggccataaggggtacggggagcgcgagccgcgcctgacgcacctgttccaggccttccaggcgcattacgggttcgattgttcgttctgcaacccgtattccggtcatgaggagggcgcggtggagtccaaggtcggcatggtgcggcgcaagctgttcgtgccccggccgagcgtatggagcctggagaacttcagcgccgggctgccggaccggtgcctggagctggccacgaaaccgcattgccgcaaggacacggaggaacgtggcctgttctccgaggaccgtgcggcgctgctgccgttgcccgggaagcgtttcgacgtggtcacgtggcggcatatgaaggccgaccggtacggcgtggccgcgcccggggacggcatcgctgttccgcggaccgggcgaacgcgggcagaggggtgatcgtgggcctccgcgcgctcgaggtcgaggtcctcgactcgtcgggcaagcatctggcgacccatcctcgggcgtacggccaggccagcacgaacagcgaggacccgtccatgcagttggcgctgctgtgcaacaagcccgcgtcctggcccaacagccgggtacgtgacgcgttgccggacccgttgcgggaatggctggatcggcaggacggacagacacgcaacgaggcgctgcagaccctcaaacgcgttgacagggaatccgggtgggcgaacgcggtcgaggcgatgctttccatcctcgaatcgaccggcggggcggaccgcgccggtgtcacactgctcgcggccaggctcgccgagggcgtggcgggtatcgaatacgacgatgacaggccggatccgggtgaatacgacatcgcgttcaccgcggacgtcggcgtgcaggaaggcgggcgatgaacacgaagacggacgaagggctctacgagaaggcccgcaagctgttcatctccaaggcgagcatcgacgaattcgccggctgggccacgccccgccaggtcgacgccgtccaccgcctgctcgacacggaactggcgaacagggaacgcgcgaagcacgacaggctcctgcgccgcgcccggttccccgtcgtcaagggtctcgacggctacgacttcacgaacgtcaggctccccgacggctacatgctcgatgagctcctagggctcggtttcatcccgcgcgcgcaggacctggtgttctacggcaagaccgggcgcggaaagacacatctcgcgatcgggctgggcatgaaggcgatcgacatggggctgggcgtgcggttccatcagaccgccgagctcgtcctccagctgggcaaggccaaacgcgacggcacgctcgagacgatgctccgggacatcggccgtgccgacctgatcatactggacgagttcggctacgcacccttcgacatcgacggggcgcgcctgctctaccggatcatcgcgggcagctacgaaagacggagcatcatattcaccacgaacatcgagttcagtaaatggggcacggtcttcgcggacgacaaactcgccgcagcgatcatcgaccgcatcgtgcaccacgggcggctcctcgagttcaccggccagagccgccgcgtcagtgaggccctcatgttcggcaggaacacctccgcgcaaccggaaaaataaggaaaatgcatgcaactgcctaaacccgaaaaaaatacatgactaaacacgaaacaccgacttgacgaaatacacatagcgtcgtttgcccgtggcggggtcgcggccgacctcacgccggaactcccacgagccatccttgcggtggatgatgcttcccgcacccttcgtgcgtcgtctgccgttcgtcgccatgatgttcctcccttgtcgggagcgccttcgagcatccgctacaagcgccctcaaaaagggcactctattggcacactatccgggccacaaacggccagatacggggcataatcggccattcttcaataatcgaaaaacggcgcaattccacagttccgaaaactcgaaaacgttggaatcacgccgttttctggggtgttcacaccctacttggacacattgaacttgaactccacaatatctccgtcggccatgacgtagtcgcggccctcctgacggagcttgccttcctccttgatcttggccatggagccgtcggcggccacgaaatcgtcgtaggagacgatgtcggccttgatgaagcccttttcgaagtcggtgtgaatcacgccggcggcctgcggggcggtccaacccttgtggatctgccaggcgcgcacttccttgacgcctgcggtcaggaaggtctgcaggccgaggatgtcgaagcccacgcgggccagctggtcgagaccggactcgctcaagccagcgtcggccagcatttcgcgggcatccgcctcgtcgagctcggtcaggtctgcctcgaactgagcgttgaggaacacggccggagccggagccacggatgcggcgagcttagcctgcaggtccttgttggccagctcgttgtcgtccacgttgaacacgtagatgaacggcttggcggtcatcagatgcaggtcgtagacggaatccttgtcgaagcggccttcgcgtgcggccttgtcgagcgtctcgccggcttcaaggatggtctttgcctgcttgactgcgtccatgtaggccggctcgatcttcttgccgcgcagatccttctccagcttgggcagcgcgttttcgatggtctgcaggtcggcgaggatcagctcagtgttgatggtgtcgatgtcgtcggccggatccaccttgccgttgacgtggacgatgtcgtcgtcctcgaaggcgcgcacgacctcgcagatcgcgtccgcctcgcggatgttggccaggaacttgttgcccaagccttcgccttcggaggcgcccttgacgatgccggcgatgtccacgaaggtcaccgtggccggcacgatcttctccgtgttgaccagcttggccagcacaggcagacgatcatccggaagcggcacgataccggtgttcggctcgatggtggcgaacgggtagttttcggccagcacgttgttgcgggtcagtgcgttgaacatggtggacttgccgacgttgggcagtccgacgattccgatagtaagagacatgattccaagtctagggagaagctggacaccttgaacctgcatgtggtgaaccggccatatgcaaaggcctccgagcatacggctcgaaggctttgactgtgatatgcgaatatacgcgaactctgattggcagtcagccgacgatggcatcgacggcgtcgatgaccgagccgcggaaaccgtccttttcgagctgggcgacgcccttgatggtggtgccgccgggcgagcacacggcgtccttcatggccccgggatgggtttcggtggccatgtagagcgcgccgacaccttcgaccatcttggcggcgagccggtaggcggtggctcgctgcagaccgtactgcacgccggcgtcgcccaaggcctcgatgtacatgtcagtgaaggcgggcgcgcagccggccaccaccatggcgatgttcatatgcgcggtgtccacgcgctcgatgaggctgatcggcccgaacagctgctcgaaggtttcggtttcgtcgtcggtcagggtgttgacggattcggtgacgagcacgcccttgcccacagccatcggagtgttcggaatggtgcactggatatggatgtccgaagagtcaacggattcgccgtcttcggtggcgaacaggtcctggtacttcttgagattccagccggcggcgatggagacgacgatcttgcccggcttagcaagttcgtcggccagcggcttgacaacggcggcaatctggtagggcttgatggcgatgatgaccacgtcagcggccgtcaccacttccagcgcattgtgcagcgggcgcacgccaagttcggcggtggtcttctcaagcttgtcgtagtgggcagcacaagcgaccatctggccgccggtgaccacgcccgcgtcaacgaagccctgggcgatggcctgggccatgttgccatatccgataaaaccgatggtgaggttctgagtcatacgttttcctttcgtgcatgtatacagagctccctcatcagagggagctcgcttccttgagtcagaacagttcttcgaggtcgcctcggttgagggcttcggtgtagaggtgcttgaagacgagcgagccgtgcagaccgtcatgctcgaattcgttggtggtccagtagtggctgttacccacgcggctcaaggtgtcgagctgcataccggaatcgacatacatgtcgtcgaagtaaacggcggcctgcagcggcacctcattgcgggccagctgttcttcgtcatagatcacgccgaagtgcgtgtcttccatgagcaggtccatggccggcctgaacgggcgtaacgcagactcctgttcgaacatccacgggaacatggcctcgccggtgaagttgagcgggcgttcatcagcaccgaattcgggcttgccatcgcgcacgcgctgggcggcccagcgaatcggctgttccatctcaccgttggcgtagatgaactcctgcagcggccagtacagcgggcgcgacgaagtggcgttcatcaccttggtcaaaaattcgtcagacaacggcgagtcggcagaagcggaaccatcgccatcaaggaaggcgtcgtcaagaatccaatggacacgctcgaagctcggcttcatgccaaagtcggatcccaagcactggaagcgttcgacggtgagcgggtcgccgttcggcatcagcgggaagccgtgggcggccatgccggcgatcacgccaagtcgatgctccacatcggtaccagccatcggattcagtaccgaatcggtgagtttgccaatgaattcggcgacttccgcagtagtcggcagcttgtcggcgatggcggccacgcgctccttgtcctgtgggtagcgctcgtagaactgagtcgtcttgcgcaccatgcgcgggaaggtatgctcgtacacttcagcggcgtcggccggcacgtgcgggatgccgccggtggtgaagctggcgattacgccggccgggaacagggacagtgtggtcagggtcaggaagccgccgtagctttggcccatcgtcacccacttgcggccaccgaattcggtcaggcgcagatgttcgaagtcacgcacgatggaatcggcaaggaacttcttcagatagtcggcttgggctcgtgcgccggccgcggcatcatcgtcgtgcgcggcggcgatgcgggccatggcgtgcgtgtccacacgcgaggagcggccggtgccgcgctgatcgggcagaatcacgcggaaatgcttggttgcctcctcaatccagccatcagaagtcgggctgttgaggcgagggccggcaccgccgggaccgccttgcaggaagatcagcaggggcaggtcgtcatgcacgtgttcgggcgtggtgaccacgcgatagaacagtttgatggtttccccgtcgaacgcccgcccgggctcgtggccggtccagtcgagcggaacatcgatggaatggtcctctatggccagtccgggcacatagtatttgctcagcattgtcatggttcaagactctagtccataaatcctcctgaagagtgataccggttcgtcgccggacacgctagcattgtgcgttatggagatgatggcgcgcgtgagggcatggtgcgcacgggagtcgacccgcacactgctatgggacacgttgctcgccgcggtgctgatcgccggttgtgtgccgttcaacggcgtcaccaaccctgattcgacgggcggcatattgtttcccgcaactcaggcgtcgatgacgctgtggtcgctgccggtcttcgtgccgctgatgctgcgcaggtattgcccggagccggcggcctggctgttcgtggcgctgaccatcacgcatcttgtgttcggcccggcgatcacgtatttcgatttctacgccctgatcatggtgtattcggtgattctgtacggcagtccccgacattcctggcggttcatcgtcacggcgttcgtcatgggactgatcacggcgacggtctggtcggtgtctttcaacgtgggtccgctgtttgccgaaccttcctccggttcgcgcaccatccgcgacggctggctggccgatgccatcacgatgcccacatgcccggcggtcaccggcgtcgtgggggcaagcgccgccgtcaactgcggggccaagatgctcgctgacgtcggcatggaggcggcgctcatcgaatcgagcgtgctgagcattatcatcatggccttgtggcagcgtgcgcgcaaggccacgctcacggccatgcgcgaacgcaatgcttccatcgtggcccgggaagcagaggagacgcatatcgcggcgctggccgagcgtgcgcgcattgcccgcgatatgcatgatgtggtggcccatacgctctccacgattattgtgcagtcggatggcggccgatatgcgggcgcgcatgatcttgccgtcgccaggcatacgatgagcacgattcgccatgaagcggaacgcgcgcagcgtgatatgcagcgtctgttcaatgtgttcggtgcgagtggcagtaccggatatgccgacatcgattcgctgtttgatggccatctggtggtgtcccggcatatgaccggcaaagcgcaacctgaccggctgtccgccgacgcggaaaccgccgtgttccgtcttgtgcaggaagcgctgaccaatacgcgcaaacatgcgggcgagggtgctaaagccaccatcgatgaattctggtcaaacgatgtgctgtcgattaccgtatccgataacggccgtggcgcggcgtctgcagcagacggtcataagcccggatacggattggttggtatgcacgaacgcattgagtcgttgggcggcagcgtgcaggccggcccagggccgaatggtggctttattgtggaggctacgattccgctctcctctgccgccccacagtctggcaccgatgcggaggatccggtgctaaccattatctcgcgtatacgaggattgatgaatcgggcgcgccccaaagtactcgaccaaggagatacgcgtgagtcgaactgggtgggtcgatttgcgcagtggaccgagcggcactatcttctgatggacgttatcgccactatcgtgctgattgcgctatttgattccgccacgtatggcgatttgcaaatgatcggcaatgccccgtattcgccgaaccgcgtgctgactatagcgctgacgattattatgctttcgcctttggcgttccgccgccgcttcccagagggcagcgcactggtcatggcgattctgtccgccgtgcagctgctgtttctgccatccatcctgaccgtcaacatgttcgcattggtgtccgtgcatgccgccgtgctgtatggccgcgaacatgcgtggcgctgggtcagcgtggcactggttgcggattcgtggctggccggcatcaagataatgtccggctggaacggctatgggatgctgattcagatgctgctgcccttcaacggcgaatcggcgatgtcccgctggctgctggtgctttccggtctgatgccgggtggcgtggtgatgctgtttggctttgcctgcattgcgatggcccggtggagccgttcacgcggttcgaacgcgctggtgctcatgcaacgcgaggaagcgctcaaggccgagcaggatcggcagaaggtgctggccgccaatctggagcgcaatcgcatcggcacggccatgcaggccgaggtattgaatacgttggaatcggtgatcacgcaagccgatgatgggctggccatgctgaactccgaaccggctcccgatagcgagcagatcatcgccgcgttcacggtcatcggggaacgcgggcgtgcggctctggcgcacatgcggcaattgctgacggtgctgcgtgaaaccggattcagcgacgagatgcatgaaggcgcacaacccgacatgcaactgcgaccggctgctcctctgtccagccagatgaggcaggcggaatccacatctcagacggattcgtccacgaacatgaactcagggaacaatcagggtgtccatggagcggcgctccgataggaaacggatacagtggagagcatgaacgagagcagaagcattcgcgtgattattgcggacgaccaggagctggtgcgtgccggttttgccatggtcattggttcgcagccggatatggaggtggtcgggcaggcacccgacggcgcccaagccgtggcgttggcggaatccctgcatcccgacgtggtgctgatggatgtgcgcatgcccagcatggatggcattgaggccacgagccgtattacctcgctctccgccgcgccgggcgacgcggccgattcggccagtctggccgccgacgcgaccgtctcggccgaatcggctgacgaccggccgacgcgcgtaatcattctgacgacgttcgatttggacgagtatgtgatggcggccatcaatgccggcgcctcgggcttcctgctcaaggacaccgaaccggaaacgttgctcaattcgattcgtactgtattccaaggcaatgcgattatcgcgccttccgccacgaagcgactcatcgaaaagatgatgcaggacggttacgcgcagcatggttcgttgggtggagaaaccacacactccggtgccgtgtacggttccgccggcggcgtctctggcggtgcggccggcaacggtgctggctcgatgaccggcttcccctcccctgccggagccgcttccgacggttccaatacgtcacgcccggcatacaccgatcccgaactggatctgcttaccgaccgcgaacgcgaggtgctggtggagatcgcccatggtctgagcaatcaggagatcgcggacaagctcttcatttctctgcccaccgtcaaaacccatgtggcacatattctggccaaaatcaacgcccgcgaccgcgtacaagccgtagtcttcgcgtacgataacgggctggtgtaacaaagctccctctgatgagggagcttattgccctacgcctcggccaaagcctcgacgggtggcgtcttgacggctcggcgggcgggagccacgctggccagcagagcggcgagcgcggcgacgccgagcaccacaccgttggtagcccattcgaacgggaacacggtgtcgccgtacaaactaaacaccatgtaggatccgagccagccgaacagggtacccagtaccactcccaccacgccggagacgagcgaaagcagcaacgcttccaccgccagcgagcgccgcagttggccgcgcgtcatgccgatggcacgcaaggtggcggattcgcgtgtgcgttcgatcaccgacagactcagcgtgttcgccacaccgaccaaggcgatgagcacagccaccgcaatcaaaccgaccaacaatgccatcatgccgttgatcatggtctcccattgagtacgttcggccaccggaccggtcacggtaacacccgcactggcggagaacacattctgcacgttggtgaatacgtcgttcaacgcaacacccgcgccttcggcgtcaatgcgcataagcatgatatgcccgtcggccttgatcccaccgttggtgaagtggctggcgtccacgaaggcgaccgcggcgtagttggaggcgatgcggcgatagtccaccttccgcggtttgagcgtcagcgtctgtgtgccgccggattgttcattgccgttttcggcgctgccgttcgcatcattgccggacggaccattggcggcatcggcttgtgcttcggccgctccagccgtgaacgtaacgctcttgtccagcggaatatccttgcctgtagcggcggaatacttgggcatcagtacggaatcgccatcaatggtcacaccggacaaatcggagcgcaccaccttgcgcagcgcgtcgacgccatccacgcccacgaccagcacactcaggctcttgccgtcggcatccttcatggtcatcatgcgggtcggcgcgtagataccgcgctgaacgcccttgactttggctgcctcgctggcctgtttaccagtcatatcggtgccagcggcaatcatgtcgacgctgtagcgcgtggtcagcgcctcgttcatggtttgcttggcgctggcggcaccggtggcgatggtggagaccagcgtcacgccgataagcagtgcggcaccggtggcggccacgcggcgcgggttcttctgaatgttcgcatgtgccactttggcggacggaccggccagtgcaaccatcgcgcccacgccgcgcatgagcaccggtagccagaacgtggcggaaagcaccagtccaaggaagatcaatgcacatccgatgatggcggcgagcagcaccagcggatactgcttgtcggccattgaatcacgtccggcgatgttctcggacatctgccatacagagaatgcgcacagtgccacgccggccacaatcagcagcacggaaatcacggcgcggaccacaccggcccgtcgcgtgtcggtcagttcgatgggtcgcaacgcttccagcggggtgacggcggtagcggaacgcgcagagcctagcgaggcaatcaccgtcataatgatgccgaatgccataggcaccgtgaacaccggaccggatagcaccagtcgcatggtcatgccggtggctttcatcaggcccgactggcatagtgcggccatgagtccgatgcccaggcccactcccagtgcggaggcgatcagtcccagcacaccggcttcaaacagcacggagacatacagctggcttttgttcgcgccgatggtgcgcagcagggcgagtgtgcggcggcgctgtgccacgagcacttggaaggtgttggcgatgacgagtgccgcgaccagcatggcaagtatgccgaagctcagcaggaagatggtggtgatgctggtttcgcccgagctcatgcttttgacggattcctcgacgagcgcggcacgggattgcacgctgaaatgcttagggagcagtgtgctgacctgtttcacggtggatgccgcagccgtgtcactggcatcgtcgatatcgagatagacgaggtagacaggcaggttgccgaaatcgttgctgccggccatcgcggtaataacgttgtcggaaagcacggaagcgccaccgtagtaggcgtaggcaccgttcgggtcgtcggtaaggcctaccacgcgcacggtcatgccggagtcggcagtgttggcgccatcggatgagacggacgcaccggacgcggcatcggaatcaccgtcgtgcgagctcgtgccatcggcgttctgggccgactcatcaccagcgtcaccggtattaccggccgaatcgccggtcttgcccgcatactgcgccgcctgcgagttgacggtcacacggtcccctaccttgacgccaagctggtcggctacggacttggtcagggcaatctcgttgctgtccgccggctggtctccttgcgtgatggtgaccggcagcagcgtacgttttgcggcggtggtgatgacgtagctgctggcatgcttgttgccacgggttacggtcacggaacccgcgtagctggcgcgcgcgtccttgacgccttcggtggcgcggatgcggtcaagctggaagtcgttaaccgtgcgcgtgtagatgtagtcctgatccttatcggtcaggtccttgccgctatccgggctgatcacgtagttcgcgccgccgagctgggcggtgttctgagcggcaagcgcatcgttcatcgcgttgccgaacaggaaggtagcggcgatgaacgcagtgccgatcaggatggcgatgcctgccggaatcagcatcctggcgcttttcttcatgagtttcagagtgatggaaaacatgggggtgtcctgtctctcgctttccggctcagcgagcgtgctgggcggcggcgcgggcatggcgcatggtgccggttctcccagctgggggcaatggagcgtcggtgatgggcaggttgggcacatcctttacaccggcaagacgggcgagcgtgtcggcgcgtgtgctggtgacggcagtgcgcgtggcgcgttcgcgttcggccataagcagctcgttcatcgtttcggcagtgggattcgcctcgtcggccacgatctgtccgtcggcgaatacgatggcacggtcggcgtaggaggcggccaccgcatcgtgcgtgaccatgacgatggtttggccaagctcgttgaccgaacgcttcaggaagccaagcacttcggcgctggaaacggagtcgaggttgccggtcggctcgtcagcgaacaccagcttcggcttggtaatcagcgcgcgggcgatggccacgcgctgctgctggccaccggacagttcattcggtcggtggttcaggcgctgcttcagtcccagggtatcgacgagcaggtcgaaccaggcgtggtcgggcttgtctccggcgagagtcagtggcatgaggatgttctgttcggcggtgaacatgggcaacaggttgaagctttggaagatgaagccgatcttgtggcgacgtagcaaggtgagctgcttgtcgtccatgcgggtcaggtctgccccgccgaaaagaatatgcccggatgtggcggagtcgaggccggcgagcgtgtgcataagcgtggatttgccggagccggacgggcccatgatggcggtgaatttgccgcgttcgaaactcacgttcacgccgcgcagggcatggaccatattgctgccagcgccgtagttcttgaccaagtcgacggcctgaatagcgatgccgcgcgatgcggccgggttctgcacgttcataatgtctctccatatttggccgggccttatgcccggatgatgattccaacttatgaagaaataacggcgcgccccatcgtgcgccagactgaattgggcggtcggccacgcgccggccctcatccttgaggattatgtcgtctcaggtctcacactattcatgcctctgcgcaaacagtgtgaggcatacagacgcaagaaagcccgcactgcatgacatcagtgcgagctttctattccttgggtcaagcgatcaggcggaaggcaccccatgcggctcgatgattcgtgatgcaccccattagcatcgcgccccttctcatcgggccgtcaaccttcctgtcgacctcacttggccaagccggaagcgcgaagggcttcgaagccgcccttcaggtcatcgaggatgtcctcgatgttctcggtgccgatggacaggcggatggtgccttggtggatgccctgatcctcgagctcctccactgtctcctgggagtgcgtggtggaggccgggtgaatcacgaggctcttggcgtcggccacgttggccaacaggctgaacaggtgcaggttgtcgatgaacacgcgtgccgcgtccttgccgcccttgatgtcgaaggtgaagatggagccgccgccattcgggaagtacttcttgtacagctcgttgtccttgcggccttcgatggacgggtgggagatggactcgacttccggaacggtcttcaggtaatcgatgaccttcagcgcgttctggacgtggcgttcgacgcgcagggacagggtttcggtgccctgcagcagcaggaaggccgcgaacggggacagggtggcgccggtgtcgcgcagcaggatggcgcgcacgcgggtcacgaaggcggcgccgccgagggcctcatagaagttcaggccatggtaggacggatccggctcggtcagggtcgggaacttgcccggcacttcggcccagttgaacttgccgccttccacgatcacgccgccgagggtggtgccgtggccgccgatgaacttggtggcggattccacaacgacgtcggcgccgtgctccagcgggcggaacaggtacggggaggcgaaggtgttgtccacgatcaccggcaggtggtgcttgtgggcgatggcggtgatggcctcgaagtcgggcaggtcggcgttcgggttgccgaaggtctcgaagtagacgagcttggtgttctcctggatggcgtcctcgaactcctgcgggttctcggcggagacgaaggtggtggtgatgccgtcgcgcggcagggtgtggcgcagcaggttgaaggtgccgccgtacacgttcttggctgcgacgatgtggtcgccggactgggtgatgttgcgcaccgcgtattccacggcggccgcgccggacgcgacggccaggcccgcggtgccgccttcgagggccgcgatgcggtcttcgaacacgccctgggtggagttggtcagacggccgtagatgttgcccgggtccgccagtccgaagcgggcctcggcgtggtcgaagttgtggaagacgtaggaggtggtctggtagatcggcaccgcgcgggagtcggtggccgggtcggcctgctcctggccgacgtgcagctgcagggtttcaaaacggtacttcttgttgttctcggccatggtattctccttggttgtgctaggtcgcgaggatttttccttgccacccgcctgccgtgttcgggcggttggcgaggtgttggttatgaagttacgacgcttgggccgcgcggcgcaagctgaacgttatcggacttgcctataagggcttataaagccttggaatcattgacgtgagcgactgtcagaagtcacgaaaaagtcgttgaaattatcgcgacacgccgggccgcacgcatgcgctttcaaggtcgactgcggtcacggtgatatcgctgccatgcctttcgcgcatggctcaagtgtccgtgatgattgcttgttccacccgtcaccaagacggtttgcccgctcggtgatgacgtctgtttcatttttctgccgcccggttacatggtttacatgacgaacgactacagtcaaacatcgccaatgaattattccgccaacatggtgaagggattcgaacagacatgaccgatgtaactctgtatgaccgtgatccgaactatattccgcgcgtggccgccgtgcacgacatgtgcggctacggcaagtgctcgctgaccgccgcgattccgattctctcggccgccggctgcgatgtgtgcccggtgccgaccgccctgttctcggcgcacacacgctatgcagtgttcacgttccatgacaccacggatattctctccggttacttggatgcctggcagaaggaagacgtggagctggatggcgtgtattcaggcttcctcggctcccccgatcaggtggcgatcattcagcgtctctaccgcgaatatccgaacgcgctgcgtctggttgacccggtgatgggagacgccggcgaaatgtaccccacgtacacaccggagctgtgcgaggcaatgggcgcgctggccgatggtgccgacgtgttgatgccgaacctcaccgaagcgagcattctcaccaagcgtgactatcctggccaggatattgatgaggccacggttaacgagctgcttggtgctctgctggagttgggtgccaagaacgtggtgctgaagggcattgaccatggcgatggcaaaatcgtcaactatgtggccagcgcttccaccggtgttgccggcaagatcgagctggctcatgagaagttgccatacatgattcatggcacgggtgacgccttcgcctctgccctgtgcggcgcggtgatggccggccgcggcctggccgagtcggccgaaatcgccggtgagttcgtgcgtcacgccatggtcagcacccgtaaccagccgcatttcgaggatcgtggcgtcagtttcgaactgaaccttggcgaactcaccgatttggtgaagtgaccgcaccttggctcccctctccgctcactgggtctgacgtattcagcgaacaatccgatgggttgttttttcgtcacagggaagtcgactggtgagccttggtaaaccttctgaactaatggtggataaccgagttttcatccacacgttatccacaacacgccaaaccgcgtcatagtatccacatttgccggttgcgcttgtgctcttacataagtaacccgcacagtggaatcatgaacgctttaccacctactcagccgacgacgaagtccggcatcgacgccggtcttgcctttcaccagcccatgctggcttcacctgatccgcaggcaatgctgccttcggaacggattgcggccacgatgggcgaccgcaatctgacgcccaaacagttcggcgcgctcggcgagcagtatgccgccgcgtggctggaggaacacggttggacgaccttgagccgcaattggcatacccgttacggcgaattggacatcgtgatgctcaatcccgagtacacggtggtgttcgtcgaagtgaaatcacgccggtccatgcattacggatatccgcaagaggccattacgccggcgaaacagcacaatctcaggaaagccgcctgcgattggctacttgaccggcgtaatcgggtgccgcattcggcggtccgtttcgatgtcgtcaccatcgtgcttcgggtgggcaggccgctcgtgcatcacattgaaaatgccttctgaagcccccccaaaaaaaaacagccacgttgcgaaacacattgtgaaaggagtagacatggctatcggcagcaccctctcagtcggactgatcggccttaaggccttcatcgtccaagtgcaggctttcatcagccctggcttgccatacttcagcatcatcggattgccggatgcatcgttgtccgaagcccgcgagcgcgtgaaatcagcgtgtcaagccactggattcggttggccgcaaacccgtgtgaccgtgaacatgagccctgcggccatgcccaaacgcggttcgtcgcatgatctggccatcgcggccagcgtcctatgtgcggcgggtgccatagggcatgattgcctagaagataccattgtgctcggcgaagtgaatcttgacggctcggtgctgccgattcatgggctgctcccgatcatgctgcatgccgaggaacgtggcgtgcgcaaaatgattgttccccatcgcaatcttgacgaggcttcgatggtggatggactggatgtagtgggcgtgaggcatgtgggtgagctcatcgaactgatgggcggcgatgccacctatacgattcccgatacaccggttaccgacgagaccaccacggatcaatcgcccacaagtcatcccaacgattgtggcgatatgaacgaggttctgggtcaggagcatgccaaatgggcactgcaagtggcggcggcaggcgggcataatctcatcatgaccggcccgccaggcagcggcaaaaccatgttggcctcacgtatgcccggcatcatgtgcccgttgaacgaggcggaacagctggaggtggcatcgattcgatcgctgtgcggcatactgcctcagtacggcatcaccgacatgccgccgttcgaggcaccgcaccacaccgccagcacggcggccttggtgggtggtggcagcggcatcgccgttcccggcgcaatcacacgcgcgcatcgaggcattctgtttctggacgaggcaccggaattcagcgcacgcgccctgcagacgttgcgcgaaccattggaatccgggtatgtggcgctttcccgttcaaaaggcagcacctactacccggcctcattccaactcatcatggcggccaacccctgtccgtgcggatactattacggcaccggcgaacgttgcgcttgccgggaaaaagaccgtatacgttatttctcgcgattgtccggaccgatactggatcgtgtggatattcagatggcggtgccaccagtctcgcgcattgccgcgcaaagcgagccaatcggcgagtccagtgccgggatacaagctcgtgtgattcgtgcccgtcaagtggccaaagaccggttcagacagtatggatgggtgtgcaacgcgcaagcttcgggcaaatggctgcacgccaatacatcgctgaaagcgatggaattggtcaatcgggccctgtccaatcatcaactcacattgcgcggggctgatcgcgccatgcgtctgtcttggacgctcgccgatctggccggccgcgtatcccccactgaacaggacgtccatcagggcatcgaaatgagaacgaggatgacatgagtaacgctactgatatccggcaatctggcggcaccgcaggaagtgtggatcacaccgatacgagtctcgccgtttcgcgcactattcccgtacctcccacggatacgttgtatcgtgccgcgctcacgttctgtcttgatggcgcggatgtgatgatgtacgccacgctcaaaggcgcggaaaacgccgaatccctctggcatgcgttggcgcaatcccatccaagccagccatctgaaatctgcggcccggcgctgtcacgtattgaccgcatgttcgtggacggcctcactcgatggggccgcaaggcgtcggcgaacgcgatgcgctccttccgcaatgcactggcctgctggcataaccgcatgatggacctgccctcgcaagacatcatccaactggccgactggttcactatggatggcacgcaatggattatcggccctggccatccatgttggccctcgcagttggccgacctgtccattcgctccgattgggcgccaccgctgtgtttgtggatcaaaggcgatccacgcgcattgaccagttgcgccaaaccggtcggcatcgtcggttcacgggacgtgaccgaatatggccggtatgtggcacacaccgtagccgaacaggcagccgttgccgggcatctggtcgtgtccggaggcgcgatgggcacggatgcggcggcacattggggagcgttgaatgcgctgcacggcagaatgcccgccaatgtgggcaaaaccgttgccgtattcgccggcgggctcaaccatatcggaccgatgcgtaaccgcacgctgttcgaacgcatcgaggcgcagggtggtgcactgatcagtgaactgtgccccgggacgattcccgaagcccgtcgttttctgcttcgcaaccgcattatcgcggccatgtcttccacattgattgtgacgcaagcccggttgcgttccggagcgctcaacaccgcgggatgggcatgcgaattgctgcgcgaagtgtatgcggttcccggtgacatcaatcagccttgcaacgccgggtgcaataagatgatcggcgaccaccgagcgatgattctgtgtgccgccacatccaccgaggatatatgccatgaacggcataagcccgttatggcagcatgcccaggcatatcgaaatccacaggtcaggactcgtccgaaaacgaggaggccatggaagtgccggcaacgactccgttatcgccagcatcctcggaatcatcggcgtcacaggagtcgtcacaagattcaggtcattcgaaacgttcgaagaccaagcatactcagcctacgcgcactcaatccaaggatgggccggcgagcgcaactgccgattccggtaacgacaaaagcaagggtgaagagcttccctcgtcgcatcagatgccggatcttcgtgtcaagccgaagcccgatcccgagaaggaagcccaacaacgtatcattatcgccaagctgccggaaatggaacgcacattagtggcattgattcgtgaatgccgtaaacgacatctcatcgtcaccccggacgcactattgcgtgtggcgcgagagacggtacccgacgagattcccaatatcggcaccatacttgagctactcggcgcattggagctgaagggagtgatcgagcgggatgccggcatactcaagctgagcagccgtgtcggctaatcggcttccatgacacggctcgaaggctgttcggcgggtgtgcgagaatcgaacccatgagtccgaaacgtttggaagatatgtatgatgcggtgatcgtcggcgccggagcggccggcctgtcggcggcgttgggactgctgcgctcccccgagatcaccgagctcaaggaacaaggcgtggacccgaagatcctcgtggtctccaaactgcagccgctgcgttcgcacaccggttcagccgagggcggcatcgccgcgagcctgggcaatgtggagtccgatgactggcactggcattactacgacaccatcaagggcggcgactggctggtggaccaggatgcggccaaactgctcgccgaatacgcgccgcagaccgtgatcaacctggagcgtcagggcgtggccttctcccgtaccgaggacgggcatatcgcccagcgccggttcggcggccacacgcgcgagttcggcggcgccccggtcaagcgcgccgcctatgcggccgaccgcatcggccaccagattctgcacgccttgtggcagcagtgcgtggccgccggcgtcgagttcgccgaggaatggtatgtgaccgacctggtgctcgccgacgacggcaagcaggcggccggcatcgtggcctttgacacgcattcgggcaagattcaggccatccacgcgcgcaacgtgctgcttgccaccggtggcgcgggccgactgttccacaccacgtcaaattcctgggatctgaccggcgacggcatggccttgaccttggccgccggtctgcagctggaggacatcgaatttgtgcagttccaccccaccgggctcgcgcacaccggcatcctgctgtccgaggcggcccgcgccgagggcggcattctgaggaacgccgacggtgagccgtttatggaacgctacgctccggagcataaggatctggccgcacgagacgtggtctcccgctccatcatggcggagatcgacgccggtcgcggcgtcgccgacccgaaggacccggatggtccgaaggactgcgtctggctggatatgaccggcatcgaccccgaacgtatgaaggaagtgctgccgcaggtggtcgaaaccatcgagcagtacgcgaacctcgatccggccaaggacctagtacccatcaagcccactgcacactacacgatgggcggcatccccatcaccaccgacggcgaggtgtaccgttgggccgacggtgccgtgcaggtagtcgatggactgttcgccgctggcgaatgctcttgtgtctccgtacatggtgcgaatcgtctgggcggcaattctctgctcgacgcctgcctgttcggcacacgcgctggtcagacgatggccgcacgcatcgccgagaacccggttgactcccccatggccgatgattcggccgatgacatgctgaccgatgccgccgatcaggctgccgattctcgcaaagcggagcttgacgaactgctcgccgggccaatagatgattcagacgatggagtgcccaccgccaatccttatcagctcatggcccaactcggatcagtgatggagcaggctctggccgtacgttgcaccgctcagaccatcgatacggcgttgacccagatcaacggtgacatcacaccggttgccgataccttgcgggcccatgacaagaccgccgctttcaatcaggaggtcaccgccatctgggaagtccgtcatctgatcgaactggccgaggtcatgctgcacgcttccgaatcccgtcaggaatctcgcggatccatgcaacgccttgatttccccgaacgcgacgatgagcatttccttgctcactcgatggtcgccgatgatggttcggtaagtttcaagccggtgcacatcaccgactatccgcccaagaagcgcgagtactgatccgctggtggtaatacccaagccgcctagggcttgtggcacaataggttggctaatattggacttgacatcccactgtttcatggaggcagaacatggctgaggcgagcaacacgacggttaccctgcaagtgcatcgtttcacgccgcgacccgagcgtgccgaacgtgcacgcggtggcagcccgtttgccaagaaaggctccccgttcggcggcggctcggattcggcggcgcgccgtcgtccgcgcggcaagcagtgggtgcaggagtacacgattcccgcgcgcccttcggatactgtgttggattgtctgctgaccatcaaacgcaccgtcgacccgacgctggccttccgttattcgtgcggtcatggcatgtgcggttcggacgccgtggccatcaacggcacccccaccctgctgtgcacagccaccatccgcgattgggccaagcaacccggcgccatgcccgaagtcgatgacgaagggttccgacacaccggcaccgaggctgaggaatccgacgattccgcggaaaacgtcgcaaacgcggcggccgcccagaactcagccgcaaacggttcgctgggagtcatcgaactggcgtccctgcccggcttcccgccgcagcgcgacctcatcgccgacatcgaccctatgctcaaccagatcaggaagctcaccccgtatcttcaggcggacggcgtgctcgccaccaccgccgaaggcaaggtggacgtgttcgaatacctgcagaaccccgaacaactcgccaaatacgagctgctgagcaactgcatcgcctgcggcgtgtgcgaaggcgcctgcccggtgtacgccggcggcgacgccttcatcggcccggccgcgctgatttgggcctcccgtttcgtcaacgattcgcgcgacaccaaggccatggagcgtatggatgccatcgacaccgccgacggcgtggccgcctgccagtccgtgcgcgcctgctcccgccactgcccgcgcggcatcgatgtgggcgaggagatgtggcagatcgtggctaaggtccgcgagcgctaagccgcgccgcggctggctgcggcgatcgcctaagcacatgcgtcgatgcatccgctgggtgcccgcacgagagaagacatgaaagaacgaattatggacagaacgcagtacaccaacctcgccaaggcatgggaattcaccgaggaacacgcgcgcgaacgtgaatccgatgcgttgaccgacacccgtacggccgccgacgagtccggccagttgcagggttcggcggcgcaggcccgtctgctgggcatgctggtgcgcatcaccggcgccgcttcggtgattgccgtgggcaccggctcgctggtggagaccttgcagctcgcccatgcactggataacaagggcctgctgactgcggtcgattccaccgcccagggcatcgcgctgattcgcaaggcgttcgccgagctgcaggacgagaccgacaccacgttgcgtgcggtgaacgccccggccagcgtgtttctgccgcgcctcaacgccaatgattacgatctgatcgtggtggcgggcgacgccgagaactatgccgccacgttcgcccaggcctcccgtctgctgcgcgtgcacggcgtgatcgtgttcaccgatgtgctggcgttggaggacggtcagggcggcgtgatcaatccggccgaccgcagcgacaaggccatcgccatgcgtgagctgctcaccaccgtcgaagatgacgaaggtttcgagtccacgctcacccctgacggcaccggcctgctcatcgcctacaaaaagtaactctgtccttggctcccctcggagaggggagccactctatctcgcttacctcacaattgcgctgacggccacgtccacggcttcgtcggcgtcatcggttacggtgaccagtttcgggtcgatcgtcgagatcatgccatgctcggccaccggaccgttgagccagtcaaagagcccctgccagtattccttgccgtagagcaccaccggaatattcgccaccttgtgggtctgaaccaaggtcaataattcgaacatctcatccagtgtgccgaagcctcccgggcatacgatcacgccggaggaatacttgatgaacatggtttttcgcacaaagaagtaccggaagctcatgccgaggttcacccactggttcaacccctgctcgtgcggcaattcgatgccaagtcccaccgatttgccgccggccagtgccgctcccctattcgcggcttccatgatgccgggaccaccgccggtgatgacggcgatgttgcgcttggctatctggctacccatgcgccgtgctgccttgtagatcgattcggtgcgctgggtgcgtgcggagccgaaaatagagaccgcaggtccgagctcggcgagcgccccgaaaccgtccacgaattccgattggatgcgcagcacacgccatgggtccatgtgcagccagtcggtgtcctgatcgggtttcagcaggttggcggtggtgttgtccgagggaatcatctggccgcgtagaatcaccgggccgcgatgataggtatcgcccagcggcgaggcgtcctccagatcgaccgggttcaccggtgtggccgcagcctcagttgccgtctcagcctccaacgccgccgcatcattcgcggctgtggcttccaatggttccatatcgtccacgactgcggacttggatgcggcctcggctagattctttgcttcagcggcctttttgccgtcgttcttcttggatttcttctgcttctttgccatccaatgtcctcctgtacggcgctatcgactcttcgcattctagcgcctgaagctctgcgtacgttttccgcgaaatcatccttgacttcgtgaagaacgtacggtgagtgacactgagcgtacgttttccgcgaaataaggcctcatctcgtgaagaacgtacactgagcgcgtctcagcgtacggttttcacgaaacaaggccaacaatggagtagggaccgtctaagccatcagtggcggaagtcgatttccacactggcggtgccgtcggcgagggtgccggggtgttccgtgggcgtggtgggctctgtggtgtggcttggctgcccgatgccatcaccatcaatcgattcgtcatcctccgcatcagccgctgctgcggctgcggtcttctcgaatcgcttggactgacggctcagcagcacaccggaaatcgcggcggcgatcagggaggccaccagcacgccgaagcgcgcctcagcggaaagttccgcgttcttgtacgccagcgaagcgatgaggaaggacacagtgaagccaatgccgcaggcgacggcagcgggaatcatgtcgcgcacacgcagccccttggccatcttgagcccgcccacatgcgtggacagccatgcggtggtgatgatacccagaggtttgccgaccaccaaagccacaatcagtgcgatgaccagcggcgaggccaacaatagcgggctcatcgactcgaagtgtacgccggtggcgaacaaggcgaagatgggcagggccagcagtgcggagaatggctggagcttgttggcatagcgttcggcacgcggcgagagttcgccgtgcatttcacgagagggggtcagcaggccaaccagcacgccggccagtgtggggtgcacgcctgcctcgaacatcatgatccaagcgaggataccgacgatgccaaccgcgatccacggcacttttttcagtcgtacgaggtatgcccagatggcggcgcatacggcgatgccgatgaaccaataccaggcgttaatcgaggagaagaatacggcgatcagaataatggccagcaggtcgtcgacggtggcaagcgtcatcaggaacgcgcggatcgaaccgggcagggccttggcgaacagggcgagcacggccagcgagaacgcgatatccgtggcggtgggcactgcccagccgtgcgacatctccgagaacgggatgctgctgccggtggtggtcagaatcagcgtgccgggttcaccaggcccgatctgagagaacaatgccgtgacggccaggaacaggatgggcggggcgatcatgccgcccaccgcgcacagcatcggcacggcggccgctttcggattggcaagcgagccggtggtgagttcctgcttcagttcgaggcccacggtcaggaagaagatggtaagcagaccatcctgggcccagtggccaataggcaggtcgagattggtgtaggggatgaacagatgcgtttccgctacggtctcgaacgcatgcgcggtggcgggcagattcgcgagcaccaggccggtgagcgcgaagccaagcatgatgagtccggaaatacggtctgaggcggcgattcgcctgatggtggaccaaagtcccttcttcgcgccggcggtcgtggccatcgcgtctccttgctgcactctcttggatgaaccgtatgtaatagtacggaatatctcaggacgttctgctccgggctgagtcgcgaagggcaaccttaccccacccctgtgtggccgactcaaacgggccaatacaattggaaaagcctcggaagcatttcgctttcgaggcttactgtgcgccagacaggattcgaacctgcgacctgctgatccgtagtcagctgctctaatccgctgggctactggcgcataccactgttgtccccgtggttcgggagtgcgccagacaggattcgaacctgcgacctgctgatccgtagtcagctgctctaatccgctgggctactggcgcatgttgtctttcagacaactcgatatataatacacgccgttcagctgaatgcaactcggcgtgttgcggcgagtcgcaccatcccgaccactaccgcaacggcgtatttactggcctcacgcctcgtgtgtacggactcggtcaagcaaaaccgactgcgcaactttgagacgtccctgcggcacatccacggcttcgcgcaggagtttgggcgtgctggaaccctctacggacgccttgtccacaatcacctgcctcacatcatccaaactcggcaactggaacatcgtgtcctgcaacgtacgttcgataatcgaacgcaaaccgcgtgcgccggtcccctgcttgatagcgatatcagcaatcgcccgaatggcctgttctgtgaattgcagatcgacgccgtcgacggcgaacagtttacggtactgcttgatcagcgcgttggctggctgggtgagaatcgccgtcagatcgtctacggtaagttccttcagcacactggtgaccggcaaacgtccgatgaactcaggcaacagtccgaactcggccagatcatcggcattgacctgttcgagcaattcctcgtctttcatgtcggcgtcgtgccaattcgcgccgaagccggtctctcgacggcctaatcgcttgcgaacaatgtccgtcagccccacgaacgcaccgccgcagatgaataggatgccgcgcgtgtccatctgcgcaacgtcctgctccttatgcttgcgcgtgccttccaacggcacggaggcgatggttccttccaagatcttcagcaacgcctgctgaacgccctcaccggacacgtcacgggtgatggaggtgttctcaccggatttgcgggcgatcttatcgatttcgtcaatgtagatgatgccgtgctgggctcggcttacgtcgccatccgcagcttggaggagacgttggagcacggtttccacatcgtcgcctacatagccggcttcggtcagggtggtggcgtcggtgatgacgaacggcacgttcattacgcgggccaacgcctgcgcaagataggttttgcccacgccggtggggccgagcaacagaatgtttgacttggcgacctcgacgtcagccaaagggtcattgctgcggcgggcagcacgcgtctgggtgggaacggattgcttggcttgtttgccggtctggccactgtgcccgttattcccgtcaagctgctcagcggactcctgaagctccatgttgacgcgcttgtaatggttgtatacggctacggataatgcgcgcttggcgttctcctgaccgatgacgtagcggttgagataatcgaagatctgagcgggcttgggcaggctcagcgaattgacctcggcatctttgacacgctcctcggagatgatgtccacgcacagggcgatgcattcatcgcagatggaggcattgggaccggccaccagttttcgtacctgatgttcggttttgccgcagaacgtgcaacggggtacgtcctcgttgtagctcaccacacgtcccatgattctcctttgccgactgcgccgcaccgtcgaaccgccacgctgcgcattatcattgtcatccttgaaatacaatacccccggtcgttgccgaccgagggtattgcaatgtccggaagttttactggcggtgttccaacacctcgtccacgatgccgtattccttggcttcaggagcggtcaggaaagtgtccacttcgatgtcgcggcgaatcttctcgacgtcctggccggtgtgcttggcgagggtctcctccagccattcacgcatacgcagcatttccttggcctgaatctcgatctccgtggccttgccgaagccttggtcgatggccggctggtggatgagcacacgggcgttcggcagcatcaggcgcttgcccttggtgccggaggccagcagaatggcggcggcggaggcggcctggccgaggcacacggtctgcacgtcgggcttgatgtactgcatggtgtcgtagatggcggtcatggccgtcatcgaaccgccgggtgagttgatgtacatcatcacgtcacggttcggatcttgggattcgaggaccagcagctgggccatcacgtcgtcggcggaggcgtcgtccacctgcacgccgaggaagatgatgcgatcctcgaacaggcgggagtaggcgtcctgggtcttcatgccatacggggtcttctccacgaactgcggcatgatgtaacggttggtcggcgcgggctgggctgcgcgggcggaggccggcatgaaaccggctacgccctgacggccggccaagcggtcggcacgggcggcgaactttgcttcttcacttgccatgagtctcactccccctgctggttgttgccgatggtgtccggcgtggtcacgagcttgtccacgaagccatagtcgagggcttcctgggcggtgaaccagtggtcgtattcgttgtcgcggtagatttcctcgagggtgtggccggtctgctcagcggtcagctcgctcatggtcttcttcatgtccatgatgagctcggcgttgatgcgcacgtcagtggcggtgccgccgatgccgccggaaggctggtgcatgagcacacgggcgtgcgaggtcaggtaacgcttgcccttggtaccggagctcagcaggaactggcccatggaagcacacatgcccaggcccacggtcgccacgtcaggctcgatgagctgcatggtgtcgtagatggccatgccggcggtgatggagccgcccggcgagttgatgtacagccagatgtccttcttcgggtcttcggcggccagcatcagcagctgagcgcagatgcggttggccatatcgtccttgacctcttcacccatccagatgatgcggtctttgagcagacggttgaaaatcgggtcgacggggccggccgggacgtcatcgcccgccatgaccggcaaggtcgcaaaggtattgctcaccttgattctccttctaattactcgaacattgttcagactaccgccttgaagcgactgaaggcggcttttcgcgtgctttttggcgggcagcgtagggatttcggtttattcgagggtgtcgaggacgtcgtcaatgaggaggcgggtctgggaggcggcatcgtcgcccagacgcgggaagcgacgggcggcattggcggggctggcaccggcggctcgcgctacgttggacttgctggcaccatgggccacggctttttccgcgagccgatcgaccagtgaatcggcgacttggcgcatctgttcggccacccataattgggccatatccgcaggtaagtcgtagtcttcggccacatcgctggctgcctcctgaatggcggcccataacaccatgaatggctttcgatagtagtcaatctgctcagtgagcggctcagcggcaagcaattcaagtgccgagcgaatttctgtattttctgacatagctttctttacctcggctcccctctctgaggggagctgtcgccataggcggctgaggggagtttcgaccggggcagctcccctcagagaggggagccagaatatatgtatttacttacgactcagcaaccactttgatatcaacgacgacgtggccacggccatgccgaccggcacaaagaaggtaatcggcgcttcagagagctccatcaccaagcacatggccataagcggtgcctgttgtgaggccgaaagcaacgaagccgcaccgatcaaggcacacgcggttaccgaatcggtcggaaacatcagtatccatacgagaccgagcatcgcacccagcgtggaacctaatgcgatgccgggctgcagcacaccgcccgacgcaccggagcgaatggtcatcagcgtcaccagcgctttggcaacaaaggtgagtgccaacacacccagcaacatccagatattggactgggacagcgggaaaccggcgttcatcacggatccagaagggccgctcccaccctgaagcatggcccagaacgatgccattccagagcccgctcccccgccagaggccgaatcggatacattaccgccgcccgtcagcaagttccatggagaggcggccgctgaagatgccgactgcatggcaccagcagtgccggcggtttcaggaatgaatgtgctgaatccaagttgcgctgcggcacggccgttgcccatcacctgcggcacaacaatcgccaccaaaccggtgatgagaccagccagcgtcatctgccacagaatagccttaccggttggcttgtgcgcttccgcccattgcgaaccttttcggaacaatgcgccgcccactccacatgccgcaccgcagatcagagcgaacaccattaacgttggcgtggattccggttgcatggcggtaatgtcgtagaacaggtgatgccctttgatcgcaaccgccacgaatgcggcaatggcagacatgcccagtccaaacgcaactttttcgattgtcacatctaccaacaggatttcgacggcgaagaacatgccggccagtggcgcgtcatagacgcctcctagaccagcaccggcagccactgccaccaccatgcgccggtcgatgccgtcaacgccctcgatatggaacaggtcgcagaaacgttgcgcgagcatggcgccgagttcgcgtggggcgacttctcggccgatcgaggcaccagagccgacgatgaaaatctgcaataccacatgcgcaatggtttgccagaaaggcattcgctttcctgccacggccttcttgactgagggcaccgcagtcgttttgtgtcgcatcagataccagataatgcctgcgatgctgagtcccacggtcaccgatatcgcacggcgtgcagcgggcacgccgaatggaccaggcaattctgggccttcgatgtagccgagcagcacatgttcaacgccgtagagcaacagggtcagcagacctgctcccacaccgatgagcacgccgagcacaatggtcgccgcagcgagccaaccaaggcgtttgatagtaaccgttggctgcatgtcaacctccgcaccctatgcaacgagtatgccttgggaactcccctcagtctcgctacgctcgacagctccccctcaaagaggggagccaaagaaacagtccttttgccagaataggaagagcccggaaccatgaaacacgattccgggctcaaacaatcatgctaacgcgatgaggctatgctcactcagcatccttggcgtcatccttggcggacagttcgtcggccacggcggcagcagcggaagcggcctcgacggactcggactcttcgtcctcagcggcctcgcccaggaaggcggagaggtccacaacctcgccatcagcggtgaacttgacggcgcgcatgccggcgagcaggcccttggaacggccgacttcctgcacagcggagccaagctggccattcttgatgatggcctggatgaagttgttcggatccatgccgtactgctgggcgatggaagcgaggaagttgaacacgtcggactgggacacctgaacgtccagcttctcggccagagcgtcgagcaccatctgatcgcgcagatccttctccacggtctcctcggcctgagccttctgctccttggtggccttctccgggtccggggtcatgcccttgagctgctcttcgaccatgttggccttgacgcccttcggcaccgggatctcgaggccttcctgcagcttggcgatgaaggcatcgcgagcctcggtggcctgacgaccttcggcgtcctgagcggcagccttgcggatgtcagccttgagctcgtccagagtgtcgaactcggaagcttcggaagcgaactcatcgttcagctccggcagttcctcagccttgacggagttgaccttgaccttcacggtggccttctggccctcgtgctcgccggcttccagcgtgccttcgaaggtggtctcctcgccggcggacaggccgtcaagggcctcgtccagaccgtcgagcatggtgttggagccgagctcgtagctcacgccttcctgggagtcgacggtctcgccgtcaatctcagcagtcaggtcgatgttggcgaagtcgcccttggcggccgggcggtccacgccgaccaaggtgccgaagcgctgacgcagggtctcgaggcgcttgtcgacgtcctcatccttgacttccggcttggagatggcgatctcaagaccgtcgatttccggcagttcgatgtcaggacgacgctcgacggtggcggtgaacttcagcttggtctcgtcgttggcggactgcggaacatcctgcacgtcgaactccggctgagccatcggacgaatcttcttctcatccagggccttggagtacagctccgggaccgcgtcgttcacggcctcaccggcgacggcggcgaaaccgatgcgctggtcgatgatcttgccgggaacgtggcccttacggaagccgggaacgttcacctgcttggcgatttccttacgggccgcatccagatacgggttgagctcttccggttcaacagtgacggtgagcttcaccttggtgggctcgaggttacgaacgctgatcttcacgctaatgactcctcaaaagtcgttatttcttacagttctgccgtaaggcaacctctacatgataacgccacttacggacggtgcaatgagtttcacttgccagttccttgcgccctgctcgatcaggaacgtctcgacgtccacttccaccgggtcttccacccagcacaggttgcgtaggatctgtggcttgatgatcatctcggccggcgtgcgggtgtcttcggcgatgcggttgatcacacgccgcacccgttgcagacggtcataacgctccggatggcgctgttgccacagccgcatggatcggggcgcgttcaccacaccgttttcgtcctgttcgggggcgggcatggtaggccattgggtgggcttcagggctatggctcgatcgatggcctgcttccagaccttcggtttgaccgcacgctgaatcggcgcgtaccgctcgaacattttgtcctgctcggtgccggtatggatgcgcacacgctcgttcagggatcggagcgcgcggaattgggcagcattgtgcggcttgttggtcgccgcctcgatgattgatgaatcggccaataacaggctgggcgcaatatcgtattgccgggcgagtcggtcgcgctcctcccatagggatttggcgatggccaagccccttggatcacgactcagctgggtgatgcgcgagatacgcagccaaggaatcggatgcggtttgcgcggggcaaggcccgcaaccaaagcgtgagaaaactcttcagcggcccactcgtccttgcctgcggctttcaggtcacgacgcatcatggtttcaagttcgataagcacctccacgtcgagcgccgcatagttgcgccagtcgcgcggcagcggacggtaggaccaatcggcggcggaatgctctttggctagcgtgatgccgaggtagtgttcggtgacggcggccagaccaaagcggtgcaggccgagcaatcgcgccgctatttccgtgtcgaacagggctttgggtttgagcccgatttcggcgaatccgggcaagtccatcagagaatcatgcagaatccacgtggcgtcgcccacggcgtcattgaattcattccaatcagctccggcccgggtcagggcgacgggatcaagcaaggcgatgcctgcaccctcacgtttgaactgaatcagccaatcctcgtgtccatagcggaagccggacgcccgttcggcgtcggcggccagcgagcccgtcgcctcggccatcgcatcgcagacacgatgatagccgtccagcgtcgaagtgacatcgggtactcccccgcgaggctctttcagcagtcggggttcggtgtcacggacgtcactcaactggcgtcatcctcctcaaaacggatggtggatctgatgaatgcggcccacgagcggacttgtgcgccggcgtccatagtaccgtccggcccggtcccgtcaagcggggtccatgagacgcgaatctcacacccggcgctggtggagccggccatcgagccaaaagccgtgttttgggtcacggtgactgtgccggataccgaatccggctcgatgccgtcgaaatagtcgcacatgtcatcccagtacatgccgggggtcagagaatcgttttcggcggtttccagcggcagtcgcgcgaacgccacgcaacgccagttggaatcccagtcaatgcgcagctcatgagcataaagcatcatgatccaccctgtggcgattcgtgattcggcatcgctgccaagaccggcggaaaaggcatcgccgagggcacgctctcccgcttcgaattccacgccgataccataatcggccaaggtggaaggcacgggaatctcccgatagcgcacgtcatggatgcgcttcatggtgctgacggattcgacggctgcccatacttcatccggcacaccctgagggcgcacggggcgtccgtcgttggactctcccgtaggaaatgcgtagatgtcggccatatctctagggtatgggcgaacgggccgaatcgtggtatttacgcgcggttcggccctgcaatttaatacacggtgaagccgtggtccttgaactggttggtcacccgttcgcgggtggcggcgttgggtcccttctggttctccagcgggtatgggatgcgcagttcgtgccacttcgggcggccaagctggtggaatcccagcacgtcgatgtgttcgacggcatcaccgaaggactcgcagatcttcgccacgttttcgacgttctcttcggagtcggtcaggcccggcacgagcacaaatcgcacccagatcttcttgccggccttggccagtcgctggccaaaatcgatggtgggctgcaaggtgccgccggtgaccttgtgataggtctcctcgtcgccggatttgacgtcgagcagacacaggtcgatgtcctcgagcatctcgtcggtgtaattcgtgttgaggaagccggacgtatcgaggcaggtgtgcacgcccatctccttggcggcatggaacacacgcgagacgaaggcgggctgcatcatggattcgccgccggagaaggtgataccgccatgcgtggccttgaacaggtccttgtaacgatcgaccttcttgatcatggcgtcaaggtagacgggcttgccgtcgcgcatcttccaagtgtccgggttctggcagtactggcagcgcagcgggcagccggacatgaacacggtcatgcgggtgcccggtccatccacggaggtgttgatgtcccaagagtggacgaagccgatatcaccggatttcagggcggaaaggcggtcacgtcggtcgagtccgattggggattcaaagccggaaaggccacccatcaaagtctgcgaggcataggtcttcgattccttgagcatatgcctggtcgtggtgcggaacgtgggtgttgcgggcatcgttgtcctcctgttccaaatgatgcgaaagtctgtgggaaataaggaaggggtggagccgtgccccaccccttcagttagtcattgccgcggttcgcggggttggtcatcagtcgacgacggcaccctggtggaaggtacgggagatgacgtcgagctgctgctccttggtgagcttgacgaagttcaccgcgtagccggagacacgcacggtcaggtgcgggtacttttcggggtgctcgacggcgtcctccatggtctccttgcgcagaacgttgatgttcgcgtggtagaggccgtggccgttgccggcgtccaggatgccgaccaggttgccgatgcgctcgtcctcgtcgcggcccaggccatcaggggtgatggtgttggtcagcgagatgccgtcaagagcgtcgttgtagtcgatcttgccgacggagaacatggacggcagcatgccgtgggagtccatgccgttctccgggttggcgcccggagcgtacggggtgcccttggcgtggccggacgggaaggaaccggtgttcttgccgtactcgacgttggaggtgatcgtcaggatggactgggtcgggacggcgccgcggtataccgggagcctcttgacctggcccatgaccgtggagacgacccacttggcgatgtcgtcggcgcggtcgtcgtcgttgccgtagaccgggaactcgccctcggtgcggtagccgacgatcaggtcgtcgtcggcgccctcaacgtactcgtactcgtggccttccagggtcttcgcgtccttgttgtagatcgggtagaccttggcgtacttgacggcggcgagggagtcggcggcgatggacagaccggacatgccgcagccgagggtgcggtacacttccttgtcgtgcagggccatctcgatggactcgtacgcgtacttatcgtgcatgtagtggatgatgttcagggccatgacgtaggtctcggacagccattcgagggccttctcgtagttgttcttgaccttctcgtaatcgagggtgccgtcggcctccggggtaatcggctcgatcacgcccttgtcgatgacctgcatgccggtcatctcgtcgcggccgccgttgatggcgtacagcagggccttggcggagttcacgcgggcggcgaagaactgcatctgcttgcccacgcgcatcggggagacgcagcatgcgatggcagcgtcgtcgccccagtggctacgaatttccttgtcggactcgtactggatggccgaggtgtcgatggagatcttggcgcagaagcgcttgtaggcctcaggcagcttcggatcccagaagatggtgatgttcggctcggggccaggtccgaggtgctcgagggtcagggtgttgagcagacggaacgaggtcttggtgaccatcgaacggccgtcatcgccgaagccggcgtcggaccaggtcgcccagtacgggtcgccggagaagatcgaatcgtagtccttggtacgcaggaagcgcacgatgcgcagcttcatgacgatgttgtcgatgagctcctgggcgtcggtctcggtgatcttgccggcctggaggtcgcgctcgatgtagcagtcgaggaaggcggagttgcggccgaaggacatggcggcgccgtcctgggacttgatggaggccaggtagcccatgtaggtccactgcacggcttcctgcgcggtctgggccgggcgggacaggtcgaggccgtactcgttgccgaggttgatgagcttcttcagagccttgatctgctcgtcgtgctcctcacggaagcggatccagtgctcgatctccggctcggtgaagtcgttgcggtacggcacggagtccttgtcgcgcttcttgaaggcgatgagcttgttcacgccgtacagggcgacgcggcggtagtcgccgatgatgcggccacggccgtaggcgtccggcagaccggtgaggatcttgttgtggcgggcgaccttgatctgcttggtgtacacgccgaagacgccgtcgttgtgggtcttgcggtacttggtgaagatcttcttgatctccggatccggttccttgccggcttccttgatggcctgctcgaccatgcgccagccaccgttcggcatcatcgcgcgcttgcagggaacgtcggtctggaggccaacgaccacgttatcgacttccggggagtcgatgtagccggccgggaaggcgtcgacgtcggccggggtatgggtgtccacgtcgtagacgcgctgcttgcgctccacggccaggtagttgtcgtcgaggtacttccacaggtgcttggtcttctcggtggcaggagccaggaatgtctcgtcgccctcgtacggggtgtagttcttctggatgaagtcgcggacgtcaatatccttctgccagttgccctcggtgaagccggcccacgccttggcgtcgagctcctcctgggagacagctgcattttccactgcggtcatgtcactccttaaatggggttgtaggtttcgcatcttcacggaacccttggttcaacagtgtagttggcacttgcttgagaaaagctgaaattgggagtgagctatctcacattgtttctgtgaacgctaccattccaatggcttctagatattgatgggactattgcacgtctccagatatgggaaaccgctcatactgtgatgttcgtatgagcggttcggtcttgagattgacagcagaaccgtatccgtcagttttcgaccgtcaatcctcggggcgagcctgtgcgggtttcacgccgtagttcttccagcgccggttctcctcctcccatctggcgttgcggtccaccacgatgtcccaggcgtgttcggcatcttccttggtcttgtacgggcccatgcgctgttcgatcggtgagaccatgcccagctcggcctgcttcttgacggtgttgaaataccactgcttcttgttatcgtctgtcattggtacctcctcaacggtattacttgctcccgctggcgggagcaatatatgtttattccctgaatgcgttggtgacgggcagtcggcggtcgcggccgaacgcgagggccgtgaccttcggtcccagcgggtattggcggcgcttccattcggcgcggtccaccaatcgcatcacggtgtctacggtgacctggtcgaagccgtcggctaacaggtcggcgcggccgtgcgcgtgctcgatgtatgcggcgagcaccttgtcgagcagcgcgtattcgggcagggagtcggagtccttctgcccggggcgcaactcggccgagggtgccttctcgatggaggagaccggaatcatcacgccgtccttcaacgggatgccggtgttgccgtcctcgttgcccacgatcttgagaccgccgatgccgacgcctgcggccgcggccttgttacgccaacggctgatctcccagacacgggtcttgagcaggtccttgatgggtgcgtagccgcctaccgcatcgccgtagatggtcgagtagccgcaggcgagctctgacttgttgccggtggccacggcgagcagaccgcgcgaattggagctggccatcacgatcacaccgcggatgcgggcctgcaggttctcggcggagacgccatcaaggtcaagttgctgttggtaggcgttgaacaatggctcaatgggctggacctcgtaatgggcgccaatgttggaggccaaatcggcggcgtcgtctttggaaccgtcggaggagtacatggagggcatggagatgccccagacgttctcgccgccgcatgcgtcggccgccatggcggctaccagtgcggagtcgatgcctcctgagaggcccagcgtcacgccggtgaagtggttcttggccatgtagtccttgaggccgagcacgcaggcggtgtatacctcttcgtccgggtcgagttccggaacgatctcggccttggcctgatgttcggcggcggaatcgaagtcccagaacgtcaggttttccatgaacatcgggccgcgttcgataagcgtgccgtcggcatcgaccacgaagctgccaccgtcgaagaccaggtcgtcctgaccgccgacctgattcaggtagatgaccggggcgttgacttcggcggcacgacgctgggcgagctcgaaacgggtgttggtcttgccttcctcatacggcgagccgttgatggtgagcagcaggtcgatgttcttggtggccaggtcggccaccgggccgccgtcctgccagatgtcctcgcagatggccacgccaatggtggcgccgtccacgtcgagggtcacggagcggtcgccggcggagaagatgcggaattcgtcgaacacgccgtagttgggcaggaagtgcttgtcgtagccagcccagaccacgccttggtgcaagaccaccagtcggttgcgcggcttggaggtcttgcggtcggtgcccacggtgccgaccaccacgaacagatcgccgaggccgtcgtcgttgagctgggtggcgagttcgttggccttgtcccatgcggcttggcggaaggtgcggcgcagggccagatcctcgatggggtatccggtgagggtcatttccgggaaaacaaccacttgggcgtttcctgcggcggctttacgggagtagtcgagcaccttggcggcgttggcgtcaagcgcgccgacgcaggtgtcgatctgggcgagtgcgaagcgaagctgtgtcatagattcttagtgtagccgcgtatgacgtcggattgcctgttcttccggcttggcgtcattcattaggtcgtttttgcgttcattaggtcactgcaatgcgatatcagtcgttgcaatggcgcgattccaacaaccagtatcgccgttcaccgacctaatggacgatgaatcgacctaatgaacgaatgccactcccctcagtcagcttcgctgatagctcgtcctgcacttatggacgggcgaggcccgcgcatatctggttcggctgtcgcctcaccttcggctacagacagcccactgggctgtctgcctaacgcctcagcctccggaggtgagccagaaaaggatttacttcagctcgttgagcacgcgcagagcggtgttgacgtagaagttgacgaaggtgggaatggattcgtcgagacccacgaaatgcgggctatgccagtcggcgcaaccttcctggccgtttgacccgacgaacgcgaacaccggcaacgtcaccttggcgaattcgcagaagtcctcccccgccatcgactgacgtatcggttcgagctgcgcgtagtcgttgacatccgccgccacggccttggcgagacctggatcggagaccagcgggtcttgaaagtcatcccagaccacgtcggcgctgatgccgtatgcctcggcggtgtgttccaccacttccttgaatcggcggccgaccagattgccatccgacttgtggaaatagcgcacagtcccttggaatccggcttcggcgggcaccacgttccacacatgtccgccgtgcacttcggtaacggacagcaccagcgggtggaagggcgtgacgttgcggctcacgatggtctgcaggctcagaataatactggcgagcgcttcgatgggcccggtgcccttgtacgggtaaccggcgtgggtgccttgggcgtggagggtcacgcggaatttcacgcagccggccatcatcggctcaacgccgatggccagctggccgggcgcatagttggggttgttgtgcgtgccgataatggcttcgacgtcatccacgagtccggcgtcgatcatggcgcgagcgccttggccggtctcctcactcggctggaacagaatcttgatcgagccggcgaacttgtcacggtgctcggcgagccagaaggcggcaccgagcagaccggtcatgtgcaggtcgtggccgcagccgtgcatcacgccttcattgacggagctgaactccagtccggagtcttccacgatgggcaggccgtcgatgtcagcgcgcagcccgatacgcggcccgggaccggcctcgccctgaatgagccccacaacaccagtctccagcgggttgtgcaggatctcgatgccgtgcgccttgagctggtcggtcagatagatgctggtgccgaattcacggaaactacgctccggatgggcgtgcaggtagtggcggatagtgatgagttcgtggtcgatgtcgatatgttcactcatggttcccgattctagtagcgcgaagaatatattgcggccctcgctccatattggcgagggccgcgatctatggggtcagtatgccttgttattgctggcgtttgagcagtcgtttggcgatggcgttggcgatgccctgcaccacctggaccagtacgatcatgatgatcacggccgtccaggtgacggtctggtcgaacttctggtagccgtaggcgatggcgaagttaccgagaccgccaccgccgatgtagccggccatggcagacatgtcgagcacgccaatgaacaggaaggcgtaggccaggatcagcggtgccagggcttcggggatgagcacggtgcggatgatggtgagcttgccggcacccatcgaacgcgcggcctcgattactcccgggtcgaccggcacgagattctgttcgaccagacgcgaggtggcgaaggtgcacatcaccaccatcgggaagatggcggccacggtgccgatggacgtgccgaccacgacgatggtgagcggctgcatggctgccaggaagatgatgaacggaatcgggcgcacgatgttgacgatgatgtcaaggatgcggtagacgaccgcgttctcgaacaggttgccggggcgggtgccatagagcaccacgccgaggatcaggccgaggaatccgccgatgacgagggtgacgagcaccatggtcagggtctggccaatggattcgaacagtagtggacgcagcacgttccagtcgctatgcgggttggcgaggatgatcatgcgttggctccttcatgtgcggcggcggacgcggcgggcgcggtggcagtatcggccgccagtgggtcatgggcgcggtcttcggcgtaggaggcatgtccggcgactgcgtcggcgtaggccacaggctttgcggcggtgccgaagtcgatgacgtcgctattggcggcgagctcgcgcaggaattcgtccacatgccagccgggcccgttgaattcgtaggtgatggcaccgatggcggtccccttgaccgtgtcgatgccgccgtagagcaggctggattcgacgccgtatttggcgatgagttcggagatattctgtccggatgccttgagttcatggccttgggtgccggaaacgtccttttggcggataagcacggtgacaatgcggcccgaccattcgtgatgcaatcgctcgacccggtcttcctcgggcaggccagacaatgcggtggcaatgaatcgcttggtcaccggctgctggggtgcagcgaacacatcgtatacgtcgccggattcgaccacgcgtccggcgctcattacggccacgcggccggcaatctgctggaccacgttcatctgatgggtgataagcacaatggtgatgccgaattcctcgttcacacgcttgagcaaggccagcacttcggtggtggtttccgggtcgagcgcgctggtggcttcgtcggcgagcagaatctccggattagtggccagtgcgcgggcgatgccgacgcgctgcttctggccgccggacagctgcgaagggtatttgtttgcgtgctcactgaggcccacgaattcaaggagttcgttgacacgacgatcctgatagtccttgcgccagtgatcgagttgcagtgggtaggcgatgttctgggccacggttttggtggagaacaggttgaactgctggaaaatcatgccgattttctggcggatgggccgcagcttggtctcactcagagaggtgatatcagtaccaagcacggtcacagtgccggaggtgggtcgttcgagcgcgttgataagccggaccagtgtggatttgcctgcaccggaatagccgatgatgccgaagatgtcaccgcgatcgatggtcaggctgacgtcatccacggctcgtgcgatgttcgcgccgcgtccgcgtgttttgaattccttcacgacatggtcgaaggtgatgatggggtcgctcatagtgctccctgatgctggttgttggtgtccggtcacggaagcggagcgaatcccgattgttggctcgggtactcgctccgcttggtggtaatggctatggacaggctagtcgtgcgctcgtatcagccgcggctcactgctgggccttggcatccttctcaatgtcggacaggaagccttgcagctcgctggcgctgaacttgtcggcgaacaccgcggtaccgccggagttctcctgcagggcgtcgagcacatccttctgctggtagatggaaacgagcttcttgtaggtctcgttgttcacgtccgccttgcgggccacccacacgttgatgtaggggcgagcctcttcggattcggcgtcatcctggtagatggcgtccttcgggtcgagaccggcatcggccacgtagtcgttgttgatcacaccagcggcgatggtcgggtccttcagggtggtggccacctgttcggccttgagcggggtgaccttgaccttgctcttggcttcgtcgatgtaggccggggtggagaaggcggtccagtcgcccttgagcgtcacgagaccggcggccttgagcacgccgatagcgcgggcctggttggtttcgtcgttcggaatggtgacggtgtcgccctgcttcaggtccttgatgtccttgaccttggtggagtacacgccgagcgggtagatggcggtgccgccgatgggctgcaggtccttcttgttgctcacgttgtagttggccaagtagagcaggtgctggaattcgttgaggtccagctcgccggagtcaagggccgggttttcggaggtgtagtcctggaagtcgacgatgtcgacgtagatgccggccttctcggcgtcctgcttgaacttgacccattcggggttggtagcgccgaccacgccgatcttgaccgggttgcccttgctgcccttggcggacgactcgttggcaccggcaaacgcgcggtagccgaagaacgcggccacggcgataatcgccacgaccacgatggtgatgatgacgttgcgggcggtgtggttcacacgcaccggctcgttattgttaggagcggccggggttgccggctgggttgctgctgtcattggatttcctctctccaaaattgatgtcgggtaacaccataacgcgcttgaaccgcgaaagtgacggaaaatggccgattgccatataggtgtcttttatggcgcgcatgcaatgtccgggattcgtgcgtttgataacccgctataggcgtgccgaacacgccggaagcacgtcggaaagcacgtcgagaggggctttgacaatggaagctatgactaccgatactgccaatgccgatatccgagccgtattcttcgatatcgatggcacgctcaccagtttcacgacccatacggtgccggattccacaatcgaggcgattcaccggctgcaggccgcaggcgtcaaggtgctgatttgcacgggccgcgcgccttcacagatgcacgtggtgctggataccatgccggtgacgttcgatggcgtggtggcgttcaatgggcagtattgttttgatgacaccggcttctttgcctcgcaggccttggatactgctgatattgaggtgattctcgactggctggaccgtcaccccgatgtggtgtgcaatttcggcgagaaggattacgtgtacttcaaccagtccaatgatctgcttcgcgccacgtggagcaaactgggcaaaaccgcaccgacccggtatttcgaggacccgcgcacccgcgcgctggatcatgagactttccagatcagtccctttgtcgggcccgagctggaggccgaactggtgggactgtgcagcaatgtgcgcggggtgcgttggcatccggatttcacggatctgattccggccgatggcggcaagccgcgcggcatccagcggttcatggcgcattacggcatcacgcgcgagcagaccatggccttcggcgatggcggcaatgacacggatatgctcgcctacgccggcatcggggtcgcgatgggcaatgcgaccgccgagcccaaggccgccgccgactacatcactgacgatgtggaccacgacggtgtgcgcaatgccctgctgcatttcagggtgctacgcgattaaaacatcacaacagttcgctttgttctgccccgccgtgacagggcttatgaataagcaaagggctcgggacgaatcccgagccctttggtgttagcgaactaacaacaccgtggaggtgttatcactcgttgtcgccagcggtagcggcggtagcggtgacggcacccttcttgtcggtgttcacgccggagtacacccagtcggtgtagtccgggtggtcgtagccgttgtcgacggcgaactggaaggcctcatcacggaacttctcgagctcgtcgatcttgtcggcgtacttgtcggcgtcgatcatgcgcagagcctcagcggtcagctcgtagcggtcgatgcggttgacacgaaccatgtcgtacggggtggtggtggagccctcctcctcgtagccgtggacgttgaagttgtcgtggttcggacggtcgtagatcaggccacgcacgtcgtgagcgtaggagtggtacgcgaacagcaccggcttgtcggcggtgaagatgtcggcgaactcctcgtcggtcagagcctcgtcgttctccttggcggactgcagggagagcaggtcggcaacgttcacaaccttgaacttgacgcccagttccttcagcttgtcggaagcagccatgatctcctgagtcgggacatcgccggcggcggcaagcacgacctcggcctcatcgttgttcttggcggtggaagcccaatcccaagcggcggcacccttctcgagctcggcacgagcctcgtccagggtcagccaggtggcagcaggctgcttaccagcgatgatggcgttgatcttgttggtggacttgtagcacttctcggcgatggccagcagcatgttcgcatcggtggcgaagtagatgccgatgacgtggtcgttgtggaagcacttgttcagcaggacggaggtgacacccggatcctggtgggagaagccgttgtggtcctgacgccaaacatgggaggagaccagcaggttcatggaggcgatcggcttgcgccacggaatctcgcggacggtagcctcaagccacttggcgtgctggttcagcatggagtcgatcacgtggacgaaggactcgtaggagctccagatgccgtgacgaccggtcagcaggtaggcctcgaggaagccttccatctggtgctcggacagctgctcaacgacctggccggagacgtgcatgtgctcgtcgacctcgtcggagatgtagccggcatcccactgcttgttggtgacttcgtaggaagcctgcagacggttggaagcggtctcatccggtccgaagatgcggaagtcgcgcgggttgttcttgatgatgtcgcgagtgtaggcacccagggtacgggtggcctcgagctggccccagccgtggccgtactcagccacttccttgacctcgtagtcctcgaggttcggcagcttcaggtcgttgcggatcacaccaccgttggcgttcgggttggcaccgatacgcagctcgcccttcggcatgaaggcaaggacgtcgtccttgacagcaccgttggcgtcgaacagctcttccggcttgtaggactcgagccagttcttgagaacctcgaagtgggcctcggtgtcgcgggcggaagccagcggcacctggtgggaacgccaggagccctcggtcttcttgccgtcgatgtacttcgggcaggtccagcccttcggggtgcggaagatcagcatcgggtagaacggacggtgcacgttgtcggtctgagcggtggccttgatgtcgcagatctcgtcccagatggtctcccacagctcggcgaagcgacggtggatggacatgtggtcctcatcatcgaagccagcgacgaactcgtagggctcgtaacccatgccgtggaagaactcgtggagctcttcgtcggagatgcgggacaggatggtcgggttggcgatcttgtagccgttgaggtgcaggatcggcagcacgataccgtcggtgcgcgggttcacgagcttgttggactgccagccggtagccagcgggccggtctcagcctcgccgtcgccgacgatggccgggacaaacaggctcgggttgtccatgatggcgccgtaagcgtgggacagagcgtaacccagctcaccaccctcgtggatggagcccggggtctccggagcgaagtgggacggaatgccgcccgggtaagagaactgacggaagaacttctgcagaccagcttcgtccttggtgatcttcgggaaggtctcggtgtaggtgccgtccaggtaggactgggaggtaccggccgggccaccgtggcccgggcccatgatgatcacggtgttctggccgtggtcagcaatgaaacggttgatgtggccgatgaggaagttcaggccaggggtagtgccccagtggcccaccagacggtgcttcacatcttcgcgggtgaagggctccttcatcagcgggttggaacgcagataaatctggccgatggaaaggtagttggcaacgcgccagtacttgtcaacgccttcgagggcttcctcggaaaccggagcgttgagcttcttccaaggggtgccaataacaggactcgtcatgtgtactcctgtactcctgcacgtgatcgtgcgattgattatttctgttcggtcacggtccctgacccttgcggtgccaaggttttccgttcccaatcaatcgtcatggtacgaggacaacgcgacttttgaacgatttcttgcgggtgtgttcgaaattgttgcggatatttcagtatttgtgcggttcgactgaccgtttgtcaacattagttttttcaacatactttttcaaaacagcggaagcatgcggaaatccagcatttggctagaacagcgcacgttcgatttcccatgttcgaaatcggcgtgttgtccgtctacaggcatgtagtttgttcgatttgcgcacatagtctctgcgtgtcggccttgtcgccttgaccagtgataatcaggggtgttcagcccacgtaaaattccaatgaacgttaggggaatatcaatggcaaacggtcctgtgcttgtcgtcgacttcggcgcccagtacgcccagctcatcgcccgccgcgtgcgcgaagcaggcgtgtactccgagctggtccctcattccatgccggtcgacgagatcctggccaaggatccgaaggcgattattctgtctggcggcccggcctccgtgttcgagcccggcgcgccgaccatagacaccaaggtattcgaatccggtgttccggtgcttggtatctgctacggcttccaggtcatggcctatgagctcggcggcaaggtggataaggccgcgctcggcgaatacggcaagacctcagccaccatcgacgacgccgccggcatcctcgccgactcccccgccgagcagaccacgtggatgagccacggtgtggcggtcgaacaggccccggccggcttcgaagtgctggcccacaccgaaggcgcgcccgtggccgccatggcggacgaatcccgcaagctctatggtgtgcagtggcacccggaagtcaagcactccccgcttggccagaagcttatcgaaaacttcctgcaccgttgcgccgcgctgcccaacgactgggatgcctcctcgattatcgaggatcaagtcaagaagatccgcgagcaggtcggcgacgccgaggtgatctgcggcctgtccggcggcgttgattccgccgtggccgccgctctggtacacaaggccatcggcgaccagctcacctgcgtgttcgtggaccacggcctgctgcgcaagggcgaagtcgagcaggtcaagcacgacttcgtcgccgcgaccggcatccgcctcatcaccgtcgacgccgccgacgacttcctcgacgccctcgcaggcgtctccgagccggagcgcaagcgcaagatcatcggcgagaagttcatccgcaccttcgagaaggcccagcgccaggtcctcgaagaggccggcgcccgcggcaaggaggtcaagttcctcgtgcagggcacgctctaccccgacgtcgtcgaatccggcggcggcgacggcgcggccaacatcaagagccaccacaacgtcggcggcctgcccgaggacatcaagttccagctcatcgaaccgctgcgcactctgttcaaggatgaggtgcgcgccatcggcaccgagctcggcctgcccgacgaaatcgtctggcgtcagcccttcccgggcccgggtctgggcatccgcatcatcggcgagatcaccaaggagcgcctcgacctgctgcgcgaggccgacgccatcgcccgcgaggaactctccaaggccggtctcgaccgcgacatctggcagtgcccggtcgtgcttctggctgacgttcactctgtcggcgtccaaggcgacgagcgcacctacggctcgccgatcgtcctgcgcccggtcagctcggaagacgccatgaccgccgactggtcccgtgtcccctacgatgtgctcgccacgatctccacgcgcatcaccaacgaatgccgccagatcaaccgcgtcgtcctcgattgcacctccaagccgccggcgaccatcgaatgggagtaagccgatagggctttgacctgctcttttgagtgccgtggtgtaccgctgagtttcgtttcgtacgagagtcatggcaaaaccgccagcgacggcagtgagtaaaaacgatttcctagcctccgttccctcgttggaacggaggcttttttctttgccgttttactccctttcacctgcgatttcgccatttactccccgtgtttcaagacaacaaggcacggggaggtattcaagggaatgggagtaaggatttatcccaagtgagttgacgcgcggtttttgtccccgagggcgaaacggggccgtttcggggcccgtgaaactcaaatcgaactcaacgggcattttttgctgggcgttccaatgttcccgttccgtgggataccctgattctctctgtggtactgtttgtggtgtttcctctggctggcggtatgctgacccgttcggctgtcatcaagcggaaggggcagtgtactttgaggagactttcatccatatgtttgacagtgtaactaccattggcttattgctgacgctggtgatgattttctcgttccaaggcaataccattctggaaaaacctctgcacattgttttgattgcggtaccgctgattttacagaccttcctgatttttgcgattgcgtatatcgcttgccgggttttgaagctgctctacaagattgctgctcccgccggaatgatttgtgcttccaacttctttgaactggctgttgctgttgcaatcgccttgtttggaacgacttcccctgcggcactggcaacgactgtgggtgtgctgacagaagttcccgtgatgctgttccttgtaaaaaaacgcaaataaaacgaaagactggttcaaatatgagtaagaaaaaggtggcatttatctgcgtccataattcctgccgcagtcagattgccgaggccttgggaaagcacttggcttccgatgtgtttgaaagctattccgcaggaacggaaacaaaaccgcaaatcaatcaggatgctgtccgcattatgaaagaactgtacgggattgacatggagaaaacccagtattccaaactgatctcggatattcctgcccctgatattgcaatctccatggggtgcaatgtgggctgtcctttcattggtagagcatttgacgataactggggattagaagatccgaccggaagcgaagatcaagtctttgtcgagatcattcgagagattgaaaaacggattctacagttgaagcagtcccttatttgattgaaatagcactctgcttgtggtataatacagatgatccaaaccattgcttttctgctgataacattgggcttgataatcttttgataacaggagtccgacaacgccgtataagttggataattggtatcaaattgagcaactaagagtcaaatcccctaaacagtattgtttagaaccagttttactttggcgagtgggagtaaactggagcggattttgcgcaatcgaaattccgtccgtagagtgtcgcagtgtgccgccacgtacgaaaaagcgtaaagccacctgtgattttgggtgagtaaaaactattgagaccctctggaaacaacgttttcagggggtctctttatgccttttgacctgcagtttcagtcatttttactctaaaagcgcgtacaccacggacatggcgacacgcagcggacgaagagtaaaggatttttcggagagtgaactgtcccagtagtttgtcccaccaccccaaaaacgcccctgaaactcaagtgaaactcaataggaacgcaagggcgtcatcgtgcgagcaccgcagcctgagccgccgataccaggctcgtttgcgacgccgtcgctgcttgcctggatcgtcaacggcaagtacgtcatgtcgctgccgctctaccgcatagagacagacctcaaggcgtgcggcgcgacgatatcgcgccaggacatggcgaactggatgatgaacgtgcacgcgcgctggctggcgaaggtccatgagagaatgaaggtcgagctgctgtcgcatgtcaggattcatgccgatgagaccacggttcaggtcctgaaagagccgaaccgcgaggcgaagaagaaatcgaggatgtggctgttctgctcggcgcgctgcaacgtgcccgtgtatgtattcgaataccacgagacccgcaggaagggcgttgcccaggagtttcttgcgggctggtccggcacgcttaccgccaacggctacaaaccctacttcaatctcggcaaccccaacatcgccaacacggcgtgcctcgtccacgtgcgccgctaattcgcccaaatcgtgaagatcgccggcggcgacgccaaggcggcgtctgcggccagcgttgcgctcgaggcaaggcgcaggatcgacgccatgttcaaggtcgactccaagttcgacgacatggagccgggcggcaggaaggccgcccgcgacgcggagctccgcccgctcatggaggacttcgggggatgggcgcgggcccagcttgtttgtgttcaattagttgttgcgggtttagtcacgatgatttttcgggtttaggcagagcatgccgaccacggaatggtcttaactggatggtgcttgtatctccgccagaaaggaccggaaaggattatgatcagcatgccccaagtacagtctatccgtcgtttgcggcggaacggggaatccgtcgcgtcgatcgcgcggaaaacacatgtcagcgagccgacggtgcgtaagtacctcgcgaaggaggatctgtcggccgtgccgtcggtgagaaagccgcgcgcgtcggtgatcgacccgtatctgcccgtgatcgagcagtggctcgcggaggatcgcgcgaactggcgcaagcagcggcataccgcgaccaggatctgggagcggttgagggacgagcatggcgcggaggtctccctgtccacggtgacgcgggcggtggcgcggctcaggcgtgagttcgcggcggagcgtgatgaggcgttcatggatctggtatggcatccaggcgaggcgcaggccgatttcggcgaggtcgacgtgctgttgcgcggcgtggtgcagcggatgcatcatttcgtgcttgatttcccgtattcgaacgtcggtctggtgcagttgatgccgggcgagaacgctgagtgcacgtgcctggcgttgcgcaacctgttcgagtggctgggcggtgtgccggagcggatcgtgttcgataacgccgccggcgtgggccataaggggtacggggagcgcgagccgcgcctgacgcacctgttccaggccttccaggcgcattacgggttcgattgttcgttctgcaacccgtattccggtcatgaggagggcgcggtggagtccaaggtcggcatggtgcggcgcaagctgttcgtgccccggccgagcgtatggagcctggagaacttcagcgccgggctgccggaccggtgcctggagctggccacgaaaccgcattgccgcaaggacacggaggaacgtggcctgttctccgaggaccgtgcggcgctgctgccgttgcccgggaagcgtttcgacgtggtcacgtggcggcatatgaaggccgaccggtacggcgtggccgcgcccggggacggcatcgctgttccgcggaccgggcgaacgcgggcagaggggtgatcgtgggcctccgcgcgctcgaggtcgaggtcctcgactcgtcgggcaagcatctggcgacccatcctcgggcgtacggccaggccagcacgaacagcgaggacccgtccatgcagttggcgctgctgtgcaacaagcccgcgtcctggcccaacagccgggtacgtgacgcgttgccggacccgttgcgggaatggctggatcggcaggacagacagacacgcaacgaggcgctgcagaccctcaaacgcgttgacagggaatccgggtgggcgaacgcggtcgaggcgatgctttccatcctcgaatcgaccggcggggcggaccgcgccggtgtcacactgctcgcggccaggctcgccgagggcgtggcgggtatcgaatacgacgatgacaggccggatccgggtgaatacgacatcgcgttcaccgcggacgtcggcgtgcaggaaggcgggcgatgaacacgaagacggacgaagggctctacgagaaggcccgcaagctgttcatctccaaggcgagcatcgacgaattcgccggctgggccacgccccgccaggtcgacgccgtccaccgcctgctcgacacggaactggcgaacagggaacgcgcgaagcacgacaggctcctgcgccgcgcccggttccccgtcgtcaagggtctcgacggctacgacttcacgaacgtcaggctccccgacggctacatgctcgatgagctcctagggctcggtttcatcccgcgcgcgcaggacctggtgttctacggcaagaccgggcgcggaaagacacatctcgcgatcgggctgggcatgaaggcgatcgacatggggctgggcgtgcggttccatcagaccgccgagctcgtcctccagctgggcaaggccaaacgcgacggcacgctcgagacgatgctccgggacatcggccgtgccgacctgatcatactggacgagttcggctacgcacccttcgacatcgacggggcgcgcctgctctaccggatcatcgcgggcagctacgaaagacggagcatcatattcaccacgaacatcgagttcagtaaatggggcacggtcttcgcggacgacaaactcgccgcagcgatcatcgaccgcatcgtgcaccacgggcggctcctcgagttcaccggccagagccgccgcgtcagtgaggccctcatgttcggcaggaacacctccgcgcaaccggaaaaataaggaaaatgcatgcaactgcctaaacccgaaaaaaatacatgactaaacacgaaacaccgacttgacgaaatacacccagcttcccctagcctcaccgaagctggcgctgcaccgtgcgctgcagtacgccgtggagttctggccctacgtcatgaacgtgctcgaagacgggcacctggagctctcgaacaacgtcgccgagcaggcccagcgaatcttcgtcgtagggcgcaagaactggctcttcagcgatgcgccacgcggcgcgcgggcgtctgcggcgatatacagcgtcaccaccacggccaaggccaacgggctcaatcccaggctttacgtcgagtggctgctgaccgagatgcccaacgccggcgagctcaccgatgaggttgtggactcgttcctgccatggtcggatagggtgcctgagtcctgcaagctcgacccagccgctgccgagaaggccaaagagatgcctgacgacttcataattaacatcgaccccgatgcgttcgacgacgagatggcgaacaacgccgaggagggcctgtagcgacatagcggcctaaggcataccgcaacgcaaagatggaaacgtccaggacttttccatccgtatgccggaatggccctggacgtttcctgctacgcggtcattttgacgcttacgctctaatgcctccaccgcttgtcgcgggcggggtagacgatccaggcggatgcgtagcttgcgataaggcagacaatgacgcagacgatgcttgtctggaacccgaatgagtcattgataacgccccagattacgcttgcgaagccaatgccgatgtcattggcgagcaggaacagggcgtttgcggcgccccagcgctctggcggggtgttctttaccgctacgctttgattaagtggcaggcttatgccagtggcgagaccatagaagattccggacgccaggaagacaggttccccgtacggtgcggcaagtagcataaggcagcagaggatgccgcacgcgacggctccggtcattgttttgattgcaggtacggtgtccatgaaatgctttgaaatcatgcgaatgataatcatgcttaccgcgctgatggtgtagaagagaccggcgtgggtatagccgagagtagtaccgtacagaccggcaaagaagacgccaaagccaaaagtggggcacatgatcatctgtgggatggcgccaggcaatgcgcgcggctcgaagatgttgaatgagtcacgcagggttctcttggacacctggtcgccttcaggatacttttcactgttaattgtttcggatgtagttactgtggtggagctgggtgcctgcccgtcttttgagtcgagttcgagccgggtttccattttgattcggtatgcgctggagcttggcagagtttgccatttactttcatagcgtgcgttgagggcgattacaagccctgcaaacccaaccagggcaaggccgacatagaggttcgttgagggatcggttcctactaggtaaagtgcgaaggctgggccgatgctcatggcgatagcctgtccgaggccgtggtatccaatgccttcgccgagccgttcttgcggtaagacgcttgctgcggcggtcgaggctgctgttgttgctgcgccaaagcccacgccttgcagcaaacggctgattgtgaagaggggatgccctgaacgacagcggacagtgctgttcccgctatgaggatagcgatgccggcgatgataacgagtgagcacttgccgttgtcgataacagggccgacgaacagtcgtgctaacgcggcggcaatggagaagacgagtgcaagtacgccggcaaggctcgcaccgtaaccttggcctgccaggaagacgctggttccactgttgagtccttggcccatgacgaagcaacagaaggtcagcgcgatgataagcacgaaaataagcgaccacagcttcggatggtcgtccttaccgatatttggcatgagaaccctcctatgattccaatacccgtattctacgtctgcaaaaagtgagatgtaagcgccaaaatgaccgcgtcttaacaacccgctgggcttgaggcagaatcatcgcatcgacttatcctggaaactgcctgacgaaggcgacaggatgcttgtcagcaaggcggcaaatcttaacgagagccaaatccaagagcttgcaaatcttcagcgaggcgttgcagcaatatatcagaacgaatggaccgaacctgtcctctgtcacatcgaaccgcatgaacgcggcctagagtactcgccaacacagagcaagcacagcgcgaaggacaaggtttcttctgaagagcttcgctatctcaactcttgtgtgcttaatccgttcaagctcgatgagccaagggaatacaacttctgcgactgtgtgcacaagatggacatacctgactccatgaaggcacgcttgattgagatggcagggactcctctgtcctcgaggaagccactgtttgaatggtgtgcttataggtatttcaatattggacgcatcctcgacgacgccagggatttatctgccgacagcctcaaagagaggctttgctcccatctgctttcaagctggaaattcgaagatgactcctcacccgaaagctggggaccaatccaatacctgttcattcagtcgatgtttaacgctcatctcaacgagctgagaaagaggggtaccggcatcgagacaacggaaaaggcctcagcactcgccgaagtatcagcggtcttatctcaaacaaggccggtgatctaaatggcgtttgaaaatatagagcaattaatgccggatacgaccgaaacgagattggccttcgaggaggcgcaacgcaccgttgctgattgtgcagatgccgcatggcgggatatttcttccggcgatgtcctaaccgcgagcatttcaacagttcaagaagccgcagatgacgcctggaaagcatgcgagccaacactcaacgctgcaggcgaaactgtccgcgatggcgcaaggaacggagcttatcttggcggcaggttcgtacttggagttgccgacgttggagaaaacgcatatgtcggtgttcaatcgaatattgaactactggccgaagacgaagaagcagcggtgaaaaccgcgcaaacacacgctgttgacgatgcagccaacgcctggggcgacttcatggaagccgatgagcagatacgggaaatcggagactatgtcgaaactggaggcgaaatcgccactgaagttgcgcttggtgccgtagccgtcaccgcttctgcccctgcagcactcgctgctggggctgtactcgttcttgacgaaatgggaaagagcttggaagccggcgctgaagacggtgagatatctcaggaggatatcgtcggagaagtcgttgcgggaactgttacggcagcaacgcttcttgccggacgaggtctaaataactttcttgcctcaaaggcagcagaatcgggcgcaagctcacgaattctggatgatgccggaaaggcaatttacgaaggcgaccgactgcttcccaataacgagtttgcgatcgacggcgtgaagtgtgcaaccgacgatctcgggcagctttaccgcgttggcgacgacctcgttccgaacatgagctatgagatcaatgggtataaatacgttaccgatgcaatgggtagggtcgaatcggccgaaggcttcttacaactaaagacccacgaaggtcgtttgaccatcaaggacactatccagtcaatcggaaaagggtttgaagagctttttgatcaaagaggccatctgattgccgaccgattcaatggatcaaatggccttgagaatattgtcgccatgggcggcgaggttaaccaaaagcctatgcagcaatcgagcaaaaatgcgccgatgctttggctgatggcgctgaagtgtttttcaaggttgagccactttatgagggcgggtcattcaggcctagctcgtttgctatcacggacattattgacggcgaagagacggttacgtttcttcttaacactgcaaaggaaatgtaatgagtgaaaagaagatgctacaagggatagcttcaattcttgaggaaaccctccccgaagactggagcaaggtcgtgttttacgccgagtacgccgagggtgcgttctctattgagtattacgttgctggcagcggaaaagacgacttcgttaaatgctttgaccaaaaaggcgtttcgagggcatccttgatgaaaaactttatggctatcaacaagttcattgaacctgaaagggccgcgcttaagcccgaaaagagatggggatcgatgacgcttattctccattccaacggcaagttcaaagttgattacgactactccgacatgacagaaaacgcttacgcccgaaagaaggcctggaaaaagaaatatctcgcctagcaacgaacggtctgggaaatcaccgcaaagccacccgtgcatactcttcgagcgcacgcgtcgtcggcaacgtttcgaccagcgcgtttttgggagccatgcaaacccctgttcaacattcctcgggagtgattgctctctatgacgaatgggattccccatcggggaatcccattttttgttgccgacgacgtccggtataatttttccgtttacgacgtcgttcggaaagggatgccgacctctatgcgccagggattcgacaacgaaaaatacatcgagctgcaagccgccaacatcagaaagcgcatcgcgcaattcggcggcaaactctatctggaattcggaggcaagctcttcgacgactaccacgcctcgcgcgtgctgcccggctttgagccggacaccaagttccgcatgttggaaagtctggtggacgatgtggaaatcgtcatcgccatcaacgccaaccatatcgaaaaaggcaagacccgcggcgacctcggtatcccctacgacgaggacgtgctgcgactcatcgacgtgttccgttcccgcggcttcctcgtcggctccgtagtgctcacccaatacgccaatcagcccgccgccgacgcctaccgccaccgcctcgagcaactcggcgtcacctgccgcctgcactacccgatcgccggatacccgcacgacatcgaacgcatcgtttcagacgacggatacggcaagaacgagtacatcgagaccacccggccgctcgtcgtggtcaccgcgcccggccctggctccggcaaactcgccacgtgcctgagccagctctaccacgagcaccagcgcggcatcgacgccggctatgccaaatacgagacgttccccatctggaatcttccgctcaaccatccggtcaacatcgcgtacgaggctgccaccgtcgacctcgacgatgccaatatcatcgacccgttccatctggaggcgtacggcgagaccaccgtcaactacaaccgcgacgtcgaagcattccccgtgctcaaagccatgatggagcgcatcatgggcgaaagcccctatcagagccccaccgatatgggcgtcaacatggccggatacgccattgtggacgacgatgcctgccgcgatgccgcgcgtctggaaatcgtgcgccgctacttcgccgccgccgtgcacttgaagcgcaccggcactggcgaggaacaggtggagcggctgcgctccatcatgaaccgggccggcgtgacccccgatctttctcccgcccgcgccgtggcccttgagaaggaagccgccaccggtgccccggctggtgccatggtgctgcccgatggccatgtggtcaccggcaaaaccggcgacctgttgggcgcggccagcgcgctgctgatgcacgcgctcaaggccgtcaccggtgttgacgaaaccattccggtaatcgacgatgccgccatcgaacccatctgtcggctgaaaaccgagcatctcaacagcgtgaaccgacgcttgcactcggatgagacgctgattgcattgtcaatcaccagcgccaccagtcctgtggccgctcgcgtcatcgacgggctcaaacagttgcggggctgcgacgccttcttctccgttatcatctcatccacggacgaggcgctgtatcgcaaactcggcatcaacgtgtgctgcgaaccgaagtacgaacgggtgagtctgtatcaccggtaagcgccaccgataagcgcggtatgccgcgaatcgtcaagccggtaatcatgcagcatgcggcctgacgattcgctgctgtcgcattgtctctcccctcggccatgctgggcttgttttccgtttgttggagagaacggggaatgccatcagcactacggaaagagaaggattatccgtgaagcggttcgtgggtttagacggtattaaaggactagcgctgatagccattgtgctgtaccactgcatgcagcaacggctgccaggcggattctacggagtcgacgtgttcttcaccgtctctggattcctgattgccgtcagtttgattcgttctctggcggaaaccggatcgctgaatctcgtgcgatatattcccaagcgtgcagtacgtctctatccggcgctgtttctgctgattccggtcatcgtctccgtcggctggctgttcgatcacgacattctagtttccatccgcgaccaagtcatcaccgtgctgctgggctgctacaactggtacgccattgccggaggccaaagctatttcgaccaaatgaacccgcaggtgtttcgccatctgtggttcattggcgtgctcatgcagttctacgtcatcgtgccgttcatcgtctggctgatgtggaagctccgccagacgaaactgtcttcactcatcccactgggactcgcggcgttcagcagtatcgccatgtgggtgatgtatgtgcccaaaggcgaccccacccgcgtctacttcggcaccgatacccacagcatgggcctgatgctgggtgtggctctcgcctggtgggtcaccgctcctcagttgggccacgctcgccagagggctgtgccgatgccccgcaccattagctcgagcgcttcggcagccgcacatcgggctccgttacctcagattcccgtggagcatcgcatctggaatgcggcggcaccggtattggcgttcctcagcctgattgccttggtcaccatggcggttatcggcaaacaggatgcattcgccttccgcggtggcatcatattgtccagcttgttgtccgtgctgctgattgccggtaccatctccgacgattcctggatgcaaagcctcatggtgttcaagccattggcctccctcggcaagtattcgtacggcatctacctgtggcactggccgttgtggattctttccagcgcccttgccccgaagatcttcaaggcagtagggccttggcctctcatcatgaccgcgttgctcaccgccattgcggtgatgatttcctggctgatggtggagaaaccggcggcaacgcactcggcggtatccgtcgtggtgccccttcgcacgaacaagaagaatcatgtggcccgggttattgccgttgacgttatcctggtgctgtcgttggccggctgcgtgcagggcattgctcatgcacctgcgaaaaccgccatgcagatccagctggagcaacaggccgcacaactggaacgtatgcagaaaaccgaacacgtgctgctgcgccatgccgtgccggcaccgcccaagcccaagcatgagatgcccaccggcgatcagattaccgccataggcgattcggtgatgctggcctcatcacagggcctttcggaagtcttccccggcattcagaccgacgcgagcgtttcccgctccatcatggtcgcccccgaactcatcggcaacgctctgtccgccggcagtctgcagcagtgggtgttgatcggccttggcaccaattcggcaatcacccctgatcagttggaccagattcgtaatatgatcggccccgaccgcgtgctggtactggtcaatgcccacggagaccgtacgtggattccacctatcaaccaggtgcttgccgactatgcggccgcacatccggacaatgtggtgctggtggattgggatgccacagccaacgcgaacgcgcaggtgctcggctccgacggcatccacccgagcatggatagcgatatctatgcaaaggcggtcaaacaggccatcgaacaatggatcgcaagcggcaggtgaacggcaggcaacgctgagttgtccaaccagtcgtgaagaacggctatgctgaagactgcatcaacgagaccacacgttgggagacatggtgagcgcaatccttgaagggaagcccgataagaatcttattctcgttacgggaaggattcatccgaagttggctgaggatgtcgccgagcagctcggcatcgacgtccttgaaaccaccgcatacgatttcgccaacggcgagatgtacgtgcgctacaccgaatcggtgcgtggcgccgatgtgttcgtgctgcaaagccactacaagcccatcaacaaggcgatcatggagcagctcatcatgatcgacgcattgaagcgcgcctcggcccgttccattactgctgtctgcccgttgctcggctactcccggcaggacaagaagcaccgcggccgcgagcccatctcctgccgtctggtgttcgacctgctgaagaccgccggtgccgaccgcatcatgtcggtcgatctgcatgccgcgcagtcccaaggcttcttcgacggcccggtcgatcatctcgtggccatgccagtgctggtcgactacatccgtgatcgtttccagggccatctcgacaacgtcgccgtcgtctcccccgacgccggccgcattcgcgtagccgagcagtgggcgcagcgtctcggcggcggtcctctcgctttcgtgcacaagacgcgcgacatcacccgcccgaaccaggcggtcgccaaccgcgtggtcggcgacgtcgccggcaaggactgcgtgcttgtcgatgacctgatcgacaccgccggtaccatcgcgggcgcatgccacgtgctgcaggacgcgggagccaagtcggtgaccgtggtcgccacgcatggcgtgctctccggcccggccatcgagcgactcaagaactgcggtgcgcgcgaggtcgtgctgaccgacaccgtgccgattcccgaggaaaagcgctgggatggcttgaccgtcctgtcgatcgccccgctgctggccagcgccatccgcgccgtattcgaggacggctcggtcgccgaactgttcgacacctaccccgagcaccacggtcaaggcttcctgttcgcctgatcacgtgcgtgtttgttcgcggaaaacacacaatgcgagacgcgacatggcgtagcctttcggtaaataccgacagtatgatataaatgaacacttgtgggccgaaagcccacgactcccccatggtgtaatggcagcacacgggtctttggaaccctttgtcttggttcgagtccaggtgggggaacggctgacggccgctcgacatccgggcggccgtctattattttgaggtgtttccgccctcaatagacattccgatcgaagggaatacgtcagttatggcattatccgcagccatcgtcctcgccgccggcgagggtacccgcatgcgttccaacaagccgaaggtgctgcatacttttgcaggcaagaccttcctgaacagggtcatggattcggtggccgccctgaatcccgacacgctggccgtggtcgtgcacttccaggccgagcgcgtcgccgaagccgcccgctcctatgacgagcaggtcaccatcgtgaaccaggacgacatccccggcaccggccgcgccgtccagtgcgcgatggcccagctcaccgaatccggcaagatcgacggcccggtgctcatcgccgcctccgacatgccgctgctcgacagcgagacgctgcaccgcctggtcgaattccacaccgcctccggcaacggcgccaccgtgctcaccaccatcctcgacgacccgaccggctacggccgcatcatccgcgaccgcgaaggcaacgtgctgcgcatcgttgaacagaaagacgccaaccgcagcgaactcgccgtgcaggaagtgaacacctcagtctacgtgttcgaggcctccgtgctcgccgaggcgatcgccggattgaagtcgaacaacgcgcagggcgagttctacctgaccgacgcgctggaaaccgccaaggccgctggcaaggtcggcgcgttcgccgccccggacccgctcaccgtcgaaggcgtgaacgaccgcgtgcagctggccgccctgtccaagacctacaaccgccgcgtctgcgaacgctggatgcgcaatggcgtgaccattcttgacccggaaaccacctggatcgaggacgacgtccaaatcggccgcgacgccaccatcctgcccggctccttcctgcaaggccacacggtgatcggcgaggacgccgtcgtcggcccgtacaccacccttatcgacgcgaccgtggacgaaggtgcggtggtcgaacgttcccgcgtacaggaatcgcatatcggggcgcgcacgaacatcggaccgtggacctacctacgtgcgggcaacgagttcggcgaggacgccaaggccggcgcattcgtcgaaatgaagaaggcgcacatcggcaacggcaccaaggtgccgcacctgagctacgtgggcgacgcccggctcggcgaccacaccaacatcggcggcggcaccatcaccgccaactatgacggcgtgcacaagaaccgcaccaccatcggctccggctgccacgtgggtgccggcaacctgttcgtggccccggttgaagtgggcgacaacgtgaccaccggcgccggttccgtggtgcgccacgccgtgccgagcgacacgatggtctactccgagaatacgcaacacaacgtcgagggctggaagcccgcctgggagcgctgaaccatgcccgcacttcaggattccatcaacgccgtccgcgtggccgccgaggccgcggaccgtatcaaagccaccgacatcgtggccttcgacgtagccgacctgctcggcatcaccgacatcatgatgatcgccggcgcctccaacgagcgtcaggtactggccgtggccgaggaaatcgaaaaggacctgttccttaagtgctccggccgtcagccgcgctctcgcgagggcctgaccgagggccagtgggtgctgcttgactacggtgatttcgtgattcatgtcatgcacgaggaatcgcgcgaattctacgggctcgaacgactctggcgcgactgcccggccatcgatcttgaactcgcacacccggaaacggcggagcatgcggaagatgctgccgtcaccaccgcgtaacgtgcgaatcgcgtaacgctgatacttgctgatattcgctgatattcgctgatattcgcgtgtcgggctgcctgttgccgaacgtcattgacggcaccaggcagccctccctttttcctgtttcctcactggaaccgaaaggatcgtcactatgaccaatcatgttcgttccgttttccttatccgtcatggacgcacctcctacaacgccgctcacaagctccaaggccaggtcgacattccgctggacgccgtgggtgaatggcaggtcaagcagaccgccgcggccttgaaaaggctgtacgtcgatcgtcggcaggaaatcaaccaccggttcattgtctgctccgatttgaagcgtgcgcacgccaccgcgcaagctttcgccgacgtattgggtggaatcgagcccgtcgatgatcgtcgcgtccgtgaacgcagcttcggtgattgggatggccatgccgtggccgaactggccgaacgctaccccgaggacttccgttcctggatggagtctcggggcggcgagctgaagtatggtgccgagcccaaggaagctgtgggcaagcgcggcgtagaggctcttgaggactggtccacgcgtgccggagacgacacggacctgttcgtgttctcgcacggcgcatggattgcgcagacattgcagaccctgttgggcatttctgcaatcgatccgaccttttctacggtggtttcattgcgtaatgcgcactgggtgcgcttggtgccgatggacaatcccgatggcactgtgcgctggcgtctgctggactacaatcacggtccggccatcgccgacaccgacgagtgggaacgcgaacgctgatcgtgtcacggctcccctgctgagccaacaggttcagtgtattcgaaaaaccgttcaagcagtaattgaataacccaatgcctgaataatggcggaaacaagccaaaaagtgtcgccaaatcccacttttgccatttggcgacacgccggcttttgccagaatcgacatctcgtcgtaatgtatacgaggtccaaacaacgggccaacaattgaaaacggggctatagcgcagctggtagcgcatctccatggcatggagagggtcgggggttcgaatccccctagctccacgacgaagccatcaaatcaggcgatatggtggtttctccgctggttcatggcgggtcttgcgactcccatgaatcggatagcttcactcggggctatagcgcagctggtagcgcatctccatggcatggagagggtcgggggttcgaatccccctagctccacaatcaaggccggtgcttcatgcaccggtctttctcgttttctggcctatcggccgacttttgcgcaacattccccggaaagcgtcgccaaggggacgctcttccgattggcgcgacaccggcgtgagcgataacagtaatcgccactacaatgaggtgtggtccctatcgtgttgattatcaaaggagacaaaaacatcgtgaccgtcacccgtgtatatatcgccagccctgaaggcgccaatggccgcaacgtcgtcgcttacggcatgctcaacgcattgacttccaagtacaagaccatggtgttccgccctgctgtgtccaaccatgacgaattcaccccgatcctgctcgccgcctccaatgccggactcggcgtggccctgtccaccggcctcgatgtgcacaaggtgcgcgaggataaggacaccgcccgtggcgatatcgtcggcgcgttcaacgatgccatggacgtttcccgcgcggacgccgccctgatcgtgggcaccgacaagtcccacgtcaacgatccgaccagctatgaattcgacgcgaatgtcgccgctgatctgaaggccggcgtgttcctagccgtgtgcaccatcgaccgttggccgcacgagctcgacgagaccgtcaagctgtccatcgagggcatggaggccgctggcaacaaggtgctcggcatcttcgtgaccggatgcgagccgcgccacgctttctccgttaaggagaccctcgccaagtacggcctgccggtctggactctgccgcaggtgccgttcaccgatgaatccaccaaggatctggcgctggagaccttccgtaagaacgctcccaccgatgaagtgctcgccgcgctcgatgtggacgtcaccgcgcccatcaccccgtacgccttccagttcggcctgctcggcaaggccaagagcaacaagaagaccatcgtgctgcccgaaggcgaggaggaccgcatcatcaaggcggccgactacctgcttgagcgcgagatcgtgaacctcatcatcgtgggcaacaaggacgccattctggctcgcggcaaggaactgggcctgaactacttggagcgcgcccgcttccaggctatggacgacgagaacgtgttgaagcccatggtcgccaagctgtgcgagttgcgtgccaagaagggcatgaccgaggagcaggcccgcaagcagctggccgacgccagctacttcggcaccatgctcgtggtgctcggctacgccgacggcctggtctccggctccgtgaactccaccgccaacaccgtgcgcccggccctgcaggtcatcaagaccaagcccggccagaagctggtctccggcgcatttctcatgtgcttcaaggaccatgtggccgtgttctccgactgcgccatcaacctcaacccggatgccgagcagctttccgaaatcgcgttgcagtccgccgagaccgcacgtgccttcggcatcgacccgaaggtcggtatgctctcctactccaccctcggctccggcaagggaccggacgtggacatggtcgaggaagccaccaagctgctcaaggagaaggctccgtatctgccggtggtcggttccatccagttcgacgccgcctggtcccccaccgtagccgccaccaaggccaagggcaacgatgtggccggacacgtcaacgtgttcgtcttcccggacctgtgcgccggcaacatcggctacaaagccgtgcagcgctcctccggcgccttggccatcggcccggtgctgcagggcctcaacaagccggtaaacgacctgtcccgtggtgctctggtgcaggacatcatcaacaccatcgccctcaccgccatcgaagcgcagtgagcccggcttagctcccggtggctcccgccagcgggagccaccgtaatgcttattttgtagcaagcaacgagtaatctaatcaacggtaacccgtgtctcacgggaacattcaatcacaatggaggatgcccacaatggcgaaaaccgtccttgtcatcaattccggctccagctcgatcaagtaccagctggttgatctcgaatccggcgaaggcctcgcttccggcctcgtcgagaagatcggtgagccggtcgacggccactacaagcacgagtacaacggcgaaaagcacgagcttgaagagccgattcacgaccacgagcagggtctgaagcgcgtgctcggcttcttcgaggagtacggcccgaacctgtctgaggctggcattgtcgccgtcggccaccgtgtggtgcagggtggctccatcttcccgaagccggccctcgtgaccaacaagaccatcaaccaggtcaaggatctggctgtgctcgccccgctgcacaacggcccggaggccaagggcgccgaagtcatgcgctccctgctgccggacgttccgcagatcttcgtcttcgattcctccttcttcttccagctgccgaaggccgccagcacctacgcgctgaacaaggaaatcgccgatcagttaccacatccgccgctacggcgcccacggcacctcccacgagtacatctcctccgtggtgccggacgtcgtcggcaagccggctgaaggcctgaagcagatcgttttgcacatcggcaacggcgcttccgcttccgctgaggtctccggcaagccggttgagacctccatgggtctgaccccgcttgagggcctgatgatgggtggccgtaccggtgacatcgacccggctgtggtcttccacctgattcgcaacgcccacatgaacgtggacgagcttgacgccctgttcaacaagcgttccggcatgatgggcatgaccggctatggcgatttgcgtgaggttcaccgtctggtgtccgagggcaatgaggacgccaagctggctctggatgtctacgtgcaccgcatcgtcagctacatcggcaactacacctaccagatgggtggctgcgacgtgatcaccttcaccgctggcgtgggcgagaacgacgacgtggtccgcaagatggtgtgcgacaagctcgctccgttcggcgtcaagctggacgaggagaagaacgccacccgctccaaggaaccgcgcatcatctccactccggactcctccgtgatcatcgccgtgattccgacgaacgaagagctggccatcgcccgcaagtccgccgcaatcgccgaagccggcaccgacacctacggcaacaccttcgccaagtaagtaaccgccgttaggatctcaccaatctctagttgcaacactatgggggctgattccgattggaatcagcccccattcgtatatggtcatgagacccctacccctgcgtcatactccccctcagtcgcctccggcggactgagggggggtccaccagaacacaggaccccttactgcctcagcatgccgctccacataccgacgaaatcaggcaaggtcttgcgcgtggtggccacgttgatgacctcgatatcgggaatacgcagccccagcatcgcggcgaacgtggccatacggtgatcagcataggtttccatcacggcaccgtgcaacgtctccgccggcaccggttcgatacgcaatccatcaggcaattcctcagccgctcccccaacacgacgaatctcgttgaccaatgcctccagacgattcgtttcgtggccgcgcaagtgaccaataccaaccatgtctgtcgacttatcagcaaacaccagaatcgccgccaacgagggcgcaatctccccggccgccgtcaaatcgaacgtacccagcccacgcacggtgccgtcaccggtcacttcgcaatagcgcacgccatcgattgtcgggaacgatactttggcacccatctgttccagatagcccggcaacaaaccacccggctgggtggtggtctcaggccaatgaggcacccggaccgtgccgccggcgatcaatgccgcgccgaggaatggcgccgcgttcgacaggtcgggctcaacggtcaccttgctcggcagttgcattgcgcgcggttcaaccgtccatgtgcgggcggattcgtcggcctcaaccgcaccgccggcaccggtcacatcagccacagtcatgcgaatgtgcggcaggctcggggtcttctcccccgtgtgcgcgaggtgcagaccgccaggcagtttggaactaatcagcaacaggccggagatgaactgggaagaaccggacgaatcgatgctgacctgcgcctgggcagccggcaaggttgcaggcggcgtaatagtgaacggcagacggccaacctcgccgtggtaatcaaccgttgcacccagctgttccaaaccgtcaagcaccggcttcatcgggcgtgcataagcctgttcgtcgccatcaaaattcactgggccatctgcaaacagggcaaggccaggcacgaaacgcatcaccgtgccggccagtccgcagaacacattgacgttgccatggaatcggccggatacgggaggagtaaccgttacggtggtgtcggttgcggaatccacgtcgcagcggacaccgagggcttcgagggcgcccatcataaggtccgtgtcgcgcgaacgcagcaggccaatcagagtaacgggcttgctgccgagggcggcgagaatcaggtagcggttggatagggacttgctgcccggcaccgttaccgtagcgttcaacggctgtgtggcgagcggggcaggccagagattcgcgagttgttcagtcataaggccaaatctatcaaacaaattattcaccggtcggcagcgatgcgggattcgatctgctgatcaggtgcggaagacggctgctcaaaaccgccttcgatggcctgcgcgtgcaacaactgagcggccgcgcgatcggcctcgatggcggcgatctggcgcgagaacacgatgaaccagccgaggaacgccagaccagccaacgcctccacattggtgagggtgttgtgacccatcatcatattgacccagaatgcagcgcatacgagcgcggtcaggtcggaggccaccatcactgctttggacaggcgtggcgcaagccacggcaggagcacgaacagcagcagcatgacgaacggcaggcctttggcgcatatattgtgcaagagattgtgtggcgtgtaccgaaacacgccgatgccgatgaatgccaggccggccaccatcagcaggaaggacagaatggagatgcgcagcatgaaatgtgggatttcgtagccgcgattcggatctctgttggtgcggtcgtgccagaggcgctgtagccgttcggtggtcaccagttcggagatggcgaagtagctgacgatgatgatgcatgtgccggcaagaatcagcgtggagttgaacatacgggccgcaaacgtggttctgtcgccgagctgcgaaaagttgttgtgataccagtatgggtcgtcggtggtcatgccggcggtgaccacgccggagatgacgaagaacggcaacagactggcaatagttttggcgttcatcatctccgcctgtacaaaggtcatgtaccccaccacgccggcgaaggcggcgcagacgctggagatatagccggagaagatggcattgcccatcatgtcgttggccgcaccgatgagtgcaaaagacgacaggaaaatggtcgaggcatacaccaccgaaagggcgacgatttcgaaaatgcgacgaatcggtgcaaaccaaccatgtttgaggttcaatgaacgtgatttgcgcgcatagccaataatgaaggaaatgacgccgcatgccgccacgatgcccgaacataccatgaatcggcgttgcgtcagctgccagatggccggcgcgtattccatgtacaggttcatcgataccgcgccaacgacggcgcaaatcaagaaggagatgagtccggaggtttctgcacgctgatgacgtcccatgccgggcctcccctatctattcgatgccgcgttatctttcaacaacaaacaaaactccccccgaggacaacgctttactagcaagccagcgggatttggctgtcgccattctactgaaaatctgaaacactacaaaaaaacgattatgtacgggcttcttagcctttgcgactatcgttaccgccttgccgagtaccgttgttcatgcagaaagaaagcagtattggacacaatcgaatgagcgtgtcggtatcgttgaaaaagtaatgaatgacggttctatcggttcaacctttaagggacgaaccagccgcggcaccatggcgctgatgcatgactatgccgagctcatcaatgaattacgtccgacagcagagcaattcaccgagatcgagcaatactgggtcaaacgaattcaggcgttcttcaccagcaaaccattcaagctggagtccgacaactcgctttccgttgatgcggccgtggaacatctgctgcggcaggcagcgcagcggcgaagggagaatccgggcaccatgtacgtcggcaccgtcctgcagcatctcgtcacggcaaagctcaccatcgttgctccggaagtggaaatcaacggcgcgtccgttgctgatgatccgagtccgcggcttccaacggtgaggccgcggaccgtctcacaaaaccgtccgcggctccgccctcctgtttcgtcgcaactgactacaccgacgggttcgggcgcttcgtcacgaaaacgccattgcgatgcaccgtatacgcgccgccgtcactgccccgttccgcccggaacaggacgatcggctcccctgcgatgtcgcgcagttcgacatccgatctgccacgtgtcagatagaagtcgaatatggcgtcgtcggattgacgcatggtgtgcagaacgtcagaggtcacgccgctggcgggcgaccgcaggttggcttccggctgccggccatcctgcggctgcgcggcaagccagcctcccacgaatcgcgtcagatcgctcacgcccagatcgcagccgaggaaatacgcctccccttcgccgtacgtgttgcgggtgatcgcggccatgccgtcaagctcccactcatccgcttcttcgccggcatacgaggcaagcacctgcacatgcggtccggcgacggtcacgtcaccgagcttgtcgatgacgcgatcgagccagtcgaaatcccaatggtcttcgatgggctggaggcgatctcagctgaagatggcaagggccacggtgttgacgccggcctggcccatcaggcggatgtcgtcatcccagatttcctccggccattggtcgggactatagtcgccaccgaaagcgatgccgcgtccgtccgcggtcagcagttttggccatgcgaagtcacgtcatgcacgcacggttatctcctttggcaggcggcgcagggccacggcccatatcggataccagctgatactagctgatagacactcctggccgatagtcgacacgccgccggttccggccccactgccggaaccgacatgggtatgttcatgaccgccgaccgcaggaacgaacaggcccgtccgccacggaccgcatcttgcggttcaggcggacgggccttatgggagggatgggaacgggagatcagttcttaataactgcctgcgcctcatcgtcgacgatctcgccggaagcgagcttggcttcgagctcctcaacgatctgcgcatgcatcttctcatcgatcttgaccttgaaccagaacacgacgaggctgaggatgatgagaacaagcgggacgtagaaggcgaaggtcttgaacgtggcgatgttggacgcggtcatgtcggctgccgtggcatgaccggtcatgccagccgcgagggcaacggcaccgaccgcaccgttggacatcgcgccgccgatcttgtcgagcatgggacgcaccgacaaggtgaccgcctcgttgcgcttgccgttcttcagctggccgtactcgatggagtcggtcagcgacagaatcgcggtcatctggatgaactgcgcaggcacatagaagaagatcagggcgacgatgacgaccggcaggttgctggagaacagggcgagcatcgtgtagccgataatcatggagaccatgccgccggtgaacaggtagcgacggggaatccagcggttgagaatcgggtacagcggcgccatgatgaatccggcgatcagcgggatgatgccggtgatggagaaggcggcaggctcgtcaagcacgaacacgaagaggtagtacatcacaccggtcgtgatgacgtttgcgatggcgtacagcaggtaggacagggcgacccacagcagctggtcgttctggaacagcgccttgaacgcctcgaacgggttgccgttcttctgggccttggcacgcagcgcgctggtgctttccttggtgccaaaggcgacggtccaggcggtaatcaggccgaggagcgcgacgatgaagccgaaggaggtccatccggcctggccctggcccttggcgccggtgaacgtccaggtgaagtagctgacgatcgggatgacgatgacggtgatgccgttgtagccgatagagccggtgaaggtgccaagggcggtgtaggtggaacgttcgtgggagtcggaggacaacgccgggatcatgccccagtaggagatgtcacgcagggagtagaacacgtcaagcacgatgaacgtgatgacgaacagcacgatgaacagcgtggtgttcacgttgaccagtccgaacatgccggagaagatgagcatgatcaacacggaggagaccagtccgccgatgaactgccacgggcggaaacggccccacttggtggtggtgttatccacgaggttgcccagcagcggatcgatgaagatctcggcgatgcggataacgacgatcaggccggtgatgacggcgatcatttgggcggctagagccttgctgtagctgacgaacaggcagctggtgacgtacgtgacgaagtacgtgctcatcgcgttgtagaaggcagcctgccccaagttgccgcacgcgtaggcgatgcgctggcctaacccgcccttcctgcggacgtcaccgtccgcgacattttcgttgctcattaatcttctccttaagaacccagagcatggaatcactcattgattttgtaaagtatagcatacaagttttatcaccgtaagcatacaagttttatcaccgaaagtaaaaagcattagtaaacaaggagataaacagcgtgtcgcaaggatgggataacatgagctgaaccgagacattgcatggacgcggcgtagcgtcgacggcaagcagtgccagtgatttggaagcggtaaacaggatttgcgttttatataaaaactgtttatccttttcggtaaaggaggccccggcctcttccataatatcattcacaacgaggtaatgacagaaagcaggagagcatgacagacgtcacacatgtcgatcgcgcatcgcaggcttggctgaccgacccgacggtgttcgaggtgaaccggactccggcccattccagccacaagtggtacgcccgcgacccccagagcggacaatggtccgatctcaagcagagccttgacggcgagtggcgggtcgaggtcgttcaggccgccgacatcaacctcgaagaggaacccgcgacggccgagtcgttcgacgactcctcgttcgagcgtatccaggttccgggccacctacagacggccggtctgatgaaccacaagtacgtgaacgtccagtatccgtgggacggccacgagaacccgttggaaccgaacatcccggagaacaatcacgtcgcgctctaccgcaggaagttcaccgtctccgcccccgtggcaaacgccaagcaggccggcggatcggtgtcgatcgtgttccacggcatggccacggcgatctacgtgtgggtcaacggcgcgttcgtcggctatggcgaggacggcttcacgcccaatgagttcgacatcaccgaactgctgcacgacggggagaacgtcgtggccgtcgcctgctacgaatactccagcgcctcctggcttgaggatcaggacttctggcgtctgcacggcctgttccgctccgtcgaactcgccgcccgcccgcacgtgcacatcgagaacacgcagatcgaagccgattgggatcccgaggccggcaccgcttccctcgatgccgcgctgaccgtgctcaacgcggccgacgcggccacggtccgcgcgaccctgaaggacgccgacggcaacacggtgtggcagacgacgggcgacgcggaggcgcagaccgcgatctccagcggaccgctgcagggcatcgccccttggagcgccgaaagcccgacgctgtacgagcttgacgtcgacgtcatcgaccaggcgggagacgtcatcgaatgcacgtcccagaaggtcggtttccgccgcttccgcatcgaggacggcatcctgaccatcaacggcaagcgcatcgtgttcaagggcgccgaccgccacgagttcgacgccgaacgcggccgcgccatcaccgagcaggacatgatcgatgacgtggtcttctgcaagcgccacaacatcaactccatccgcacctcgcactacccgaaccaggaacgctggtacgaactgtgcgacgagtacggcatctacctgatcgacgagaccaacctcgaagcccacggcagctggtccctgcccggagacgtcctcaccgaggacaccatcgtgccgggcagcaagcgcgaatgggaaggcgcctgcgtcgaccgcgtcaacagcatgatgcgtcgcgactacaaccacccgagcgtgctgatctggtcactgggcaacgaatcctacgtgggcgacgtgttccgcgccatgtacaagcacgtgcacgacatcgacccgaaccgtccggtgcactacgagggcgtgacccacaaccgtgactacgatgacgtcaccgacatcgagacccgtatgtactcgcatgccgacgagatcgagaagtacctgaaggacgacccgaagaagccgtacctctcctgcgaatacatgcacgccatgggcaactccgtgggcaacatggacgaatacacggcgctcgaacgctacccgaagtatcagggcggcttcatctgggacttcatcgaccaggccatctacgccacccagcccgacggcaccaggagcctgcgctacggcggagacttcggcgaccgtccgtccgactacgagttctccggcgacggcctgctgttcgccgaccgcaagccttcccccaaggcccaggaagtcaagcagctgtactcgaacgtccacatcgacgtgacgaaggactcggtgtccgtcaagaacgacaacctgttcaccgccaccggcgactacgtgttcgtcctgagcattctcgccgacggcaagccggtctggcagtccacccggcgtttcgacgtgcccgccggtgagacccgcacgttcgatgtcgcatggccggtggcggcgtaccgcgccgacgcccgcgaactggtgctgcaggtttcgcagcgtctcgccaaggcaaccgattgggccgaaagcggctacgagctcgccttcggacaggccgtggtgcccgcggacgcgatcgcgacgcccgacacgaagccggccgatggaaccatcaccgtgggccgttggaacgccggcgtgcgaggcgccggacgcgaggtcctgctttcgcgcacccagggcggcatggtctcctacaccttcgccggcaacgagttcgtgctgcgccgtcccgcaatcaccaccttccgtccgctgaccgacaacgatcgcggtgccggtcatggcttcgagcgcgtccagtggctgggcgccggccgctacgcccgctgcgtggacaacgtgctcgagcagatcgacgacagcacgctcaagggcacgtacacgtatgagctcgccaccgcgcagcgcaccaaggtgaccgtctcctacacggcccacaccgatggccgcgtgaacctgcacgtcgaataccctggagagcagggtgacctgcccaccatcccggcgttcggcatcgaatggacgctgcctgtgcagtacacgaacctgaggttcttcggcaccggcccggaggagacgtacctggaccgcaagcacgccaagctcggcgtgtggagcaccaacgctttcgcggatcatgcgccgtacctcatgccgcaggagacgggcaaccatgaggatgtgcgttgggccgagattaccgacgatcacggccacggcatgcgcgtcagccgcgccgatggtgccgcgccgttcgcggtaagcctgttgccgtactccagcttcatgcttgaggaggctcagcaccaggacgagctgccgaagccgaagcacatgttcctgcgcgtccttgccgcacagatgggcgttggcggcgatgattcctggatgtcgccggtgcacccccagtaccatatcccggcggacaagccgatcagcctcgatgtcgacctcgagctgatctgatcagaattgatccgatagtccaccgtgcaaacgatgtggcccccgacttcctcgcaggaagtcgggggccacatcgtttgcacggtccttgttagtccagcggatgcgccggatatcgatgcagatccaaacctagtcgttgtagagcatcaatgaataaagatgtcgctcataagctatcaagagaatccagaacctttttgaattcatatgctcgacacgcaatgtatccagcgtcgtttataatgattcattgtgccttaatggcgcatcgggctatagcgcagtttggtagcgcgcctgctttgggagcaggatgttcccaaagcgttgcgcttgcgacacccgataagccctactcccgcttgggttttaggacttcaactaaaactgaaaaatgaccgccagtaacactcagtaacaatgaccgcagacctccgattttctcggcctatctgagtgtcaaaaatgagtcatctggaggcacagaccgtcttgaggtatgtgtagactaaaaaagttatgccaagtgacataattaccgggccgtagcgcagtttggtagcgcgcttgctttgggagcaagatgtcgcgggttcaaatcccgccggcccgaccacgaaagccctactcccgcttgggaattaaggctttttcttttgcttgaaaggccgtttcggaggctgaaaaagttttactgggttttactgagtctaccgacgcaaatctttccaccttatacttgttaaacaagtgattcatgcgctttcgacgtcgaagcgtaaggatttaaggagtcgatatggaagacgagccactgtaccgcctgataatgcctgacgggatgcatttggccaatcctcaagacgatcccagcgtctatctgggagccttcttcgatgatgaaaaccatttgaaaggacaagcacgttgggaacccgtcttcgacaataccgacgacggagacggcgcagaaatcggcaacgatgacggagacacacctgcagcggctatggctgccgccgcaattgcgattgccgcaatagtcggaaccgcatactatctagcgaacaatgagacattcagaagctggtgggataaaaccgtcgttcattggtgggaggattcagttaaacctacgatgggtaaactttggaacaaagtgactcgtcgttcaaaaaagaatgatgtcgaaacgcctcagccgattgcattactgacttccgctcctgaaacgacaaacgcattctccaaggaagtcgatgacgcgattgaagcatgccagttgcacatggacagcgaggaggcacaaaatcgtttgcttatcatcatgtacaaggcaatggatctcgcaaaggatattcgtgaactttcctcggccaacattcaagaatccgctttcgatgaaaagacgaaactggagttgcgtcagaccatggaaaagctgacaacgcagaacgtgacagatcttatcaacaaggccttggaacggaacattccgcttcttgagaagcaggagaaattcgacgcttggtctgcgcttttagggaagatgaccagtgatggcaaatttgtgcccctacgcagcgatgccttacgaacggcattgagtctagaaccctaccgagcaatgctggaagccccgtcacataaaggcgaataagtaaatgcggtgagtgatactgcgcaagcaacattactcaccgcatgcctatgcccgtcgcctatcaagcaacggcactagttcacttaagccgagtttcccatcattgccataatgcaattgccctcttttcacccatgagcggatagtgttggccggcagacggatccccgctttcgcgcattcagcactcagttgcttggctgtacctcgtacttcgctgacgaccagtttggcaagcagacggtcggctacggcacgacggttcaccttgttgccgcatccagcgcattcgccgtactgttcgtcgggttcgccccacaccacgcttccacaactggggcaagcgccgaacgctatacgcggcttggcggggttgaccgccgtgtggatccgtcgggcaagattggtgatgtcctgataccaagcgagcacgtccccgctcgacagcaagggaactggatccatgatcgcggcgttcgccagcgccttcacagtggcgcgcgggtccacggccttcgcgtagtcgaaacgcaaacccagttgtcgcagtagctgttccgtctcgcagtacagttcccacatgccgtcacgcaacggcgacggtgcctgcgccggcgtggaatgcctgttgccctgtatgctgacgctggcccgtttggtggcgaccaacagcagcggcatggcatcctcacctatcatggcgagggcttccatgagccgtcgctcgcactccttgcacagcagccttccagcaacagtgctggctccgtcattgttcacgcatggccctgtcatcgtcgttccctccgttcaagtgttgtcttaggtcttgcaggctgtcggtgtcatatccgcacgagcaccaccagcgcagtccgtggccggtagattcggtgatgaccagatgcggttcactcgtggttgtcatcgtcgtgtctttcgttcatggcgcggatgtgttcctgcatggcggtgagcgacgggtagttgcggccgcacgagcagacgtagatccgcccgtgcttcgcggtgtccacgagcctgtgcctgatggtgggtgtggggtcgtcaaggaatgccagtgggttgctcatgatggtttctccgatcttgtgttccagatggttggcgaaccggttggggtcgcgtgtgacgtatccgcattggcagacgcgcatgtatccggcggcggtgccgaacccgaccgtgagggccggtgtgcgcagcgtggccagtaccgccggcacgagtttggcgagccgatgcgtgtggatgcttggtggttgtggttggtgtgtgatggtcatggtttattcctctaggctgtctcgaaagcgcttatctcccctttgctgagttgcggtccgttccatttggacgctgccgtgcgtttgggtggtttgaatggcttcacgctgatcggcgtgcggaagcactcgtgggctgcgaggtacatgccgtcaggtttgatgccccgcgtgccgcatggtgtgcgcagtccaatcagcgtggtgccggcgatgggctggatgcgcgtgaacctgcggcccaggatgatggccacggccagatccgttgcgtccagtacgccggggtcgtaaatctcttcgatcggccctccggtgtccaccgccacccattcacggcatgtgccgcagcgtctggctgtcaggtgcgcggggttcgcgcccgacgggcacaggagtttgagccacggtggtttccgtctcggcatcatcggtcgcctcccagctggcggcggatggtctgccagatcgtctccaactcagattccttcagtccgctggtctgtccgcgctcgaacagatcacggcgaatggcctcggcattgtcggggtggttcagcagtcttccgtaggcccacgcgtgaaggtcgttgttccggcttccggccggtatcggcgtcatgtcgggtttcccgttcgctatggatccgaccgtgacgggccggcgcattagctcgctcaatgacgggatccgcgccgcatgctccggcttgggcgtggaagcttggccatcgggttcggtcacgtagccgtggtcgatcagccatcgcaccatcctgggcggcatcatcggcggctggccgtctggtaggtcaagcagcaggtagtcgccgccggatatatgactgcccgctccgaccacgtagcccttgccttcgcagcggatgtctaccggcatgcccttctcgtggacggcgttcttcagccggccttgcagttcgggcgggatcaggtagtaggcgtgtgcggagggcaagccgttcctgcggccggtgggtgtgcctacgaggtacgtcttcgggaagtcctcggagccgtattcgccgatttcgcggttgaagacgtcccagccggtcggagcgtctttgagcacttcgccggtggccggatccttggccacgtccagatcgatgaccgccatgcccgcaacgggaacgaccgcatacgcggccacgcccgtcggcggttgcttgccttccggcagcgtgcggtttttggcccagtcgtaggagcgtttcccctcgttgaccgtgccgaacgtgaccggatagccgcaatcgtccggcgtgaccacggtgcctccctcgatgggatccggcaacggtggcaccgtcttggctgcgtcttcttcctgcatggcttcggtcatgtccttggcggtgccgtcgcggtacacgctgaacacgcgttcgttcctgaccaccagcacgcgcacgacctcgccgttgatgcgcttgggcttcgatttcagaccgagcttcgtgacggtgttgcggtgcgccatgtcggtctcgtggtgcgggttgtcgcggctgacggcgtacccgttcgccacgatgcagtccacgatccactgctgcgcttcggtcaggtcgtcggcggatccgatgacgacatcgttccagggcttgtcgccacgcacctcccacaggcggcatgaggccatcaggaacggtgctatgccatgttcgtcgcggaatttcagcaggtcggcgaattcctcctcggctcggccgtccctcatgcgcacgaacacgcggcggcgttccaacgcctcggtcatgctcatgatgactggattgttcgatgcgatgatgaacgtggccttgttcttgaagctgaccgcgttctcctgcactcgacgggcgaccatcgtgtcgccggtgccgatcttcttcagcagggtagcctgttccagggtgatggtgtcggcatcctcgtcgtaggcccacagcgcgccgatcagcttcagagtctcctgatcggtggcgaagccgccgttgccgttgcgccctcccagcagggtcttcgacgtgaccgccgcagacagttcgggaaggctgcgatgcagtgtgtccagtaggatgcccttgccgttgccgccgccaccgtacagcacgtagaacagatgctcgtatggctccaacaaaggggttgcgaacatacgtcccagattctcggcgctgtggctgtcggcggtgacgaaatgcaggaatctgcctgcctgcgacaccagttcgtcggagtagtcaacgtccacgaacgcaccggcgtatggccgctggtctacgtgtccgccgcgttcattccccagatcccggccgatgtgcgtgccaactgcggtctgtgggtggctcagtacaccaacaacaatcccaccggctggcagtcccgaccgtggaactacggcaagtacggcgaggccatgcgccagtacaccagcaacgggcgcatcaacggctacaacggcccgttggatctgaactacttccgtggcacccgcgaacagtgggacaagtacgccaaccccggcaaagccaccaagccgactccgacgccggctccgcagcctgcgccgagtgtggactacgaggcgttggcaaccgcgacgatccgtggcgattatggcaacggcgaaacccgcagggccgcgttgggtgcgaactacgggccggtcatgcgcatcgtcaaccagaggctcaacggatccgcagcatacgcgcctgccgcttccacccggagcgtgagcgtgaccgtgcgtagcggtgacaccatgtccggcatcgccaagcgaaccgggctctggccgttgaacgcgtggagcgtgccctccggcaacatcaacctgatctatcccggcaacatcgtcacctaccgaggcacggcaaccgccgccagcggatccgcagcaacgggaggtcgcgtgcatgttgtcaagagtggcgaaacgttgagtggcatcttcggggccaatggctggcagcgcgtcgcccagttgaccccaatctgatttatcccggccagcggctccgctactagccaaaaccatcatggccttcggcaccgtgccggaggccactttcatcatcaatattaaggagaaacctatggatatttccaccgcgaccaccctcgcgtccgggctcgtggcgctgatcgtgcccgcgttcgcgcaggcgttcaagaagtacatccccagcggatacgtcggactagtatccctcgcagcatccatcctgttcggcaccatcgccatcgccgccacaggtggattcgacggcacctacacgtggggcatcgtgctcgcgggagtagtgggtgttgctcagactgtgtacacgctcgtcaatcaggcttttgatggcaagcttgccaagaacaagatggaatgataaattgccctgacttcacctacttggtgaggtcaaggtaatttatcaatttggaagctatagaaacccctagggctagtcgttttctagcatgctctagttttatagaacaaatgttcgatgatgttggtagaatgaagcacaacccaagagagagaaggtgctgcatgaatcctaccgtcatcgctgcaattatcgccgcagccgcttcgttgggaggtccagtactgtcatgctttctatcgagaaaagcagaggtcagggcgcaaaaagctgaagagcgagcggaagctgctgaaaaaagagcagcggcggcagaacaacgagcggccgacactgcgaaaaatcagcacatggaggatttcttaagcttttacacgccctatgtcaaagcttgcgaggagttgttgtccatcaacaaaagattgggcaattatattctcgaacagctgaaggatgtgtaccactgggaaacgctttcccccgaagagcaaaaacgtcccaatcccaagattcatgatcgaggaacgacgataaatactttatggaggcatcgggatcaactgttgagcaaagcagacaaacttcgcgataaaggcctaatcaagttcggaaaggcctctaaagagattagagaattgcgctctgcgtcggactttgttgggtgcatgttgccacatctatacgatccggatacaagcgaagaaaaggaagacgatgaggcgcgtttggagctcaaacgatattggaaccttgagtctggacagctgggcgctcgcgcagacgatctctttgaatttgcaagagctgccttgcgtgacacagaaacgagactgctgtttgattagcgacagattgtttctgaagagctcaggcgtgcaagaatctgcgatggaaagaatcagcagttgcgctctcaactagctcgcaatcacgtttgttatcggcgcccactaggtaaccaaacgcgcaccttaaggattgacgcctgagaaccttgctgccatttagtagtattgtactatagtagtataaatgtataagtgcgaggaaggctgaagatggacgtagtctcgaatgtcgccagagcgggcgctgacgatgacccctgggaagtcacgtctgtgaaaatgagacgaagcactaagcgtgcagtgaagctctatgccgtcgaacacgacaagacaatgcaaagcgtgctcgaagaggcgcttcaacgtcttcttgcggaaaagtccatgaaatagatgtggaaacgatatgatgtctcagcgtgtaagttcagataaaggagaagctaaagtgactcacggaaacgcccctacgttcatcgagctattcgcgggttgcggtggactcagtttgggtcttcggtcagctggcttccaagaagttctggcgaatgagctttcttccatgcccgctgaaacttttgctctgaacttaatgaatgtcgatatgcgttcacctgagtttcaggcaaccaaacctgaaaatcgtaaagtcttatggatcgacccatcttccgatgatgtatcagaacgtctggtggacaacccattcgagcgcccggaaaccgacatgccagaattgtccggcattgacgattttgaggggaagcttgttgtaggagacatccgtagactgaatactttcattgagaaacgtggaagcgctttgatacatggcgaggtggatctggtttccggaggtccgccgtgccagagtttttctttggccggtcggcgtgagctgggcaatcaacgcaaccagctaccttgggaatttgctaagttcgtcgattcgcagcgccctcgtatggtactactggagaacgttgaaggcattctacgtccgtttaagcaggatggcgaaacttattatgcgtggttcgaggtgtgcaaggcgtttgcaaatatcggctacgtaacgtgtccgatgcttgtgaatgctcgtctggctggcgttgcgcagaatcgccctcggttcattatgttggcaatacgcgaagatttggcggacaaccttcctgactctgtagcagcatggtttgcacaaggccatcgtttaatagacgcaattaaagccggcaatcctgttttcgacaaagaaaagtggcgctattggaatctaaccgatttcgatgcggacaaggcggaaggcacggttttcgatcctttggtcgcgttccgggattcaggaagacagcgcacggtttacgatgccattcgggatcttcaagatgagaacccgcctactcgcagcaagtacgttagggaaatcaactcgacgctcggtgcctatctggatggtggaagcaaaaagatgcagaacctcaagcatccaaatagcacgccgaaggttcaagctcgttttcgcatttatcaggtcatcgccaactcacccaaatcggttggggatgaaatcaaaaagattatgcgcaagcagaagactgatatttctgaagagacttatgagacactgttacgctctgaccttcttggatatgggaatggcatccctgagactccggaacaaatggttcactatttggagggcatggcaacacgcaagttctctcaaagggctctaatcagcacacttccggcacctgctgctttgtctattcccgatgatgtagcgcattattgtgagccacgcactctttcggtaagggagatggcgcgcattcaatcgttcccggactcttttgagtttcgaggtatagccactactggcggtgagcgtagacgctatcaggttccccaatacacgcaaatcggcaacgcggtaccgccgctgcttgggcgtgcattggggaaggttgtgtcttctatactggctttgctctagaagacgaattcctcgggatcagagaaaagaagcgggaaattcttcttgtccatcttgaacaggatgccgtgatctcgccatttgccgtccgcgtcgaaatgagcggcgagatccagcgtcactttatccgcctcgattagcggagccagcagcgatacgttcgggttcttcgtgtgcattacgcgcacgtaccggaaatattcaacaccgtcgattatttccgatgttgcgccaacccaaaaagtctcagggtgcttggtccgcaaccgatccctcaatagtttcatggtccaagacgcgacatagctgcgcttgtcaccatcctgatatttcatgtcaagccggtcagcgttttcattaacttcgagcaccaagccatacgcattcgggcgggagactcggaaagtctcataaagttggagccttgcttcagaggcaccacgaggaacctgcattttaccatatttttcaacaatctcccggtacggcataccgacatccggcacctgagagaacagggtcgaacgagtcggcgtgcgcaacttgccattccgactcaagcgagtagttttgagctcgatgcccatatagtcaggattcttggagttgttacgctgaatgcctagagcatgctccaaagtatctcctacaccgggatcgcctggagtgatggaacgctgcggaccggccgcgttgatttcacgaatcaatttaagcaaatgttgctcgataacactgctcttatctccggattgcagaatgctatacgcgtagtcctgatgcagaagcgagtcagcaacagcggggtctgaaagattgaaaacataaatagcttcatcgataaccgtcagagcaagtaaattgcaagggtgacagtgcttcttgaggtcgtagaaccaaatgcgcggatcacccttcttagtgatgggacgatacagggaagcctgtgtctcaatcagtccattcgattggacgaagaacgctgggacgacgtgtttgttgtcagagccctgaggctgcatctgaaagtcgtggacatgggaatcgtatagaagatcccgaaccggcgcaatggcgtccatgattgattttttgtatccagtgggcgtaggaaccagaaacgctacaggagtgttgagtctggcaaagaccggcgcaaacctttcaattggagtatcggacatgctaagcatagagacctcatttttcatcattgacgcggtacagccataatcatacgagcaaagaactcgtaaccttggaaaggcacagcgttgattcacagccttactaagaagaacagcccatttcgcgaggaggggaagatgtgcagttcatccattcctgattactttgatcccgtcgatccgaacttggatccagagaaagcattctgcctcgaaggagtcatggacgcccgcatgctgtggccggaagatgccgaagagcttatcgagctaaccaacgatacgccaaccttggaagagctgggcgacccgtattatttcgataagttgcgagaaaaggtgagccggctgggtttggagccgaacgacgggcatgatttggaaggtgcgttgggcgagttctaacagaccgattgagctggttggcgtttgaactgtgatccgtttgagtgcctgcggatccgtcatatggcacacaacatttctattgcctttgttcctactgataaggcaatgttctcaacactcttgcgattgactgtctaagcctgaaacattggaatacaaggtatatgaaagaatcaagtttccgcaagcaactgctttcatcagctctgcaagggcacatacattgactgcgatctctcgctggtcagggtcatagtcaggtttgggcaacagggctacggcgtctcctttgacaacgttgttcgcaagagcgcggtctacttcatgatcaatgtgttccattatccaatgatggcagatagaagacagctggattacgctactgtctcttttcctcacagattttctcttggtctttccctcggtaaaaatgtcgaaggaatggctccgtttgaggatcaatccaagcgaatctgagaagcgtttcgacacgccgaagaacttagcccgtgccacagactgacttgaatacaatccgttaacaatgatcgtcacggtgagccaatcccagtcggctcaacaaagacaaccaaaaaccagaaaccgccattttccaacgatattggccccagcaaaagccatttaatccagcaaagaaacaccccgcgaaaacagaatgtcgcaggttcaaatcctgtcagcccgaccggagcccttggaaacattaggttttcaagggttttgttttatccgcgtgaagccaatcgacacgatacgacacgacacgatggatgcgcagcatcctcgcctaggggttattggccaaatccctccccgctgtttttccagatcagctgtagacaagctggaatgcagatatcataatctcacctgtttgtgctgcgtgaatcttcttcttggcaataagttctggcaaatcgatggctctatccaagatcgccgcgagatcacttccatccatcaacaggacatttggacggtgcctgtgattattgttgattgcccgtttcgtgaaaccgctcatggaaataaaaacacccaaggtattgtctagtttgttatcaactttatccgaaaagatgactacttcaggagcgtcgatcggtttggattgccatttggcttcgagaagatagtccatgttgtccaatgtgaatgcgccgtcgatctgttcgtcattgatcttataggagccacgagtggtgatatcgaatgtttggaatagcttggttagaaatttctcaaaagcgtagccccgcgactgggcgtctgtcatctgagtaatcttgccaaattcactcttgagattgacaactgctgcagccatggcagcttccgtctgctggcgtttctcagcagcgatttttctcgtctcagcggctcgattcgcttcgtcattttcgataataggtttcatacgagcagcaaagtcccttactcgttcaactgcttcgtcatgaagctcttttccattaccttgaactttcagaagccacgtagggtccccaagtttggcaacagcaactgcaacctccagcagctcttccgaatacaattgcgggttcattgacatgccatcaataagctgtgaaataagagttcgtttatactcatgatcccaatccagttgccctataagcgtctggttaacaccgcagttaagaaggaatcgtcgtaaatcgttcttataccagaacgctgatctgagtgtttctttaagcgccgcaatcgttcccggggccagtactcgcaatgtcatatatcgagtataaagcttgcacaaaacccaaaaggaagcctgtgcctaagacagatggctatttggagctactccatcgaactctcaagaggctggagactgcggtgtttgacgaaggtacgccgccgcgtgatttggcgtcgttgactcggcggctgcttgcggtgagtcgggagattgagcgtcttgaatccgagaatggcggggtcaacgcatcgaccgcgacagaagtagaggctgaaccgtttgttccgagcgaggtctagcgtcggaaccgaccggcgcaggctatctgaagtggcctggtttttgttccgcctttatagtgaggcggcttgcgccgcttgattcgtataatactcggtttccaccgcttccggtgtcctgtagcccatggactggtgcagccgtttcgagttccaccacgagacccaccggaacgtcgccagctccaggcccttcagatcatggaagggcctgcgccgccagacgagcccggtcttgcacgcggcgtcggcggattcggccatggcgttgtcgtaggagtcgccgaccgtgccggtcgacggcagcatgccatattccatcaccctggtggtgtacaccgtgctggtgtactgcacgccatgatcggaattaaaccgacatcggtttaacagtgacaggggttgccattaccggtggccggaatggatccgcatctgcaccgagcacgggctgacccggtcgatgagcgcgaagggctgttcgccggacaatgcggccgcggaggggttcttcggccgtctcaagcaggagttcttccacaagaggagcttccggggcgtgacgatcgacgagttcaccgtgatgctcgacgagtacatggtctggtaccgcgacaagcgcatcaagaccgaatacggcatgagcatcatggacaaacgcatccagctcgggctcgtcgcctgaaaccatccggtacactgaccaacgaccatacagacaacgaagtccaacaaaacgtcaccacccccaaaccatcagcccacactgcggaaaaacactgccgaacctgtcgaacaaacattgaagcaaaacaaactcgacaccgcggccggcaaaccggccggcatacgcaagctcatccgcaaatacagcgcgtacacgctgctcgtattggacgaatggctcctagacaagcccgacgaacgcatgcgctccttcctcctcgaggtcatggaacaccgctacgacaccgccagcaccgtgttccgcacacaataccccgtcaaggaccggcacgggcggctcggaggaaacgtgaccgccgacgcgatcatggaccgcatcgtccacaacgccatcaccatcgacaccggcgactacaacatgcgccgacaccaggcgaagccggctgaaagcctgtgacaatcagctgactgcgcaccaccggtggccttcagacagaagaccacaggccctcaatcacaatacccatggccttcatccgcaataaccagcggccttcataccatcaaatactcaattacgatatacgaataatcttgtgtccaattagttccacaagctatcgacgtgctacagcataaccggaaataccgcaattcgggtttattagctactaagagaaaccccaatacttacgagaggaaattatgcggcggcgatgctctttctgaccatcgtacgccattggacgcggctaataggagaaacaatctggaattgtaaagacctcaggatcgtaagggcctctctgtccagggtcaacaaactacaaattctgcgatcctgtatcatacaatcaaagttaattcgttctaaaccataatgatcgaacaatctctgtaacaaaccgccccaccggctaagcatctctatcaggttgctcggcgacgccatattccacacagtcatatatcttttatccgaatacagaggtatgcactgtgaagctctgactatttccgccttctttatgcccgtttctttggaggcatccgctatatgccaaacatatgcgtatggcggatcatgcaggatacatcggattagctccaacatatcataaaggcgtttcttggaccctttatcgcattccagagccgcgctagcgaacccagatctttcaccaccttcacaatgtataatccgaagctcatgtctttcggtatccactttgggccagctccgattggctttcatcaaaaggtttagaccgtcaataatctcattgatacagaactcagacacatccttcgtcaaatcactgagcactcgtatatgaatatcgcaatccgtcttctccgtgaatatatgattcacccaacgcgcgccagttatcttatactcagagaaacgaagcatacaatcatctatatttcttcgtgcactactcaactgagcgagcatctttaattcatctaatccaatgcggcaatgagtgcttccacaactaaattgtattgtcgatatcccatatttaggaaatacataacacaagcggtcagaccaagattgaaagcgagcgaaagtgccaggaggcaatgacctagcaccaacgtcacctccaacttcaagaggacagcagccaacccctctcccattctcatcctgcagatcaagaccattactctcatttagatagctttgaaacgcatagcacaaagacatcaaaatggcgatggccgcacggtcataagcagattgaaaatcagcagtcgcctttccgttcacatcggcctgcaacacgcagcaatcagcaacatattcattcgcgctgtcagaaggacgaagattaaactgacatagggccacaccaaaatgctccatatatgtcaggtgctcaaaatacttctctattgcaacaccgatttcgccataaagcgttcgcgcaagctcaatgggaattcttttaccttcatcccggattacgttcatggtcacggacacggctaatcaactccttcattaggcaatcagcagctgcagaatcaaacactgtccgagcatcgaccgaatccgattactgtgacctctccgcccgaatcaatttggccatcgaacatcatgccccaaacaatcatggcatcaggttgaacgcaggcacgtatctcatccacagcacgcgttactttctggagtttttcatgagccgaacaagcgaaagagatgcagacggcgttcatcatcttcaacgaatcatttgagaatgatgccattgcgcgcttcgcggcctcaactattccatccgtaccttctgcttggccagcgccggaccaagccagatcgttgccgcccatcgccgctttgatatcggaccaatcaacatgtatgtacgaagaattcatatcagatatatcatccaatacccgaaaaccagcgtttaactttttcgccatctgcaactcttgcttgtccattttgactccttatcgagagctatcaatactcctcacaatatgcacgacaagcaatcaacagtagatatctaccggaatattgaagatgaacaagctactaacgtttagctgaaaacgagtcagttaccgaggccccggcattgatcacgaaatgtgaataatcctgtgtccaatgagccctacaagccatcgccgtactacagcatatccagaatagcgatgttctagggcctcggcgtagagagcttgttgttgagcgtattcggtgcggagacgctgagaccagtctttgactgtttcacccgggcgcattttgtcggttttgtagtcgaagagggtgatggtcttggcggttggatcaaggaaatagccgtctatgatacctcggaccacgattgtgtcgtcacattgctcagcaacgttgccgctgtcattcttcgtgttgggcacgccaccagccatgccgctaccgttcaccttggcattaagccggttacgttcaatcaacatcgagaatggctcttcccggaacagagtatcccgatgagctcgtatttgcgccgatagcgggcaattttctccagtgacaaaccagagcaagccttccagctcgcgagtcagcacaatatgagccacttgcggcgtgatgacatgattcgcttccagacggtcaacaatgtttctcagctcggcttcgcactgctcacggaacggctcagtaccccaatcaaagagttccagtacattgtggaccgcagtacccacctccgaagcagatggctcaacgtcggataccttcttcataaagtcaggaataaagaacccactatgcgcttcccgcctttgcttccaatcatctagattgtcttccagcatggcaattggcgcagccgcgtcatcagacggcaatacagccagcgaatcagtgtcatcagatatagattccgcatcatcaatcatccagctgcgagccttggaggaactcactaccactggcatgcgcggaggctcatcaggcaatcgcaaaccagtcacatcaatacgtttattgatatagccatacccgtccgttcgctcattcatagtggtcgtcggctcaggcgcagcactgcagaatcgaatcgtaatggccctgcccgtcgccgccatagccggcgctgtttcctgtagtcccgcagcaagattccacgcacggacctcattagggcgaagaatcgcagacgaatcatcatccgcatctccagacgccagcaatgatcctagaatccaatagagataattggggctaccactattcttgaccaccgttcgtggatctatggtgcgtccatcgccgcttagcgagatgccttgagccatcgtacgcaaattcagattgccatcatcgttctttcctggacggtacgatcccgcgataatcaacttgcgttcggcacgagtcatcgccacatagagcaaacgaagttcctctgccgcctccaactccttggcccgcgaatcaatcactgcgcgctggaaagtatccactcgaacatggttacgttggtcaaccaacgataaggcaccttcgccatattcggcaacagccccatcctcattccttgtctgatgagcaatcgtgcgaacgacagcggttctcgatccggtcagcagattattgctggcacccatgagtatcacgacgggccattgcaatcccttggatttatgaatcgtcatgatatgcacggcgtttttggtaggcactgttgaagcttcttcaccggagccactcgcggaccacattgttacggcatcaaggaatggttgcaatccacgctcctgagctacagcaaatgcatcagccttttctacaagcaagcgcaggttcgcctgccgtcgctcaccttcaggcatattgcctgcgaaatcgaacaagccagaaacggcatagagatgccacaacgaatcagacagagagtgaactcgcgcataatcgcatgcggcatcatagattcgcaggaatgccgatatctttgcaagcaacacatcagaagaaagaacagccgattcatcagcttctcccccactctcagcaatccgccgcataacgtcaaatagccagcctctgttatgcagacgaatccgcgccaaatcatcatccgtgaaccccatagtccgtagcaccgcaaccaacggcacatcctgatgacgattggcgataatacgcaaccaatccaaggcgatctgtatctccggctgacgatacaggtctccaacgccctgtacttcgactggaatgccgacacgatatagtcggtcagccaggtcggcaaaatgagtagcgccacgagccagcaccgcgatatccccatatgaatactgcgcgcgaggcccctcgcagagctcctggacacggcgcactatcatgtccacctgtaattcgtccttgccggcgcgaactgtcggtgcagtgtcagtgccgttttcatcagccacaacatcagcactcaagtcaggtgccgcgttactcaccaacaattcaatggcttctgcatcgaatggtttaccggcttgctttgccgagccgatttgcaactgttccttcaggtaatcggtcgcacccatattcggcgtcatcagtcgggcaaataccgtattcacaaaagtgatgatttccggcaccgatcgatagttcacccacaattcccggcgatggctcgcatccgtaacactattgcagatatcgccgaactcctccggcgaggcatcacggaacccataaatgctttgcttcacatcaccgaccatggtaagtttggctgcatttcggctgatttcgcgaatgaatcgattctgcagggcgttattatcctggcattcatccacataaatatatcgccactgagcaccgatacgcttggccacgtcaggctgctgcatggcatccaatgcccagaaagccacatcactgaactccgctacggactcctgctgtttcacaagcgcatactgctggtcgaacgtggtgatgagcgcaatcaatccttcgagtcttcgcgcagcgacctcatcaagcgagtccacttgttcagcggtaaaggccagtttcgattgcaaatcagaaacgatccctttaatgccccgcaccgtttccgccaagcgacggcccagttcactgtctttgggtacggcgattgccgcactcttaagaatggcagttttgccgacagtaatgcgcttgggcagtacgtccaatggattggcatcgataacacgagcacgaactgcattccatgattcgctacgcaagtactgaggcaaatcgcatatcatccgcaatgatttgactaccgtatcttgctgcgcggtgtgcgcatcgtggcagctggcgagcgcctcatcaagacacgatcgcaattcggcaagaggatgttctgccatatcaatccagcctcgaaaataacggtccaaatattcattgccgtattcaccaccaacgacctgattcagcgacgcaatgttgaaccggtatggttcggcgagccggctaagccaaccgatgcggttgggcttggtgagtgccttgtcatacaggctcatcatggtggcgcgcaagtcaccatcatgccggggcccttgcatgttgtccaacacatccatgaaccgcgcgtgcattgagttgcgctcgtcataccacgattcgaataacgcgtcgagtgtttggcctctcagccggttcttcatggcatcatcagcaagaatctggaatcctggagccaccggcaatgtatcggcattgcgatccacgattcttttggagagcgcatcaatagtgctgatttgcacggttggcagatcgttcaaggcaacggagaatacggtttgcgcatggtggcaatcgtgcagaatcgtacgcgccagttcgctgtcgtctccacctaattgatagtccgtatccaagagcacgagtgaacccggctggcatccatgattgcgccgcgcatacagaatggcgtactgcaggttctgttccaagcgccggcgaatttctgcggctgcggcaacggtgaaagtaataattaacgattcgcggatggatgaatgcgcttcgtctgcattacggttcagcaagtccagcagaatatcctgcaagagttgagtggttttgccggtgcctgcggatgcgctgatgacgtaaggcatggtgtttgtcggaaaatcgtccgagagattatccgcatcttccgacctaggtaatgcatcaacatgttctaccatgccttgcctccttcagatgtattattcatatgaagagccgcttctttgagctccagcaatgtcactgctgtctccacctcgaatatgttgccattcaacacatcccacgccatgatgtcggccacatcgctgtaggcaagaccatcacggccgtcaaccaaagaacgataagggcgcaccggcagtttgccgtccaatatgttctggcaggcacccactattttcccgtgcacataatccgctatgccacgaaattcttccgcactcagttgttcgataccgatgccggtttcgtcggattctcctataagcacgccactgttcggcatatcaaagcctcgccatacgtttctgatgcgcatgttctgagcacttgaatcgtcacttggctcatcgaacagactcgttgatccatcgtctgcgctcggcaacatgttgtattggttattcagcgcgatgcgttctcgaatggttgcgctgggtttaatcgggagaaagaacatgcctgctactggcattccggagttgtgctgggcggcagaagcatacgtaaacagctgaagttcatggccgtagtacacatttgaagcgcggccgccatcattgcgagacggtttgccgaacaacgtacgggcagaagacttatagtccagcacaacaatgccggcgctctctcgcgaaatattggtatcgcgaattaccgtatcaatgcggtcgaccttgccattgatacgcaatgcaaccgggatttccttgtccctcgccctaccgattaattgttcccctgaatatggcgactgccatgcaccggtcgttcctccaacgttgccaaatacttgctctacacacgtaggcgtaagcatcgtctgtgcggacgataatgcctcacgttgcgcagcagcatcgacggcaaaatccatcagcgtatcgaccagctgacgatgaatcatacgcatacgattactggaccgcagcacctccatacgcgggtcttcgttcagcaccgtccactgattgcagcctcgatccagtctggaatagtcggcgataagctcttgcatgtctgttgcagtgggctgaggtggtaagccgttcaaatctcgttcgttcttgtgtcgctcgatccaggcattgaccgcatgttccagcactgcatgatagaacgtgccttcaagcgcggcatcaaaagcgaacgcatttgccacgttaactttcaatccgtatttcaggaaatactcatacggattgcgatagtacgtttctattgccgaaaccgatgcattgaacacacgagtcgagatcgaaggatctgcaccatgagtgcgataaacgcgatgcacataatccggcctagtgaacaaccgatatgccagttcgcggtcaaggggacgatactctgtttcaacggtcggcacagcgcgtttgctcgctccgatgatttcgctcgtatccgatgtacccgtctcccattggctgatatatggcgagcatgcttgtgcagcgttacgcagactctttggataggtcatagacaactgctgcgttgcgctggcaacaacaccgttaaaccatagcggttcttgcccggacctacgttccaccgtaccggaaagtacattccacgcttccaaagtcttgccttgggaagtcaggaactgtgacaaatccagccgctcgccgtcatcgagcagaccggtctcatgcggaatcgcaggcaattgagattcactgcaacccagaacaatcacatatctgtatggatgtaaaggcgatgacatcggcaatacgtccacggcgctggcggagaccggacgcgaatcgattgactgcgcggcgagcgtcgaagctagatttctagcaaagattcctacatattcagcaaaataatcgttaccgagctgttgaaccatgtcgtcaaacgcattcatgatgacggtccaaactggcgcggatccttcaatggtttgggcgtattcggtaagaaaaccaaccatcccgcctagagcctcccgcacggttgcgctaggccgcggccgaaacacatcagcggcttgctgaatcagcgaacgaatcttctgcaaatgtgcagcgaacggtatgtctgtatcgatccataccgttgccggattgttggagttcagctgattttcaatgtcatcgattgccgttggagtcaagttcagataccggctgaagataccggaacgcagtatgcgcaggatggactggggttgaagttcgtaggtcgcggaatcaagcagtcccagaatcgcatcagcgaacggatggtcaagcatcgtactggacgcggcaatattaatcggtatcccctgatacgtgaattccgatgcaatttgggcttgatatgaaccaaggtctcgtgaggtgaccagcacatcaccgtatgaaatttctggattgtccgcgatgaacttcttgatggacgctgccgcatagcgcacttcggcagtagtatccggcatcgcacacactgatgtagaagcggatgaagcgaaaatactggacagcgtatttcggtttccatcatcgcgtctctgcaatgcttccagataatccggatcagaaccggcaccaaccatcaccgtcagatgcacgtattgcgcaagtgtatgaactatcctcatctccgaagcgttgaggtgtgcgaaaccgtacagatagaaccagcgattactcccatgccgctgtgcccatgcacatatggtttcatgggcggctccggggaatgtataccgtttacctaaccgttgctccaccagttgcagcaaagagccaagcaccgaaagtcgagcattcgactgatgagcggccagagcaagcacctcttcagcactgaccccatcattatgcaattcaacaatttgcttggtgaactggtcaatagcctcaaacgagtcaccaacctgattacgcaacgattcattatcattcagacacttcgctacgtaatttctcagcgacatcatgctgattgatgggcgaatgtaccttccataatcctggttgccgataatcgagctcatcatgcttgccagagaatggacacccacattcatccccggttccagacgttcgcggaattccggtcggaccatcgactgcagtacttgcttttccacatatgcgcgcaagcttgccggtgtcagaataacgaatcgcccacggcaactatccggaaaatctgcttccgtacatccggcaccatcagaaaggacatgatcaatcagggcatgaatgtcatcacaccctcgctcgggccgtatcaccatgacactcataccttaccctccccagtgagttgtatctgttctcagcatataactgacgcaacaaatatccgggacttcgcgcatgacactttgcactcttacgcaagcctagtgatttcgtagtatcacattgccgtctaagcacacacatattgttcaatcgcacgtcctattggccatttgaaagactcacactggagctgttgccgagtggtttgatcccaatccgaaccattagggacgacttcatctgtactcttttgcgcacaaggacttgcatccattacatcctgcaataaatcaccctgtccatgggattgtgctgctctgtattgcctttccgcctcgataaggtcattgccacattgggcaagagccttcctgcaggggttgacgcaatcaaaagcaccggctctaatgaggtaattgacattccctgcattgcaatgttccaatgaaacacgacgtataaaatcattaaaactgcgataggcactgcccttattacgggttgaaacgatttcttctgccaattgttccgaaatgccccgtatcgcattaaaaccgagctgaattccatatgccgatttctcatcgtcaccggtactggaatacgctgtcgcataatattgagattgattaatgtttggcattcttacatgaatacctaaacagtacatttcttcaaatatactttccagtttcgctctagcgccatcctcgttataactattcaacattgcggtcatgaattcgattgtgtataacgttttcacataggcgacacggtatgcgaacattgcacgagcaacagcatctgcgcggtcggcacctctgctatggcatatgtcaattagctccgcaaaagaggtaagcttctgctgcatcagttcgctcttcattccatccaagaatggaataccggccgtatagcccgcggacagtaagtcatacacacggctctcatccaacgaactgcaagaatcgtcccatacttgcggcacattgcaatccggtatgaatcgaagggcatcctgcaccacctgcaaaactctcgaacctgcaatacggagacgaggaagcccaagttcatcacagccttttgcatcaaacgcggtgctttctgcccccgaaggaaaacgaacaatggacgttacttcggcaaggggcttgttgcaaagagccaacacatcactgcgaacggaacagtcatatatacagtctttcaacccatccgcaatagacttcttggcgttatcctgcaaccaaacctcagccgaggatgcatcccagaaccgttgatatccgcatacatgcgacacatctttcactgccttggcatcgttaaaacggctgtatgcaattacagcagctgcataaccattcccatatcggtcacatagatattgcaatacccgcctggacagtccccgttccgtttgcaaaacagctgtaggaaagactgaatcttgaaaatcagtaaagggtaaatcgtattcgatgggatcaatctcactaatccccagcgcataggcgacaaggctgcgagccaatatccccttcccgggcccgaccaaatgcccctcttctcgcaatcgattcgtacaatatgcgacggccatcaagtattcttcagcatgggtttcacgaatcacagccatttcgtgttgagcacgattccacactgaatccggtatgcttccatacttcgtttgcagccatccttcaacttccccttgaagaatttcactcgacgctcggccatcagcaccaacatgctgcggcattaatgagccatcttccgctacacaaaatccggtatcgcaccgctctgctatgagcaacgtattgtcgcaggcttcaggcacatcggagaacagagaccgcataaccgcagatgaacgcaaataatactcctcgctttcaaacttgaaacgatgaggaccatccatcacatcacctgtttcaatgcatatacgcacatcatgttttagactgtcatcacgctttgcataatgcacatcactagttgcgactaacggcgcattaattcgtttcgccagttccactagatcattcctgatttggtgctcaatggacaaaccatgatccatgatttctataaagaaattatctcgaccgaaaatatcctgtagttcaccggccattcgcaacgcttcatcaaattgtccaagcaacaatcttgtcggaatggctccagacatgcagcccgacccacaaataagtccttttgcaaatgatgacaagacattgttatccatgcgaggataacgcgagaccagaccttcgagattcgccacggaagatgctttcatgagattgacaagaccttcatcggactctgcccatagcgtcaagtgagtaaacagcccaccaccgctgacatcataaggatcatgaggcacacaagtaacacttcttcgagtattcctctctttccacgaattatcccaagatacgcatctcgtatccgtgcggccagtttctggcgttacgtatgcttcaacacccaaaatcggcttaatgcctcgctgacgtcctgctttccagaactccatcaaaccgccgacactgccgtgatcagtcagaccaattgctggctgacctaatcgttgcgcttcactcatcagctcgctcacagtagagacaccatctgccagcgaatagtcactatgtacatgcaaattaacgaaatcccgcataagagcaccgcctccatagtcatggttgcttcgaattcgaatcggctgcatgttcagtttcctgccgcgctacaatcaacggtaattatctactggttcttgaagcagtctcgatactcagcgagaggaacatgatggccgtctcatcgcaacaagcaacaccttccactgcgcagattgtcatcgagattctcgaactgctggatgcgcatacagaccgcgagcacgggattactgccactgagatcagcaagcgcatcagcgtttcggaaaagaccgtacgagggcatctcaaggcgttgcgtgacatgcaaccattcggccgtcgggtggagcatctggagcgtcgagacctgctctctgctgaaagcgctgatccaaagccgggatggtacattgaaccggtgtttgatacggcccagatgcgtctgcttgcggacggcgcggtaatatcacggtctgacagcgaatatctgagcgaccttatcgccaaaatctatacgttcgcgggcaagtcgggccaattgcgcggtctgaggcagctcactacgccaaagaattacaacaccgagtttctcaacaatatcgaaatgctcaacgatgccatcgaacacgaacgagtaattcgattccgttactgcacctatgacattgatggcaatctggttcctcgccgcgacaatgcgggtgaaatcaaagaataccaagccgatccgtaccatctgatgtacaagaacaacaaatactatctgatttgccacatgcatcagcatgacagtctctcgtatctgcacgtagaacgtttccgcaacctttacgtcgaggagactgatcatgcgctcaatcgctcactggatagcttcagtccgattccgggaacgccgttcaacatcgaagagcatatggacgaacgcccttaccccatggacggcgcagcagtaccgattcacctgcgtattaccggcacgctggagcccttgtacgactggttcgacaacgccaaggtcactcaaatcagcgccaacgaatacgacgtgcatatcatggccaacgaattagcgaccttgtggtgggcattgcaatatgccgattcgcgcctcattgaagtccttgaaccacaatccttacgcattatgctgcgagatactggcgaatctttgctagaaaagtatcgagactagctagtcccgctatattctcaccaacgctcagctcttttgtcggcactcggcaatgagggcggcacagagcaaaatgacctgggcgacgaggttgaaccaaatgagcacgccgatcaacgcggcgaacggggcaagcatcggattccgggaggctccggctaatagtcgcgcaccgagaagctgcattgcggaaaccgtcagagatcccagtaacgcgccgagtatcgtgaatcgtccggctttgatgtgggagaccacgcgcagcagcaacatgaacaacgcgaaattcagcgcgacaccggtaccgaaaccggtcatctccaaaagcacgatgccgggcaacgaactgctggggatgccgccccattgcagcagtcggcgtacgatgccgccggacaccgtaccggccgcggtcgaaagaatgaacagtattgcgatggcgatggcggcaagcgtatcgcgtaaccttgcgacgacgatattgagctcgtcgccgcagtcgtcgaacatggcccgtacggcgtggcgcagcgagttcatccagccggtcactgtccaccagaatatggccaacgtggccagaccggtccacgtcaatgcgcttgacatggcgcctagcgcggaagacgtcagaaacgagtcggccacaccgggaatgacttcacgcaccgcgtcaatcagcatctgctgccaatcaatgttgccgaccatgataaggccgaacacgctcaccgcaatccagacgccggcaaaaaaggcgaacagcagaccatatgccagaccattcgccagcagggggccgctccgcgacacataccggtcgagcacgcgcccaggcagcgaacgtgcccacgcgtccgctcccctgtcaatcgcactcttcaacccatgcatagttcaactgtagctgttgccaccgttgttgaaacagcatggcgcgaaatcgcatttagccagctcaaacgatggcaaccatcaacgcccccactcaattgttcagaatcggataccatatgagtattcaattcatccgtcggagtgcaatgtcagcagtcctcaccaactgatgtcttgctaacccgctggccgccctagtatctactgtttcttgtggtcttcgttcaacagccagtcaagcgcgtatatctgtcggatgccttcgtgggagtagggccgttcgtcatccagcgtaatcagcgtcttgggatagttgtcacgcacggcgcgcagcgaggacggctcccgatccagcgtcgccgaatcgtgcaccgattcgctgacctggtagtaccgacgtccgcctggcccgttcgtgacgaagtcgatctcgctgccggagctctgtccgacatacacgtcgccctcgcggcgcatcagttcgaggaacaccacgttctcgaggaggcgtccgatgtcccgcacgttgttggagcacaggatacgtcgcatccccaagtccacggcatagtacttcttttcctgcttgagaatcctcttgcccttgatgtcgtatcggtgggccgggtagaggatgaacgcgtcgtaggccgcgatcgtcgtcggaacgggcacggtcaacgactaggaaacggtttttatcagcaggagattctgcaatccggatggcatataccgcccggcttcattactgctttggctcatttctgttcacttcacgctggagtaccgagacacgttgagcggaaataccggtaattcacgtacggttaccgaccattggactgaatggtactcagcatccgcagtcacttggggtatggtcatgacggagagccatcatgaccgatctctcgttattctgggatgaatccggcgaagccggaactgaatctaaatattaaaacgcatgatgcacacgttgcggaattagtccaccagaacttcggcatattcggcaggttcagcgggttcgatatgtcgggcacgcatggcatcgagggcggcagccaagtcggccgggtactgggaccggaccgtggtccagacgcgggtgcggggatgacggaattcgagcttcatggcgtgcagccactgccggtcaagtcccaaggcctcagacagcaccggattggcaccatacatggggtcaccgcacaggggatgcccaatcgaggagaaatgcacgcgaatctgatgagtacgtccggtctccagattcacggataccagagtggcctcatggccgaaacgctccagcacatcccagtgcgtaacggccggtttgccggccggagtcacgcagaagcggaaatcggacactttggcgcgcccgatcggtgcctcaatggttgctttgttctctttaagaccaccctgcacgagcgcatgataggttttctttacctcatgctcggcgaactgccgacgcatctcggtgtacgcaaggtcggacttgcacaccaacatcaagccggaagtgcctacatcaaggcgagaaacaatgccctcacgcccggccgcaccataggaagtgatatgcacgccgcggtcacgcagtgatccgagcacggttggaccggtccagccaaccgaggcatgcgccgccacgcctacaggcttatcgactacaacgacatcatcgtcttcgtagacaacggccatatcagttgcgataggctcaggctcggcctgttcctccgccaaatcaaattcgacggtctcccccgcctgcaatgtgctggaccgcgcaacttcacgtcctaaaacgcgcgcctgcccggagtcaaccagatcggcggctttagatcgtgaaatacccagcattttggccacggctacgtcgaaacgcttacccaccaatgcatcgggagcagggactattcgactcattacttggcgtccgcctccggctcagactgtagggattcgtcggattgctcgatgagatccttgtgtgagaacggctcccccataagaatcagaatcaccagggccacaccggcgactaccagatagatatccgccacattgccaacggaccagccatagttaaggaaatccaccactttgccgtcgaggaagccgtcagcgtacataacacggtcaatcaggttgcccagagcgcctgcaaacgcgaaagaaatcgccaccgaccatttcatggagacagtgcgcaccccagccacagcaagggccacgcaagccacaacggccaacagactgattacccaagtagcgcctgatcccatgcccaaggacgcgcccggattacgcaccaaggtgaaggacagcagtccgggaatcacgcgaatggtctgaccgttggataacgcggccatcgcccaagccttggtgagctgatcgacaatcagcgcagccgcggccacacatgcaaagacggccacgtgggtgcgcagccgtccctgttggttcgtcatacgacctgtacctgcctacgctcagttggtcttggacgaggtctggtcgacgtagttgttcgactcggaaacctgcgatgccagctggccgaggtactcggtgaggcgggcgcggtattcagtctcgaactgcttgaggctctggatgttgccctcgacgaccttggactgagcctgaaggttgtcgcgcacctgctcggcatacgtatcggctgcagagcgggtgttcttgtcgtacgcatcagccgcggaacgagtgttcttgtcatactcggcggcacgctgctgcacttccttctcgtagttgtcagcgtcatcgtgctgagacttggagtagttgtccgcatcctgacgagtcttgacggagtatgcgtcggcctcagaacgggtgttctgggagtaggtctcggcatccgcgtgagtctggtcacggtaagcgtcggcctcggagcgggtacgatccgaataggtgtcggcgtcggaacgagtacgagtggagtagtcgtcggcctcggaacgggtacgctcggagtagttgttggccttggtgaccagatcgttgtacttgttctggctggcctcggtgatttccttggccttgttcttgcccttctccacgtactgatcgtgcagctgcatagccagggtcagcatggcggtggcgcgctcgggctcggtgcccggcatggaagcggcgccagcgatcttctgcagagaaccggtctcggtgctcggctcgaccttagaaacctgagcacgaagctggttttcacgctgcttggcttcttcgagctgacgggacagctcagcgatctgagcggactgctgctgagcggcggaaccctgctgctgagcagcggcgagctgacgggacagctcctcgttggccgcgcggaactgatcacgttcctgctgaatggcggcgatctgctgaccgacagcctcctggtcaccggaggcctgagcagcctgagcggtgagctgatcgatttgagcgttcagctgatcgacctgacccttgagctgctcattctgggaggacagcgcgcggttggattcctcggcttcgctgagcttggcagagacaagctgtgctgcctgatcattgccagcctgaacggcctgctgggcctgagccacagcgttcttcaaaccagcattctccgactcgagttgctgcacctgaccggtaagatcggagatcttcgcattaaggttggtcacgtcaggacccagagtctgggtggcctgaccgccggctaccgcctgacgtccaagagcctcgacggtttccgtgacctgatcaaggaagtcatcgacctcgtcgacatcataaccttccttgaatcgaacagtctggaaggtatgctccctaatatccttcggcgtcaacagagccataaatcttgcacctcgctttggggcatcgcccgcacttacgttggtctcaagtcagaatgctatcacgaccccatcgtttcagaacattcgacgtgggtttttatgccagatatatgcctccggcgggtcaaaaacggcctcagaacactatcagaacaacactttccagtaccaccagcgcaaaatacagcacaatgaagctgacatcaagataaatcgaaccgagcggcaatgggcgaatatagcgacgtagccagcgcagagggggttcggtaatggaatacacaatattgatcagctgggccaccacaccacgtggataccagtttcgtgcgagaacggagacccagtccagaatcatgcgcacgaacagaaccgtgatatacgcgttaatgagccatgcaagaatgcggccgatcagagagaacactaaggaaagcatgctgacagactaacaaccgcgcatgaaaagtttgctcggagcacaataagaatcggccgactccttgctgggagtcggccgaataccgatataacgtcgaatgcgaaaactactgaaccggtcaatcagcgaacaaatcgtgtgccgaggctggttttgtcggctcttcgaccttgatgttcacctgcgccgggctcaacaggaacacgcgcggagtgacacgctcgagggaaccacgcacgccgaacaccacgccggcggagaagtccacgatgcgatatgccacggcttcggccacaccagtgagattcagtacgaccggaacaccgtcacgcaatgcgcggccgaccagttgagcatcctcatatgacttcggatggatggtggtgattctgttcacacggccaccggggaacggcttggtagtcgacgatgcggcaggcgcggtggttgacgccagcggcgtgaccgtatggtcggaatcaaatgcggacttcgaagccggcttctgctcctcgtcctcctcgatgtagtcgtcctcatcgtccacaacgtcactcatgcccagataggacatcgcgtttttcatgaacccagccatggatcaatcctttcagcgcaggaagtcagggatgtcgagatcgccagccggatcgttcacggcgatattcggatgagcggaagtcggatcatcaaaaggcaacgatgcggagtcaccgatagccggtgtgaatgccggttgggcagtggcagcgggctgtgcagccggtgccggtgctggagctggctgtgccacgggagtcgcaggatcggcggcggttggcacaaccggcgtcaccgtgctctgagtgtcgtcatcttgagcggcgacggggtcaaaaccagcagcaataacagtgacacgcacttcatcgccataagcatcgtccagagcaagaccccaaataatctgggcttcagggtgaatcgccttgcgcaccagttcggtggcagcagaggcctcctgcaacttcaggtcggtcggaccggcgatgttgatcagcgcaccgtgtgcgccttcgatgctttcctcaagcagcggagagctgatggcgatttcggcggcctgcgtggcacgatcctctccccgtgcggaaccgataccaaacagcgcagtaccagcaccacgaagaatggagttcacatcgttgaagtcgacgtgaatataggagttcatcgaaatcaggtcagtgatgccctgaacaccggcaagcagtgcggtatcagcggtcttgaaggcctcaatgatgccgatggaacggtcggaaagctcgagcaggcgatcgttcggaatgacgatcagcgcgtcgacttccttgcgcaggttgtcgatgccgtattcggcggaagcggaacgctgagggccttcgaagctgaacggacgagtaacaaccgcgatggtgagagcaccctgttgatgagccgcacgagcgacgatcgggctggcgccagtaccggtgccaccgccctcgccgcaggtgacgaacaccatgtcggcacccctaagcgcctcttcgatatccgactggtggtcctgggccgccttggctccacgctccgggtcggcaccagcaccgagaccacgactggacttatcggaaagggaaatcttgacatccgcatcagagcgcagaagatccttcgcatcggtatttaccgccacaaattcaacattctgtaatccctcggcaatcatgcgattgacggcattaccgccggcaccgccgacgccaacaaccttgatgttggtcttgtcgttgaactcattctgcgcgatctcgctcacgtttggctcctgtcacttcacggttacacccaagagtagcgcaaacaggctactcttggagggaaattcacgcgcagaatggcgcgtgttgcgtgtattttcagtattttctcagtaactggcgtccattgggtcgtcaccgaagagcgcctcacgctcttcgtgggtggtggtacgcgattccaaccagccatacggcaagtgcaccttcttggcgaaacgcacgcggccgcgcggtttgtcgaccacgcgtggcgggtattcgatagtcgggtcgagcttgccgatctcgcggtccacatcggccaggctctcgcattccataaaggccttgcgggtggagccgcccaccgggaatcctttcagataccaggcgatgtgcttgcgcagatcgtggacggccatcatctcatcgccctcataaaactcggtaagcagctcggcatgacggtgaatcacgcggcagacctcgcccagattcgggttgagccgttcgggattgccctcgaaggcgtttttgatgttggcgaacagccacggccggccctggcatccgcggccgatggccacaccgtcgcagccggtctcgcgcaccatttcgagcgcatcctcggcaccccagatatcgccattgccgaataccggaatgttgaggtgttccttgagctcgccgatgcgggaccagtcggaatgaccgccatagtattcggcggcggtacgggcatgcagggttacggccttgcagccctcctcctgcgcgatgtgtccggcttcgaggaaggtctcatggttatggtcgatgccgacgcggatcttcgcggtgacggggatgcccgccggctcgcatacggcgaccacgcgctgtaatagctcagtgaaaatgtcggttttccaaggcaaggccgaaccaccgcctcgacgagtgaccttgggcaccgggcaaccgaagttcagatccacatggtcggccatgttgccgtcgaccacgattttcgccgcctgttcggtgatggaggggttcacgccgtacaactgcagtgaacggattttttcgcttttggcgaaatgacagaggcgcagtgctttcgggttatgcgccacgagggctcgagcggtgatcatctcggccacgtagagtccatcgggaccatattcctcgcaaatcacgcggaagggccagttggtcactcccgccatcggcgagagcaccaccggggtcggcacggtgatgttgccgagttggaccggggcgatatgcaccggggtcccggggcgcgccggcgcgtccgtacgtgggtcgaggttgtcggtctcgtgatgctcggtgagcactgtttcggattcggattgtgccatgtgattcctaagaaaataagtaggggctcccctgagagaggagccccggcgtctatcgccgccacttcgcctacaaacagcccactgggatgtcttccttacggctcagcccacagaggggagcccaagttgtgcgactccggcttagtacaggccgccggcttcctgaacgccggactcaggccaaggctcaccgcccatttccacaggcttcaggggcacgcgggtgcgcttctcgccgatgcgggcggccacgtaatcggccaccttgtcaagagcgacgcgctcctgggccatggtgtcacgctcacggatggtcacagcgtggtcctcgagggtgtcgaagtccacggtgatgcacagcggggtgccgatctcgtcctgacgacggtaacgacgaccgatggcaccggactcgtcgtagtcgatcatccactcgttgaagcgcaggtcgtcggccaggttctgggccacggtctgcagttcaggcttcttgctcagcggcagcacggcggccttgaccggggccagacgcgggtcgagacgcagcacggtgcgcttgtcaacgccgcccttggtgttcggggcctcgtccacatcgtaggcgtccacgaggaagcacatcagggagcgggtcaggccggcggccggttcgatgacgtacggcacgtacttctcgccggtggcctggttgaagtagctcaggtcttcgccggagtgcttggagtgcgcgctcaaatcgtaatcggtacggttggcgatgccttcgagctcgccccagtcggaaccctggaagccgaacttgtattcgatgtccacggtgcgcttggagtagtgggagagcttctccttcggatgctcgtagtggcgcaggttctccggcttgacgccgaggtcgatgtaccagcgggtgcgggcgtcgatccagtactggtgccattcctcatcggtgccgggcgtgacgaagaactccatctccatctgctcgaactcacgggtgcggaagatgaagttacccggggtgatctcgttacggaaggacttacccatgttggcgatgccgaacggcggcctggaacgggaagaggtcatcacgttcttgaagtccacgaagatgccctgtgcagtctccggacgcaggtagtgcaggctgttctcgtcctcgaccgggccgaggtgggtgcgcagcatcatgttgaagtcgcgcggttcggtccactggccacgggtgccgcagttcgggcagacgatgtccttcatgccgttttccggcatcttgtcgccgtgcttctcggcgtaggattcctcgagcttgtcggcgcggttgcgcttgtggcagttgagacactcgacgagcggatcgttgaacacgctcacgtggccggacgccacccacacttcgggcggcagaatgatggaagtgtcgacaccgacgacatcaggacgggtgacgaccatggagcgccaccattcacgcttgatattgtccttgagagcgacgccgagagggccgtaatcccaagcggaacgggtgccgccgtaaatttcgccggcggggaacacgaagccgcgacgcttcgcaagggatacgacttcatcgagtttggactgagccacaatgcaccttctggtttgaacggtttggggtctaataacaaccgcttcaggatagccgtatatggtgacaggtcaggcggcattgtccggtatatgttccgcgtctcacgagcgaccgttcgcagcgattcctatatcgcaacacctccatattgttcctgttgttttacccttcccgaatttgtgccactgacatcgcgtcagcgtcacaaattcgggagatgttgctcggcggaggcgtctatgtatcacgaatggacggggacgcgccagacctgacgacacgtatcgaacaaatccgtcacgataatgtccatgttggcgcatagcgtcggcactgtaatgcaggggaactcgcatgtggttcgcgagttgagaaaggcctgagcctgacccttagaacctgttggttaagaccatcgtagggagcagtaaatgagcaatagtgcatcatcgtttaccggcgtgtccagcggttataccgccgggactccggttccagccgattcacccatccgtgacaatatcgccgatgccgttcgccgcgtacgcgagacgactccgttggcccagtcattcaccaattttgtgaccatcaatttggttgccaacgcgcaactggcggccggcggcactgcggccatgagtttcctgccggacgacgtgatcgaaaccgcgaaaatcgcgggcgcgaactacatcaacgtgggcacgctgctgccgttctataaggacgcactgcccgaaatcgcccagcgactcaactacttggacaagccgtgggtgctcgacccggtggccgccggcatcggccgcacccgtaccgccattcttcaggccttcaaggccgctcccccgaccatgattcgcgcgaatgcatccgaggtaatcgcgctggcgaacatgtgggggctcaataccgaaaccgtgggggacgcttccgagcaccgccccgccggagtggaatccgtcgacgacgtggagtccgcaaccggcgcggcggtggcgctggcacagtatctgaccgaacagcacgccaagcattcctcccatgacgcttccacccgctgcgccgtggccgtgtccggcatcgccgatctggtgaccgatggcgaaaccgtgtaccggctgccgggcggcagcgcgatgatgaccaagatcaccggtgccggctgctcgctgggcggcgtggctgccacgtatttggcggtctccgatccgttgaccgccgccctgtccgcgtctctgctgtacaaccgcgcgggagaggtggccgatacaacttcgcacggaccgggctcgttccaagttgcgttccttgacgcgctgtggaatgtgaccgccgaacaggtggcgaaatccgagattttggtgcagtagtttcagttccctctgatgagggagctcataacagttttttccaataagacttccacaagaaacaacaaaagcaggaataataatgagtaatgaatacccatacgcctccatgcgcgacagcttcgacctgtccgcgtacttcgtggtggggccggaggactgcaaaggccgtccgctgaccgacgtggtggatcaggctctgcacggcggcgcaaccttcatccaactgcgcgccaaggaggccgatgcctctgagctgaccgacatggctcgcgacatcgcgcagatcatcgaggacaatgagaagtccgattccgtggcctttgtgatcgacgaccgtgccgacgtggtgtggcaggcccgccgcaagggcatcaaggtggacggtgtgcacatcggccagaccgacatggagccgcgcgaagcccgcgccctgctcggcgacgaggccatcgtgggtctgtcggctgagaccgaaagcctcgttcggctcatcaacgagctgcccgacggctgcatcgactacattggcgccggtcctctgcacgtctccaccaccaagcccgaggcttccgtgggcggcaacgacggctccggcaagacgctggacgccgcccagatcaacaccatctgcgttgccagcgaattcccggtggtcgtgggcggcggcgtgaccgcagccgatatggccatgctcgccgataccaaggctgctggctggttcgtggtctccgccatcgcgggtgccgagaacccggaagaggccgcgcgcaccatggtcgaaggctggaaggccgtccgcggcgacaagaagcacggctacgctccgcgcgtcgtaacccacacccccgctactgacactcaggctgctcaggaaggggccgcgaagcccggttccgaggccactgagaagaagttcaccaacgccaaggacgccaaggatgcccagaagcttgccaagcagcagcgcgtggacatcgccgcccgtggttccaagcagcgcgacaaggcgcacatccgcaagaccaagtccgtaccgttcacctatcagtatggttcctacgacctggaagtgccgtacaccgaaatcaagctgagcgacacgcccggcgtgggcccgaacccgccgttccacgactacaacaccgaaggccccaagtgcgacccgaaggaaggcttgaagcccctgcgtctcgactggatccgcgaccgcggcgacatcgaagactacgagggccgccgccgcaaccttgaggacgatggcaagcgcgccatcaagcgcggccgcgccaccaaggaatggcgtggacgcaagcatgagccgatgcgtgccaaggaccacccgatcacccagatgtggtacgcccgccacggcatcatcaccccggagatgcagtacgtggccacccgcgagaactgcgatgtggagctcgtgcgctccgagctggccgccggccgcgcggtgatgccttgcaacatcaaccaccccgaggccgagccgatgattatcggatccgccttcctgaccaagctcaacgccaacatgggcaactcggccgtcacctcctccatcgatgaggaagtggagaagctgacgtgggccaccaagtggggcgccgataccgtgatggacctgtccaccggtaacgacatccataccacccgtgagtggattcttcgcaactcccccgtgccgatcggcaccgtgccgatgtaccaggccctcgaaaaggtcgaggatgatgcctccaagctgagctgggaactgttccgcgacaccgtaatcgaacagtgcgagcaaggtgtggattacatgaccatccacgccggcgtgctgctgcgttacgtgccgctgaccgccaaccgcgtgaccggcatcgtctcccgcggtggctccatcatggccgactggtgcctgcgccaccaccaggagagcttcctgtacacgcacttcgacgagctgtgcgacatcttcgccaagtacgacgtggcgttctctctgggcgatggcctgcgccccggctccctagccgacgcgaacgacgccgcgcagctttccgagctcatgactctgggcgagctgaccgagcgcgcctgggccaaggacgtgcaggtgatgatcgagggcccgggccacgtgccgttcgacaccgtacgcatgaacatcgagctggagaaggccgtgtgccacaacgccccgttctacaccctcggaccgctgaccaccgataccgctccgggttacgatcacatcacctccgctatcggcgccaccgagatcggtcgttacggcaccgctatgctgtgctacgtgaccccgaaggaacacctcggcctgccgaacaaggatgatgtgaagcagggcgtgattgcctacaagatcgcctgccacgccgcagacatcgccaagcaccacccgcacgcgatggatcgcgacaatgcgatttccaaggctcgcttcgagttccgttggctcgaccagttcaatctgtcctacgatccggacaccgccatcgccttccacgacgataccctgcccgccgagccggccaagatggcgcacttctgctcgatgtgcggcccgaagttctgctcgatggccatctcccagaacatccgcaaggcattcggtggcgaggccgctcagcagcaaatcgtgaaggaggctgctgcaggcatcgactccgaggcactggctacggccaaggccaatgtcgataacggcgtggtgtccgccaacgtgctcagccccgaagaaatcctcgccggcatggatgcgatgagcgaaaagtacaccgcccagggcggcaagctctactccaccgcccaggagtaaacctctctggctcccctctctgaggggagccaattattatgcccggtggtgtcttaattcgggacgacgctcgactcgctcgaaggcggtgccgaagtgtgcgccatctggaccgaggccgtcggaagtctccaggaccacgccttcgttgagcgcacggcgcacgatgcccacacggggcttcaacggccacacatcatgcggcactttgcgatagaaatccgtaccgacgagcaacacgtcgcccacatcgaacacttcctgacgcggaaatgtgagctgtgtggtgtgtccgttaggcattacgccaaaatatgcggtgagttccggtgatgcgcaccaagacgccgtcacggcgcagtacatcgttatcagccatgcctcctcccgaacatttcatgaatcaatcgcaatcagcaaaccttccccgtctcaccacaggagcggcaaaacatcaaggaaaaccgctccgaaaaacatcatgggccccacttagaatgaacactatggcacaaattgcaacatctacacttcccgctgttctcgcgatctccggctccgactcgtccggcggtgccggcatgcaggccgatctgaagaccatgctggcctgcggcgtgttcggcatgagcgccatcaccgcgctcaccgcacagaacaccaccggcgtgcgttccattcaggacaccaaaccggacattctcgccgaccagatcaacatggtgtttgaggatattccgccggtcgcggtgaaaatcggcatggtgtctgccactgacatcatcgacgtcatcgctgaacgactcaccttccatcacgccacgaacatcgtgctcgacccggttatggtggccacttccggtgccaatctcatcagtgacgatgccattgcggccttgaccggcaagctgttcccgatggccacggtcgtgactccgaacattcccgaggccgaagtgctgaccgatacgctgattcgcaatcaggaggatatggaggccgccgcccaccgcctcgtggagcgttatggctgtgccgcgctggtcaagggtggtcatggcaccgaggatgccaacgatgtgcttgccgagacggatggaaccgtgacctggtttgatggcgcgcgtatcaataatccgaacacgcacggcaccggatgcacgctgagctccgccatcgcctcgtatctggcgcttggcgacacattgcccaaggccatcaagcatgcgaagaagtatctgaccggtgcactgaaggcccagctgaatcttggccacggctccggcccgatggatcatttctggaagtatcgctgagtcctactggctctcctctctgaggggagccaagtaataaaaggagaattatgattattgaccgtaatgccgttactcaggaagtgccgatcgacccggaaaccggcaaaccgtacctcaataccgtggccgccattcaggtgtcggccaatggcgtgggctccgaggtttcgccatacgtggctcaggccgtcgaggtgattcgcgaatccggcctgccgcaggaaaccaacgccctgttcaccaacgtggaaggcgatctggacgacgtgctcaaggtggccggtgaggccgccaagaagctcgccgagcagggctaccgcacttctctggtgctgcacatggatatccgccccggcttcaccggccagctgaccgaaaagcccaagctggtggatgagatcctcgccgacaagcaggcgaagtagcaaagcatcgcttccaccagcaagggcatgctttgttattacacgtttcatggggcggtagctcacccatggggtggtaaaaccctcatggggcggtagtcgaaaacggctctattctgcggaaaggcataatccgctaaccgccccatgggccaaataccgccccatgagtgttttaccgccccatgggaatcacggttctgccttctttcgacggggtaagagcgtaagtggggcatatataggagcgtcacaacctctgttatcgttcacgatgtgaccgcaacgcggcgtgccacaaaatcgaacctatagttaagccccatgtagtgagctatctcacaacgattggctcgctacgtagaattcaagacttggatcgcaaacgtcgttcatcccacacaatgggagggcgaacggaacacacagtccaatcaagagttcgctcgccgcaacaccattgagcagttgcacgcgggcaggtttgcaagaagagggctcaaatatgactgctgctgaacagcagatttccggcaatcccgcggctatggaaaacgcacaagcacgtaccaccgtgacggatcaagccaaggttcaggatattatctcgcgcatggatcgcgcacatgaaaccccgatgttccatcgcatcgtgacgctggtcgccgctggcatgctgatggacagcatcgacgtatatattggcagcgccgtcgcctccagcacgttggctacccgctggtccaccgttgcgcaaaattccacctttatgtccgcgggcttcctgggtctgctggtcggttcgctgctggccggcttcgtcggtgacctgaagggccgccgcgtggcttaccaaatcaacctgctgctgtttggcggcttcaccttcctcggcgcattcgccccgaacatggctgtgctgtccctgtgccgtctgggtgccggcctgggcctcggcgctgaaatcgtcaccggcttcgccatggtcaacgagttcgcaccgatgaaccgccgtggccactggtgcgcgattgtctcgctcgtggccaactgcggtgtgccaatcgctatgctgctgtgtgcatggatcatcccccgctggtcctggcgtccgctgttcgtggccatcggcctggtggccgccatcatctggtggctgcgccgcgacatccccgaatccccgcgttggctcgccgtgcgcggccgttacgatgaggccgacgccatcgtcaagcagcttgaggccaacggttccgaaccgatcgacgcagccgccaaggccgacaccagcgacacccgcaacgccggaggccgttcgctcggcatctgcctgcttgtggctgtggttgctgtggccgccacgaacgtgtgctcctacgccttcacttcttgggttccgacgattctggtcaagcgtggtattaacctgtccagctcgctgctcacctccacggtgatgatgctcggtgccccggtcggctgcctgattggctctctgcttatcgaccgtatcggccgcaagcgcacgattgtgccggccttcctgttcactggcgtgttcggtttaatgtatgccttccagacctctaccgtgagcgcaattatcgttggcttcctgctcatgatgtgcctgtacgtgcttatggcttccgtggtggctgtgtacgctccggaactgttcgccaccaaggttcgcttccgttgcgtcggcttcgcgaacgccgtggccaagctgctcaatgtgttgatgccgatggtggtgggctggatgcttacctcgcttggtgccacgtccatctttgtggccatcagcgcgattgctattgcatcgatgctgattgtcggcttctttggcgcggagactgcgcagaagtcggttgggtgatcggtttcctcacagtggaataactgctgataatgtccattcggcgtcttgcgtggtgatatgcagggcgccgttttgttgttctagtaattgttggtaacggttgaggccggtgccggtggataggtctgcgtctccagcggacaatcagcgtctgtgatgtcacatgcaatgccaggagcggcatcaacggtcgaatcatgcggagtcactgcactgtgcgccgcttctcccctgccttcaatcacatcaatgacttgatgcgtgcgatccaatgcgcccatagacatatccgtaaccagcacgtcaggccgcttggtggggctcaggcatcggctgatggccacagcacccaaatcgcaggtctatatcacggcaaaatcgctggacatacgttcgattagcgcgccgaacactttcagcgcatatgggtcattgtccacaatgccgatgcgtatgttgcggttgcgcgcttcttccattacattcaccccttcagtgtgcccgacgccgaactactccgtcctgacacgtcatggtcactatgacaactatcattccacatttcctgcgtgatttacgatggaatcatcatcaatccttgacaaggcggtaaaggaggacggcaatgaaccgtgcacaagcactcagcaagctcaacaggagcgatatgcgcaatgccgccgccgagcgcgggatgcaacgactgttcacatggaaccgcgcgcattggattggcatggttgtactgatagcggtgttgctgctactgcagtggagctcatcaatgtatctcatgcccgacgaggttcttgacagggctgccaaaaacctgttcgtatggttccccggtatggttctgcactggccattggtgttgggaatcaccaacttgatactcggttcgacacgatccggcagtctgtctttcccgttggcgagcgcaatcatcggaccactggcattcggctggaccaatcttcgcttacggccggggttcccataccgttcctgggctcaagggaaagccgcaatataatgaaaacagcgatttcatgcaatgatgcacgagccgatccaagcaaaggggccaaccatgagcgagcaactgatggaacagtaccggttgcgcggacaacgcaaatgccgtaacgcttgtatcgccgccatcgtgacagtagtgcttgtccttgccgtcgccggcggcgtatggtggacggccggcgatggcagcgcattggttcgcaatatgttcaagccgaaggccacgcctgccacgcagccggtagtcaacagcaccgcaaccttcgcctaccgcaccgcaccggaattcctggcgatggaagccggcgaccgaggcaccggcaatgtgaactactctcctgcttcgatgtggatggcgttggccatcgccgcgcagggcgccaatggcacgacccgctcgcaactgaacgaactgctgggctccggttcgctgaccgatagcgactaccaatcgctgctaagttcgatcaacgggcaatattcgggggcgaaatccgagatgagcgccgcgaactcgctgtggattgatgacgactactctcttgccagcgattaccaatccaccgtcaagaagatgttcgaggccgaagtcaccacgttaccgttcgacgatcaggccgccgcaaagatgtccgattggatcgccaagcatacgaatggttcgctcaagccgaagatcacgctgcgtgaccgtgaagtcctgtccatcatcaacaccgtctatgcggatggccgttggaaggatccgttcgaagagcagtccaccggcaacggcaccttccacggcgaagccggagatgctcaggtgccgatgatgcaccggaccttcagccaaatggcttacggacatgatgagtacaacacttggcagcgggtggagattccgttcgacaacggcggcaatctggccatcgtgctgccggccgaagggcatttcgacgagttggccggcgatgccgagaagctcagttgggcgttcggtacatgctcgacggcttcccttggcgagggcgcaatgggttgcgccgcggacagtatgcccggatggggcgtctccgtcaactcggtcatggtgaacgtcacgctaccgcgattcaccatcgacagcatgttcgactcggaagccaccatcaaggcattcgaaaaactgggggtgaccgatgcgttcagtgcaggcgacgccgacttcaccaagatgatcgacaccggttcgcacggcgagaacctgtatatcggctcgattctgcaaggcacgcgcatcgaggtgaacgaagccggcgccaaggccatgtccttcaccaaggtcggcgcagactccgttagcgcgccggtggacaacgtcgagttcacggtggatcgcccatttctgtattcgtacgtcaccccggacggcataccattattcatcggtgcggtgcgcaacctcggcggagtcggtggagaaaactgatactttcctggcagtccgtcaattagggtgtatcgtttgacgcatggttacgatgaaggaaatcgcgaacaaggcgggggtttccgtctctacggtatcgctggtgctcaacggacgcgacgaggggcgcgtaaagtccaaaattgcggacaatgtgcgcgccatcgccaccaagctcggctaccagtcgaatccgctggccagttcgctgcgtacaggcaggacgcacatcctcggtttcatcagtgaggaggtggccaccaccccgtacgccggcggtatgattctgggcgcgcagaccgctgcaagccagttcggctatatgctcatcaccgtgagcaccgacggcgagaacagcgagagcgaggaaatcgccgcactcaagcgatacggcaccgacggctttctgtacgccaagatgtcgaaccgcatcacccatgtgccttcctcgctggccaagacgccactggtgttggtggatgccaccgactcgcttggcaaaatcccgagcgtggaaccggacgagttccaaatcggctacgacgccaccaccagattggttaaggccggatgcgcacgtatcgcctatgtgggttgcttggagccgctgattgcgcaggacgatcgtttggaaggctatcaggcggcgctcagggacgccggcctcgactatgacgatcatctggtcgtcaatgtgctcaacaacgggccggcactgaccgcagtcagcgatttgttcgatgccgagcatccggacggattcttctgcttcaacgatgcccgcgcctggtatgtgtacgaatgcgccgcacgccgaggactcacggtcggcaaggacatctccgtggtcggcgtggacaaccatcgcgtgttcgccgaaacgctggaaccgatgctcaccactgtggaactgccgcatttcgagatgggctactgggccgtggccaagctggtgtcgattatcgaaggacgctcgatggacgacgtctcatggccagcgaccaccgctcccctgccgccgatcgacgcgccgattccggcgaagatccactgcacgctgatcgaaaaggcctcggtgaagtaaccgagtcccacacgatttctcaaggcctccgttcagcacggaggccttttgcgtgtcgaacggatacgacacgccgatttacgtcaatcgattgacgtaaatcgattgacgtcgcataataattactacgcaacaacttctacaaaggcacggccgcccgagcagaagcgttacataaccaataaccaaccaagtagtaatcaaaggatgattatggcaagtgcaaccaaatctgcatggaagaatccttcctatctgcagagctctttcggcatcttcatgttcttctgctcctggggcatctggtggtccttcttccagcgctggctcatctcaggcgttggattgaccaatgctgaagtcggcaccatctactccatcaactcgctggccaccctggtcatcatgtttgtgtacggcgtgattcaggatcagctcggcatcaagcgcaagctcgtcatcgtagtctcggtaatcgccgcctgcgttggcccattcgtccaattcgtttacgccccgatgatcctcgccggtggcaccacccgctggatcggcgcactcatcggctccatcgttctgtctgccggcttcatgtccggctgctccctgttcgaggccgtcaccgaacgctactcccgtaaattcggtttcgaatatggccagtcccgtgcttggggctccttcggttacgccatcgtggcgctgtgcgccggcttcctgttcaacatcaacccgctgatcaacttctgggtcggctccgcattcggccttggcatgctcctcgtgtacgccttctgggtcccggccgagcagaaggaagagctcaagaaggaaaccgacccgaacgcagcccccaccaacccgtccctcaaggaaatggtcgccgttctcaagatgccgaccctgtgggtgctcatcgtcttcatgctgctgaccaacaccttctacaccgtgttcgatcagcagatgttcccgacctactacgccaacctcttccccactgaagaaatcggcaacgccacctacggcaccctgaacggtttccaggtcttccttgagtccgcaatgatgggcgtggtcccgatcatcatgaagaagatcggcgtgcgcaacgctctgctgctcggcgctaccgtgatgttcctgcgcatcggcttgtgcggcgtgttccacgacccgatcaccgtctccatcgtcaagctgttccactccatcgaagtgccgctgttctgcctgccggcattccgctacttcactctgcacttcgacaccaagctctctgccacgctgtacatggtgggcttccagatcgcttcccaagtgggtcaggtcatcttctcgacccctctgggtgccttccacgacaagatggctcagattctgccgaacaacgacatgggatcccgcgtgaccttctgggtcatctccggcatcgtgctgtgcgcgctgatctacggcttcttcgtcatcaagcgcgatgatcaggaagtcggcggcgacccgttctacaccgacaagcagctgcgccagatggaagcggccaaagcctgaaaggaccaccatgactgacttcactcccgaaacccctgttctcacccccatccgcgaccacgctgctgaactggcaaaagccgaagccggcgtggctgagatggccgccaagcgcaacaaccgctggtacccgaagtatcacatcgcctccaacggtggctggatcaacgacccgaacggcctgtgcttctacaagggcctctggcacgtgttctaccagctgcacccctacggcacccagtggggtccgatgcactggggccacgtctcctccaccgacatgctcagctggaagcgcgagcccatcatgttcgcaccgtctctagagcaggagaaggacggcgtgttctccggttccgccgtcatcgacgacaacggcgaccttcgcttctactacaccggccaccgttgggccaacggccacgacaacaccggcggcgactggcaggtgcagatgaccgcgctgccggacaatgacgagctcacctccgccaccaagcagggcatgatcatcgactgcccgaccgacaaggtcgaccaccactaccgcgacccgaaggtctggaagaccggcgacacctggtacatgaccttcggtgtctcctctgcggacaagcgcggccagatgtggctgttctcctccaaggacatggtccgctgggaatacgagcgcgtgctcttccagcacccggatccggatgtgttcatgctcgaatgccccgacttcttccccatcaaagacaaggacggcaacgagaagtgggtcattggcttctccgccatggggtccaagcccagcggcttcatgaaccgcaacgtcagcaacgccggctacatgattggcacgtgggagccgggcggcgaattcaagccggaaaccgagttccgcctgtgggattgcggccacaactactacgccccgcagtccttcaatgtggacggccgtcagatcgtctatggctggatgagcccgttcgtgcagccgattcccatggaggatgacggctggtgtggccagctcaccctgccgcgcgagatcactcttggtgatgacggcgacgtggtcaccgcgccggtcgccgaaatggaaggcctgcgcgaggataccctcgaccatggttcgatcacactcgacatggatggcgagcagatcatcgccgatgacgccgaggccgtggaaatcgaaatgaccatcgacttggctgcctccactgccgagcgtgcgggtctgaagattcacgccactgaggacggtgcctacacctacgtggcttatgacgaccagatcggccgcgtggtggtggatcgtcaggccatggccaacggcgatcgcggctaccgcgccgccccactgaccgacgccgaactggcctccggcaagctggacctgcgcgtgttcgtggatcgcggctccgtggaggtctacgtcaacggtggccaccaagtgctgagctcctactcctacgcctccgaaggcccgcgcgccatcaagctcgtcgccgagtccggtagtctcaaggtggattccctgaagctccaccacatgaagtccatcggactggagtagctctttcacctccctctgacgagggaggttttttgtgcgccctgtcgttcgccttcgcctatactgatggacggcatataacacgatccatcacacgaccggcaggcgcgcaggctcctcaccttactgttccacgccccggccgcaagcgccaccagcaaaccggactggcgcggaaagcaaggtgacatcccatgtccatcgccaagcgcctcaagcgccgcatgcccaccgtcatcgccgtcatcgtattgctggcagtctgggaaacgtgggtggatctaggacatgtctcccccacgatgatctccgcgccaagcgagattttcgccgccaccatcgaaacatggaacacgctcggcccggccgcggcaatcaccggctatgagggcgtggtcggcttcctgtttgccgtgttcttcggcattatgatcggcattgcactgtactgctcgcacacgttcaacgcggcgttctatccgctgcttgccgccgcacaaaccatgccgctgatttccatcgccccgttgttcctgatttggttcggttttgagatttccggcaaaatcgtaatcgtggcggtattcggcctcttccccatcgccgtgcagactgtgcgcggactagaagcagtgccccagttctattccgacgtcgcattgacctgcggcgcgaccccggtctggacgctctggcacgtgaagctgcgcgttgccgcacgtcagatctatggcggtatccgagtatctgccgcatacatcttcgccacggcatccaccgctgaataccttggcgcacgcaagggccttggcatctggctgcaggctgcctacaattcattccgcacgccgctgatcttctccgccaccatcgtcattatcctgatgacatgcgtactgatgctggcggtaaacgccagcgagcgcatcctgctcggcccgcccggcgacgacgaagaccccgacgcggaccagtagttctttttttaccgtcaaaggcacgagccggcggtcaggaccgactgaacgaagcggcttctcatgaggtctccaaccctgtctctataatggaacagctttaccagcgtgtggcaaaccggctttcccgagctttcatagggaatgtcgggggcgctggtcgaacggaaatcaaggccctccatatcgttttctgccgacttccgttcgaagcaatcccagagaacgatagagagacaacgaattagggaaccatcattatgaagaaaagccttgtatccaaggccgctgccctcgtgggcgcccttgccatgactttcggtttcgccgcatgtggccagaccaacaccgccgactcctccaactccaacacctccgacctcaagaaggtcactttcatgctttcctgggcacccgataccaaccacatcggcgtgtacgtggccaagaacaagggctacttcaaggacgccggccttgacgtggatatcgtggccgtggcccaggccggtgccgaacaggccgtgaacaacggtgtggccgacttcgccctgtccaacctgaccaacgtgggcgtctacacgctgaagggcgctcacatcaagcaggtgctgcaggtgcagcagaagccgagcgccatttggtgcgcactggcgtccaacaccgccatcaagtcccctaaggatttggatggcaagaccttcgccaccttcggctccaacgagtccgatgccgtggtgcgccgcatgatccaaaccgatggcggcaagggcgaattcgacaaggtgaccgtcggcacctccaccttccagaccatggaatccggcaaggccgatttcggcggcttctacgccacgtgggaaggcgtgcaagccgacatgtacggcccgaagctcaactgcttcaccgagcctgactatggcgtgcccggcaacgccgacaccatcggcatcatcaccaatgacaagaccatcaagaacaatcccgacctggtcaagaagttcactcaggccactcaaaagggttacgagtacgcgtacgccaacccggatgacgccgcgcagattctcgtggacgaagcccctgacgccaacctcaagcccgaattcgtcaagaagagcatgcaggttatcgtcgacggccagtactggggcgatccggccaagatcaaggacggctctttcgtgctcggcaccaacgacttcaagggcgctcaggaatacttcgacttcctggctgaagaagacgcatacaccgacagtcatgacaagataattcatgaggccccgcaggccaaggaccttgccaccgacgaattcatcggcaagtaatttccgatattccgagtttgaatctacgcaaaaatgcgtccttcccatgaggaaaggacgcatttttgcgtatcggccgataaggttattcatagcggattacgctaacaaggagacgattctatggtccaatgtcctgaccgcattattgccagcatagatacgggtgttgatgatgcgttggcgttggcgtatttgttggggtcgacggatgagtgcgagttgggtggcgtgattgccagttatggcaatgtggatgcgaacacggcttatgccaatacttgcgcggtgcttgatttgtttggtcgggcggatattccagtgtttttagggtctgagcatccttcttgggctgatgcgtttattcctgatgcagggtgtgcccagttccacggggatgatggactggggaatactcggctggcagggtccggggctctggctgatggagcttgtgtgcctggtgatgatatgtctgtggatgtgcccgatgaggttgtttctgttggcgggtatttggcgggggatgttcatgctcatccggcgttgggtgcttgttctcgtgtgaaccgctctcggtcggtgggccacccccagtcgactatgccgacagctctcgccagcgggggcaaaaggagatgctccgttgatgctgcggatgggattgagtatctgattgagcaggttcgcgagtttggccgagacgttaccgtgctggctaccgggccgttgacggatgtggatgcggctattactcgagcaccggatattgcatcgaaactcaggctggtgatgatgggcggtacgcttacccaacccggtaattgttgggatgcggtagctgagacgaatatcatccaagaccctgaggccgcgaatcgtgtatttcattccggcgcagacatcacaatggtgggacttgatgtgactcaccagtgtttgctaccgcaatcggcggccgaccggtggcgtgcgacggggaccaagcgcgggcggttcttggctgatctcgcggacttttccatcaaggcaaatttggaagccgaccccgcactgttctctggcggcatgccgttgcatgatccgttggcggcggcggttgcacttgattcttcactggtcgattgttttgatcttgcgttgcgcgcggagaccaataccggtgatttcaatggagtacgaggccggaccaccggagacccggttgggctggtgaatcattccatgccgcatgtgcatgtggcacttggtgtggattcgggacgttttttggatgagtttgtagagaggatggctgaggtgtgccggtaactcccctcagtccgctacacgggcagctcgaccgcaattacggacaagctgccgctcgcattcttctggctcgactctcgtctcgccttcgcctacaaacagtccaccgggcgtttgctttacggctcagcccgtcagagggggcctaacaaggactatttcacaccgccgaatcggcgatcgcggtggatgtaatggtcgatggagcgccatagcacgtcacggccgcagtccgggaagagttcgggcacgaagtcgagctcggcgtaggcggcctcccacggcaggaagttggaggtgcgctgttcgccggaagtacggatcaccaagtcgcaatcgggaatgtccggattgtacagatggtcggcaatcatcttctcagtcacacggtcgccggaaatcttgccatcgcgcacttcgcgagcgatggcggcgcaggcgtcggcgatttcagcacggccaccatagttgatgcagaacaccacatcgatgaccttgttgttcttggtgcgctcctcggcggcttcaagctcgtcgatcaccgacttccacagcttggggcgacggccggaccagcgcacgcgcacaccccactcgtccatctgttccacacgacggtggatgatttcacgcgagaaacccatgaggaagcgcacttcctgtggcgagcgcttccagttttcagtggagaacgtgtacaggctcaaataccgtacaccggcttcgatggcaccggcgatagtgtcgaacaccaccggttcggcggcctgatggccattggtgcggaccatgccgcgctgcttggcccaacgaccattaccgtccataatcacaccgatatggcggggtaccttgttcttggggaagtcgggaatacgagcggggtcgctgaacggagctgcgggaatgtccaacgacgtgtaatcaacgttctcaaaagccatactcatgaatctatcaagcgcagcgaacgaatcgggcgttcgaggtaatactccccccaatcttcaaccaactcctgcacaacccgctccacaggcgcggcatcaagcaccgaccaatcgccacgaatcagtgcatcgaactggtttaacacgaacggtgcgatacggcgcgcatcggtagtgtggtcggcttcgcacatcacaccgccggacgcgatggacaggtacgccggctccgccttgccgcataccacgcaagtgcccaatcgtggcgtccaaccggccaaggccaaggcgcgcatcacataggagtcgcctatggcttgcggggcgtgggattgtttggcgagcgcgttcaacgcgccgatgagcagccgatattggttcggcagctgctcatgttcggtgctggcgattttatcgatagtctcaacgatgacgttggcggcctcatacgccgcataatccgccgcgatcggagcaccataagcggcgaccgcttcagcttgggagaccacgtcaagcgagcggccttcagcgataagcacatcgactcgcatgaacggctcgagcctggcaccaaagcgtgatttggtgcgacgtacgcctttggcgaccgcccgaatcttgccatgcccacgcgtcaggatggtgatgatacgatcagcctcgcccagtttggaggtgcgcaacaccacaccttcgtctcggtacagcgacatctcatctcctttcccgcgacgcctggcagactctactcaatgaagtagtcagtaaataaacagaccccagaaggcgaacaccaacagtatgtacagcatggtgaaggccaccagccagaacaggattcggcccagacgggtggaggccagtaccgggtcagcaccggtgacgatgtctcgaacggattcgcgacgagggggtatctgaatcaggccgcggacggaagcgacttctatcagatgcataaagacgcgggaccaagcccatagcaccagcacggacaccacttggatgaccggccagctccaatacatgacacccggcgtctcggtaggtgcgctaccccatgcaagtttgaccacgcccatgatcacctgcccgagtccggcgaagaagatgagcaatgtggcaagagtggtgagggtcaaagtcagcagcgcattgccgaaaccatgtgcgaaaccgagtaccacaggccgttccggtatcagcatgcccgcatgtttggcctcgcgcttctctcgccgccatcgggcatccgccgcgattttgcgacccagcgccaccagtgccagcacgatggatgcgagcagcagcagtaccaccgtgacgtgcagaatcacaccatatatggtgccgacgcgtcttgccttcaaagcgcccggcagaccgattgattggtacagattggtgccagccaccttttcactggtctgcgtgagtccggcggaagtgccgacggcccagtcgatgagatcgtccacataggcgtccgcaaacggggtgcccgcttcggactcatctcccaaacgcagcacatggttggcgaccgggtagctgcgcacggtcacattccagttatcggctttgtgggcgttgtagagaatcgcacgcacaccgtcgacctgcgccgtcatcacgtctttcgaaccgtaagccacataggtgggtacggcgtaggcggcgggtttgagtgtggcgaggtcgaaattgttcagtccgaacaggccggtgtccgcgctgaacacacgttggacgatggattgatagccttcgttcgcgccaacaagggtgaagtcttgggtgacgaaaaatcccagcgattggcgtgggctgaacaccatcgggctcaggagaatctggaaggcgatgtccggatcgtcctcgagcagatacgaggagatccatgtcgattcggaggtggcatagatgccgaccttggcctcgtctacatcgctttggtctcgcaggtattcgatgacctgatcataagccttggctgaggccggataatcgcggttgatgtcggtggtgttccaaacgggtttgtcgagcactgcggtcacaaagccggccgaagccatatcagaggccacgtcgccaaaggagttgtcacaggtgccatatccggcaccgtgcatgaacaccacgccggggcgcttgcctgatgcgttctgaggttcccgaatcaataccttgatggcttggacgccgtccgcattggccttgccccgagcaccggactccttggtcagattgccgtcgccggtcatgttcagcgtgatgtatcgctcggtgacctcatacgtgccttttgccggcagcgtttctccggacgggttatcgaaggtgacttcggtatcgtcggtgagcgtggccatcgactggccggtgggttcgatgttccaaggcaccgtggtcagattggaaatggagaccagcacgccaatcaggataatgaagatgggcaggctgaccatcagccggtgggtgctggtccacggcttggatcgaacagtcaggcgatgctcttcttcttgcggcacgtgcgctattgtaatctgaccgcgatatttatgccgagggcctattcggccgaatcagtgaccggggtgctggattgggaccacgaccgggccggtggaattgacggggacttgaccgtcggcctccatttgggcggcgatatcgttcgctatggtgagcagcgtgtcgacgatctggtcttcgggcacggtcttgatgaccttgcccttgatgaagatctggcccttgccattgccggaggccacgccgaggtcggcttcgcgtgcctcgcccggaccgttgacgatgcagcccatgacggccactcggattggcgcggtcacgtccttcaggccttcggtgacggcggaggcgagctggatcacatccacttgggcgcggccgcagctcgggcaggagatgatgtcgaacttgcgggggcgcaatcccatgtattccaagagtttgcaacccaccttgacctcttcggccggcggcgcggagagagacacgcgaatcgtgtcgccaatgccctcggccaagagcgcaccgaacgccaggcaggatttgatggtgccttgccaagcggggccggcctcggtgacgccgaggtgcagcggccaatcgcccttggaagcgagcagtcggtacgtttcgaccatggtgatgacgtcatggtgtttgacggagatcttgaaatcgtggaagccgacgtcctcgaacatgtgcgcttccttcaaggcagaggccaccaatgcttccggagtcgggccaccgtatttggcgtagagttccttgtccagcgagccggcgttcacaccgatacgcagcgagatgcccgcgtcggtggcggccttgcagatgtccggaccgacttcgtcgaacttacggatgttgccggggttcacgcgcacggccgcgcagccggcgtcgatggcctggaacacgtatttggactggaagtggatatcggcgatgaccggaatcggcgatttgcggcagatttccggcagtgcgtcggcatcgtcctgactcggcacggccacgcgcacgatgtcgcagccggcggcggtcagttcggcgatctgctgcaacgtggcaggtacgttggccgtgagcgtgttggtcatcgactgcacggagatgggcgcgcccccgcccaccggcaccgggcccaccatgatgcggcgggacttgcggcgcgggtgcaagggcgattcgctggtcaggtcgaccggatcaccggttttgcggaacggcttttcgatgggattttccgtattcaaggtattcatcattgcttgtttatcaggtcgtcggcgcgtcggcgggcttcaagctcaagctggttcatttcctccacgtccgtgaacagcgggttaccacgaagctcggcgtccatctggtccagcacggctttgaccgtgtccacgatgccgaggtatggcagacgatgctcgaggaaggcatgcacggcctgttcattggctgcattgagcaccgccgtatgcttctcggaggcggccaggcagtggcgggccagttgcacggcagggaacgcctcatcgtccaacggttcaaaggtccaagttgcggcttgcgtccagtcgcacgcggcggccacattggtcatgcggtccggcgcggacaggcccagcgcgatgggcagacgcatgtctgggggcgaagcttggcaaatcgtggcgccatccacaaattcgaccatggaatggacgatggactgcgggtgcacggtcacgtcgatgcgttcaggcggcacgttgaacaagcgggacgcctcgatgacttcgaggcccttgttcatcagtgtggaggagttgatggtgacaaccggccccatgttccacgtcggatgatgcagcgcctgctcgggagtgatgttctccatgtcggcacgtttccagccgcggaacggtccgccggaggcggtgaccacaagcttggcgacttcggcgtgggttccggagcgcagggattgccagatggcggaatgctcggaatcgaccgggttgatttggttctcgcgcacttgcgcgctgaacagcagatgcccgcccgcgactacggactccttgttggccaatgccagctgggaaccggccttgagcgccgcgatcgacggttcgagtccgatggagccggtgatgccgttcaatacgacattcgcaccggagccggccatggcgatgaccgaatccggaccgccggtcacgcggacaccttgtgcgccggcctgtgcgagagctgcttgcagcgctggaaccttggtctcatcaaacaccgcgacttcggacacatggaactgtgcggcctgttgcgccagcagctcgatatgtgctccgcccgccgccagaccggtgacggtaaatcgttcaggatgacgcgagatgacgtcaagtccttgggtgccgatggatccggtggatccgagaatgatgacagtggagttggaggctatgctcactgttccttcttcgtatcgtcattgttcagtgtggggaacgacaggtcggggatatccgaatcgaagttaccgccaagcgggaacagcagcgggaacgaatcgctggaatcgtgcttatcctgtgacggctgagctgcttccgtgtcatgggaggcggcaacgtattcagatgattccgcagccggacgggagatcgtgctgtctgcaggctgactatcggatacgcgaaccggaatggagttcgtgttacgatccggcttgctggtgggagcaaaggagaccggcatagcagcggacgcagcctcgtcagcagtgctattcacaggctgtactgccggggcggagggtgccggggatgaaaccgaacccggtacctcattcaatttcagcgcattcggtgcatcaaggctgggcatcttaggagcgaaggacggtgcatccactgccggaagttcctgagaaaccgcagccatgtgggcgagagcggccaaagaggaatcgttctgcaccatatccacgggctgttccgcgaacaccgacggggtcgatgacggagctgcgggttcgtgagctgcctgtgccggagcaaacgaggggacgctgccagcggtcacaccggaaaccggcgcggacggggcactgacgggaggctcagccgcagcaactgcggtaggagccacggaaggcgtctcggagacgggcttcgccgcagactcgttggacgcatgcaccaggtatgctgcgggagcaaaggaaaccggctgttccgcattggtgctattggtgcttgtggaagcatcgaacgatgcaggagccggcgcataggagatcggcgccgccgcggccggcgttgcgggagcaaccggagccggagccgtgaacaagctctgctcggcctgatgcagggcatcgaatgattcgtcatgagcaacggcagccggagcaaaacgttcgtcagttgccgggcgctgcgttccggaagcgaacaacggtgagacgccgttcgcttgaacggtcacgttcgtggcggtctgggcaggagccgcaggctcgccggacacgaaatcggccacacgggcataggattccaagcgactcagcaactgtacgcaggcgttcaggaagtaatcgacctgtcgctcgtcatagcctttcttgcccttgcgctgggtgaagatcacattgttgaccgtattcgcattgagatcggccaaagaccgtacatcgtcttcggtaacgccgtcaacgcccaatgcggccgccgccttgtccacaatctggtcgaccagacgatccacctgcttcttatcgtacgaaggctgcttgggcgctccggacttgaagcgttcacgctcgttacgctccgcatggttctggacttcgtgatacagcttctcggtcttcgccttccacgtcacacgcccatgctgtgcgatctcccatgtggtctgcttatcgaccacggcacgttccagacgtccaagcgcggcgtcaacctgtgcgatcacatagccgttcttgcgcaaatcaaaggacacgttctgaatgtcatgctgggtgagattcatgccctcgctgtcatacaaagcatgggcgcgctccaggaaagcgtccacctgagcggggtcatacccccacttgcgcttgcccgcacgtgcgatgcccgacttgccgtccccttcacgaagttcctgcgccatcggctattcgacctcctgctggatataaacactctgccacaactttacgtgactattgagacgcatctgaccaagaaaaccgaaattcacgattttgtagcagtactgccggtttccttctgcacgcatctcattgagatttcagaacccttgccgaagactgtcagggaatatcgtcacagcctatatccgtggaatgaggggattccatgaagcgatgaaaaatgaaagtgggcaatgagggactcgaacccccgacatccaccgtgtaaaggtggcgctctaaccaactgagctaattgcccgcaaatgacaacaatagcgtatggccggcactgcgcgacacgtggtgtcgcatacgcgtgccgtagcgctcaatcgcgatgacattcagtcacgcccagcagcactacgtagcacacgacgccagtcaacacgcttaaagtcaagcgtattgattgaggcttatcagcgacccttgccgaatgcgcgcaggcggatgccgttccagtccgagctgacggtcagcggggtggcggcgttcataccggcggtctgtgcggcggactgcacggtggatgagctggtggcacccgggcggccgggcttgggagtcagtatccacagcgggccgtcattgcccagtaccgcgtaggcgtcaacgatcgtatcggacaattcgtcctcatcatcgccgtcacgccaccatacgatgacgccgtccacagcggagtcgtagtcctcgtccacgagatcctcgcccgtgagctcttcaatctgggcacgaatggaatcgtccacgtcgtcgtcccagagccactcctggacgatatcgccgggctcgaaaccaaattcttcagcgttctgtgatgccgtttgattcacaggggacacattagcaagtcttcgcgaacaaatgcgttaacgcggccgaaaatcgccgcattgtgggcagacccatgcgagtcgtctcatcagaaacaacgactggccgcgcatgtcaggcctcgcaatgaggcaaatcgtcggcctgccccttgccgatggccaccaacgcctgatacgcctcgtccagcgtggcgaccttgacgtcgcgcagaccatccggcacgcggccggccacatccgaacaattcgacgcgggggccaggaaccatgtggcgccatcgcgcttggagccaagcatcttcagctctatgccgccgattctgccgactttgccgtccttgtctatggtgccggtgccggcgatggtcttgccgccgctctcgttggcgggggtgagtttgtcgatgagaccgagcgtgtacatcatgcctgcggacggcccgccgatgctgtccacgtgcatcgtcaccttggcgtgttgcaatgcactggcgtcaatgcccagttcgtccgcatgggctttggcatacgccagaccgacggcactggccgaatcctgggaaccggccatgtcttgttcgactttcttctgatactggtccgcgctctggcccaccggtaccgtggcctcacgcggcatgacctccacctgcggattggaccaaccccagacggcctgcgcgttgatgatcgggtacccgggcacgccggacgcgttcaccgtggtcagcagcagcttgccggaatccttatacgtcgtcacgccggtaccagtgatgtcgataaccgcaccatcctcaactttgcccagcacatcctgggtgggtccgggcatctcgatgacgtacgggctgggcagcagcagaatcaccacaccaagcaacacggcgaatgcaccgacgaaatggcgtttcggacgagcggccgcataggcccgagcacggctgattccacgagataggcgcgaatcatgcttcacttcgaacgatggcatgtgctcatctcccgcttccgaatccgcagtcgggctctcctgctcctggacgaggtctggttcctgattcctgtggcgtgcaaacataccctacagtgtaagcggagggccgaaatcggccgaaaacgaacataaaccgaaaatattgctcggccacaagcgaacaggcccgggcagaccctacacttggggtaacacaccgcggcaaagaaggatacgcatggacgacaacgcgattcacgagtggctgatcaaatgcttcggccccattcagggtgagatggcctggcagcagatcagccagttgcctgaggagatccgtgaacagctgatgagtcaggaccccagccgactgcccaatccatccgaagtccagcagatgatggccgcgttcagcgccggcggactcaacacgatgggcgatatgcagcgcactgtcgaggaagggccgatcaacgtcaagctcgccaagtcgattgccttgcagcaggccaacgcctccggttctgcatccagcgtgtccgccgtggatggcgaggcggctcgccgcgcgatgagtgaggcgaacctgtggctggataccgcctgcgagttcaatcccgcgcccggcgatccggatgtgctgacccgcgccggctgggtggagggcaccatcgaccagtgggcgaagttcgcagctcctgtggccgagtcgatgaacgacgctttggcttcggtgatttcggagcgtcttggcggcgcgttcggcgatggcgagattgccggcatgttcgccggaccggtgccgattccgattcccgacggtatgaaagacccagcccaactgatgaagctgctgggcaacacgtcctttgccatgcagttggggcatgcggccggcaatctgagccatgaagtgcatggcagcttcgatcagggcatcgcgttgctgaagaacccggctggtggactgattgcccagaacgccaccgaatacgcgaagatgctgaacggtgaggcttctgcggccgaggccgacacggccggcacttcaaccgactcggtcaatccgttctccacatccaccgacgcttctgccaatcccattggcttcacttcggccggcaacagcgatactccggcaactgacggtaccgcccaagtctccggctctgatgcttccgccgatgccgccgacgccgccgcgttcgaggctgcgctctccggattcgagaccaccgagaaaatccccgaatctgaagtgctttccttcctggccctgcaggaaatggctcacgcccgcctgtacgcctcggtaccgtggctgatgccgcgtttcgaggcgctcatcggcaagtacgcacgcggcatctccatcgatctggatgcgatggaggaacagctgcgtgacgccacgtcgatggatccggagtcgatttccggcgcggtgaatctcaccaaggtcggcatccccgacactcccgaacagcgcgaggcgctggcttcgctggaatcgctgctggcgatggtcgagggctgggtggattgcgtggtgtggcgcgccggtatggcccatctgcctcatatcgaacagttgcgtgagatgatgcgccgcgagcgcgcgatgggtggccccgccgagcgtacgttcgaaagtctgctcggtttgcagctgcgtcccaagcgcatgcgcgaggccaccgggatatgggagatgatcaccgccgccgaaggccctgaaggccgtgacgccaagtggacgcatcccgatctgctgccttcgctgcctggcgacaagcccgcagatggcgcgtctccgtcatccgacgccccttcaggttcttcttccgatgccaacggttccgcttctcaccctgccgcagatggcaagaccggcgatatcgattgggatgccgaactgtccaagctgctcggcgaagatggcgaagacggtgaaaacggcaactcggaggatacgcaggcatagtcaaccggccttcagccaattcccgctcctgaacgttcaggagcattcagtatgcattacagacgcccgtcacaaaaatcgtgatgggcgtctgcgctgcgctccataaccatccttggtccgtgcatacgacaaatgcagcgaatcctcagctcgggtgatgcccacatacataagccggcgttcctcttccagcgcatcccccgtttccggcgaaccatacggcaagagcccttccgaacagccgatcagaaacacgtgcttgaattccagacccttggatgcgtggatcgtggaaatcgtaaccccgagatcgtcgtttgcggcaagtccggtggcgtccaaacccatcgcctccaatagtgcgcgtttggacgcggcatcgtcggcgagcgcggatgattgccatcccgaatccttgcggacgcgatatttcagtctcgcagcgcgcaaggcggcaccgaataccggctgttgggcgttgatgcgggtgaggatcgcgcaatcggacggcttggccccgttggcaaccaaccgggctatgcgtgccgccacgccctgtgcctcttccatatcgctctcataagcggttcgggtaacgcgcggaccggattcacgggcggaaaccagtttcaggtaatcctcacggttcggcgcggccgcaagcacccggttggcgaggttcacgacttccggcgtcgaacgatagtcggtgttgagattgacatcggcggcgagcggcccgaattcatcggcgaaacgcagcagatcccagctggaagcaccggcaaacgagtagatggtctgggccggatcgcccacgacgcatacgttgcggttcattgcgctcttgccgtcaggtcctcccccgcccagccacagggtcagtagcctgtgttgcaggggcgagacgtcctgatactcgtcgacggtgagccagccgatggtggaacgaatttgggcggcggcttcgggaaaaccatccatgatatggcatacgagcaacagaatatcgtcaaaatcgatttcgccacgcgaggtcttttcctgctcgtaggcgctgtagacgtcggcgaaccgagcggtgtcgagtccggcgggcggctgcctatgggcgatggcacatgcccgggcataatcttccaccgccaccaacgagattttggcccaattgatttcggcgagcacatcgcgaacggtcagcggatcggcatcggtacgtgcggtggcgcggatgatcgcgcgggagacgacgtcacgctgatcttcgatcacatgcggaaatggagcctcgcatatgtctgcccagacgctgttgagctgatgcaatgccgctgagtggaaggtcgcggccgtgactccggcagttcccgcacccgaaccggaacgtccagtacctccccctacgccgagctggcccaatcgtgcgcgcatttccgccgccgcttttaccgaaaaggtgacggcaagcacccgctccggcttccatgccccggtggcgcaggcataggcgattcgccgcgtgaccgtgcgtgttttaccggcacctgcgccggcgataatgcgcaccggcccttgcaacgtagtcgcggcggtacgctgccgctcatcgagcccctcaagaatcccctgcgcctgttccatgcgtccattgtggcacgattcgcgctcacggcacgactcatgcctatggctgaatcgggctcacgacaaaacatcgccagaatcatgcgttttgcgtgtcattctgcggtgcgaatcgccacggatgtattagtgtggaagggtgatgaaacgtagcgattatatgttggcggcactcgcctcagccgtcctgccgaatctgggggtggccggcgtacgcgagaacgtgcaggccagcgcaaccgacgaggccaaaggcatcgatcagaccgtgattcaagatgcctcaggcaagttgtacgacgtatacgccactgacaccaaggaagggcgtacgcgtctgattcgccgtgtgaaagcggcgcagacactggcagccgcgcgcgagcctggtggcctcggcttcgatatggaccgtgtggtcgcgttcgccccgggagacgtttcccgacccggccagacggccaccgcacaggccgtggggcagcagactcaggcggagtccacaccgctgaccccgcgcaagcccggtcccacaggcgagacgaccgtgatgattgccgtccaccgtgatggccaggcgcggcctctcgacctgttgacattggatgactgcgcggccgtcggcaccgccatcggagccattcatcgcctgccttcgacttttctggccaatgccaaatatccggtagttaccaccggtcagattcgttcgcagctgaccgcctggattcgccgcttacgctccgccggccatgttccccaagaaatcaccgacagctgggcgcgcatcatggacaccgagggattgtggtcgttctccacctgcacggttcacggcggattttccgacggcgacttcctgttctccggttccaccatcaccacggtgaccaactggcaggatatgcaggtcaacgatccggcacgagaccttgcctggattttcggcaagctcgacgaatcccatcgcaacgccgtgctttccgcatacggccgcatgatgggctctcgacttgacgatctcatcatgctcagggccaacctgtggctgcagatggaacaggtgggcgaattcattcaggcgttgaaccgtgcggacaacgatcacatcatgcagttcaaggcacaggtcgaacgactcgcacaccagttgggcgtgatcaagcacactccggcaccggccccagccgcagggtcggccgccgcctcgtcaacgaagcccggtttgccttccacaatcaccgtcggcacattgttgcaggacgaccgtcatcaggcacccgcacaaccgcagcagtccgacaccggtaccgcggcggccgaggtctcggacgacacgcccgatcccgatcgcaccggttccgctgacatcgtggccgctggcgacgtggatcttaccccggaagtcgaacccgatgctgaccggaccgccaatcacccgcaagcgaatgtctccggcatcgcaaccggtacgggatcgaccaaaccgcagccctcacatggcgcttcccattcttcggtgacgatcacgctgaaggagctcctcagtatgaacgggcatagcggcacgacgtcaaccgacgcttcccctgcgtctcaatccgccgccccgaccgacgatgcggtgaatgacgatactccggacagtctcgttcagtacggagcctcgagtgcccaaaccacggtgattccgctgttggagcgggaagaacgcgctctgcgcgatgcccgtgccgggttggacgggtatgacagcgagggcaatccgctggccgaatcgtccacatcatccaaataatgtcgtgtacggtgttccgcgccacgccgagcgcgtaacaccgcacatgacgacgcagacacgcggcacaatagagtacagaacctcggccggcgacggccacttaccatgatgttcgtcacaaagacggcagaacaaggagccttatatggatatcgaactgggcattcagaacgtggcacgaccggtgaacttcagcaccgacgaatcagccgacaatgtgagccaggccatcgcgcaggccgtggccgacaacacgacgatcgatctgaccgatgacaagggccgtcgcatcatcgtgcccgccaaggcactcggttacgcgatcatcggctccgaaaccaagcacgccgtcggcttcggcacgctgtgaccatgaatcgcgcataagcggccttgggcattatctcaaggccgcttttgtattgctgaatcaccgatatagcggaagcacgccgcgatgaacgatctcttcgacagtggcctcgtcggtgaggttctcccccagtttgttcggtttgcctttgccatgccagtcagacccaccggtgaccagcagctggtgccggcggcagatggtgagcagccgttctcgttgctccggtgaattgccacggtgccatacctccagcccgtccagtccttcgctgatcaatgcctcgatctggtcatcggacaacagtctgcggttacggctcacatcaccggcatgggcgatcagaatcacaccgcctgctcccttgacggcggccaccacttcatgagaggtcggcgaaggcgtgggaatatagtatttggatgaggcgctgaccgcatccgcaaacgcttccgaacgagtccgatatacgccggcactcaccaaagcatcagcgatgtgaggccggccaatggtggttttgccaccctccttgacttgggcgagcacggattgccaggtaatcggataatcacgagacaacaattcgaccatgcgctgcgtgcgttgcaaccgtgcggctcgagtattggcgaacaagtccgtgatgtgctgattcgtgggatcatactggtagccgagcatgtgcacggagacgttctcatccgtggcggtgatctcggtgccgcggagcaacggcaaaccgaccctatgagccgcggcttcggcctccggccagccggcggtggtgtcatgatcggaaatggccacgcccttgagtcccaatgccttggattgttcggccaacgtggccggcgtttccgtgccatccgagaaggcggtatggcagtggatgtcccacccgacggcgggcggttccaaaggcatcacatatccagtcataccttccatcgtaacctcatttcagcattcccacgcaaggcgcagacaggtcgtcaccttctgccaacggccgaaaccagacattcggcacccagctgacaaccgcagaggctaatctggagcgcagcgctatcgaaagggacatgatgactcgtaacaccgcaaccgacacatcatccagcaccacgaacaccacgccgcttggcttggcggaggcacgaccgttgattggatggcgccacagtgccacttggacatatctcatcatgctgattgcctcggcagtggcgttgggggcctcgctcattctgtccgctgagactttgcaattggctcggcatccggagtccgcgctcggctgcgatctgaactcggcggtgtcctgttcggcggtggcccagtcctggcaggcggaaatcgtgaaattcggcgggctgagctatccgaacgcgttcttcggcatcgccgccgaatcggtgttcgttaccatcgcggtgatcggtctggcgcgtgtgaaggtgccgcgttggttcgcgacctgcacgtggctgggcggactggccgctttggcttactcgtactggctgagcacgcagtcgctgttcgtgattcacgcgctgtgcccgtggtgcctgaccctgatgttctccaccaccatccagttcatggcgttgagccatgcgaccgtggccgtgcagggattgccgtcacgtaaagctgtggcggctgatgatagcgacggtgaggctgaggtcgcaatggtgccggccggactcaataagtattaccgcctcaacatcgacctcatggtcgatatactgtggatcgtggcgatcgtggtactcatcatcgtcaccgaaggcgcggccctgttcgctgcctgattcctttacaacaaatcgatatcggcgaccagcgtggctgctccggtcagctttacgtcgctgtcggtgacgtccacgcgcagggtaccgccacgtacggtgatgtcccagtggctgatgccggtcttggcccgcagcacaatgcctgtggcgcacaggccggtgccgcaggacagggtttcgccgcagccacgttcgttgacgcgcatcgtggcttcacccacgccggtgttctggtcgatgtcgtcgacccgcacgaattccacgttctggtcggattcgatgaccggagccaccactggtttggtgaccaaatccagtgattcaaccactggcagggacgcgaaggcatcctcgatcaccgcgaccacatgcgggttgcccatatccacgaacgtaccgcgcgccgagccctcagtgccggggatggtgacctcgtaggcgtcggtttcgccgatcttccactcccccatttcgacctggaacacgttggctccgtacggcctcatattgccgcgtggcgtcagaatcttgacgccggcacgggtgccgaggcggaacggctcggtggagtcggccacaccctcacgctgagcgaacaaggtgatggcgcgtgtaccgttgccgcacatctccgccaacgatccatccgcattgcgatagtccatgaaccatttcgtgcccccggccagtacgtccgaaagctgatcatcgcttaaatcagacacgaaatcaggccgtgtcaggcgaatcaggccgtcaccgccaatgccgaagtgacggtcgcacaggaatcggacctcatcggcggtaggctcgaatttgccggacttgtcgaggtataccacgaaatcattgccggttgcgtgtgtcttggttactcgttgcggaagactcatggctttcagagtactctagggagcgaaacaacaccgcaaaacaatcggctttgtgatcggtcgcggcaacatacggttgcaggcatggctatagggaggattcaggcatgagctcttcggctccaatcggcgtattcgattcgggtcttggcggtatttccgtggctcgccaaatcgccaaggatatgccggccgagcatgtgctgtattttggtgattcggccaacgcaccgtacggcatcaagacgcctgaacaagtgagggccctgagtttcgatattgtcgaacggttcgtgcgtcaaggcgtcaaggccgtggtcatcgcatgcaacaccgccacttccgccgcggtgaacgatttgcgcgaacactacgatattccgatcatcggcatggagccggccctgaaagtggcgtgcgaccgtggtgacgtgccttccgacccgcatcatattccccagagggtgattgtggcggccactcccctgaccttgcgtgagcggaagttcgccaaactgatggatcgattcgattccaacaacacgattttcaaggagccttgccccgacttggtggagatcgtggaatccgggcggctcggcgaccatgacctggtgatgcgcacgctgcacggctacttcgaccagtacgacatggagcatatcgactcggtggtgctgggctgcacgcatttcgtgttctaccgcgactacttccgcgagctgctgcccgaacgggctgctgtcatcgacggcaatgagggtaccgtgcgccatctgggcgtggtgttggagtccctgggcaaactggcacccgaagacgcgaccggcggcgtggagctcgccaattccgatccgtccgaacggattgccgagttgtcacgcaaattgctgaacgtatgagccgttcttggctcccctctctgagggaagccaaggaagaaccagacaaattcacagcacactgcccatatcgttgtccgtgcagcacgcgtaagctcataccagattcaagtgaacagggggttggtatgacaaagacggcgatgattgatgtcggcggcgggttccgcgcgattttcggctgtggtgttatggaccgcatgctggaggacggcatcgacgtggatatgtgctacggcgtttccgccggcgcggccaatatgacctcattcatcgcacgccagcacggccgcaaccacaccttctacaccaagtacgccttccgcaaggagtacgcgagtgcggaaagcttcttcaagaaccacaactttgccaacctcgactacatctacggcacgctgagcaatcacgatggcgagaatccgttggatttcgcggcgttcgaggccaatgagaccgggttcaccgtggtggcctgcaatgccgaggacggctcgaccaagtacttcgacaaatcgcgcgtgcgttttgatgatttcgacatcatcaaggcttcgtccgccgtgccggtggcctgcgagccgtatgtggtggatggcgtgccgtatttcgatggcggcatcgctgatccggtgccggtgcagaaggcgctggaggacggctacgatcgcgtgattctgattctgtcccgcttgcgtaacgaagtgcgcaagcagcagaaggatttggctccggcccgcatcctcgaacgctcccaccccgccgcggccgagaagctgcgcatgcgctacaagacctacaacgacgaactcgaactcgccaagcattacgaggcggaaggcaaagtgctgatcctcgcacccgaagacctgtatggtctcaacaccctgaagaagaacttcgagggcctggaaatgatgtatcgcaagggatacgcggcggccgaggccattccggcattccttcaggcatagcgatagtgaagtccctcgcttggaggggcttcactatcgatggatggggattcgcaaacggggtgattacttcgtctcggaagcggtgagcatggccttggtgacctgctcgtagagatcctgataaccgccgggcgtggaggcgggcagcaccacggtcttggtgttgttcgattcggacagcgagcgcatcacgtcgaggtactggttgaacagcaccacgttgttcacgtcgttgatgttcatgcccacagcctgcagactcttgatctggtcgacgataccgttggcgatctcgcggcggtaattggcctggccctcaccctgcaagcgagtcttctccgcatcggcggcggcttgggtctcgatctggatacgctgggcctcggcacgctgacgggtggcttccttttcacgctgggcggcattgatggagtccatcgcgttcttgacctgtgggctcgggtcgatggcggtgatcagcgtcttgaccacggtgaagccgaaacggctcatttcggcgcccacggtcttctgcacgtcgaacgccacatcgtccttgcgggcaaaggcatcgtccaaagacagtgcggggatagcggaacgcagcgcgtcctccatgtaggagcgcagctgaccggccgggtcacgcagctcgtagtaggcggtggccacatcgttcgggttcacgcggaactgggtggaggccaccacggtgacgaacacgttgtcgagcgtcttggtttccagctgcacgttaagctggttgacacgcatgttcgttttcatggcgatgcggtccacaaacggaatgcggatatggatgccggcgaactgcaccttaaggaacttgccgaagcgttcgatgatgtacgcctgctgctgcggcacgacgaagagtgcggcagacagcagaacaatgagtagcacgatgataatcagcggaccagcaaagaatacggccatgatgttttcccttcacccacgtcgaaaccgccctcggcctcgactcgtgatttccatcgtatcagcgttcaaaacaaagcggtagacatcgtacgcatatgtgtacaactgttcactatgtgtgcatgctggcttcttataaaaaagtgcggcatccaatcagtatgctgcggccatgcctgagccgacagccacggcgccgataccgtcctccagcgcggcaagccgcttttccagtgcatcgacagtgggattggccacacgggagtactcgaagccgtcgatgtcaccgcccgcgagcgcatcgccgcgcgccgcgtcacccaggtcgaatgcggccgaggcatagattggcggcacagcggcacggccgttatccagcggctcgtagccggcgtggatggcttgcgttcggaaatcaacgcccattaatccttcttcctcatgccgctctattgtggcgggctcgactctattcccgaacttagcaagtcatggtacgcgacaccggcacatcggtatcgcaattgtcaatgcgcgcttataagcaatggctatagaatatccgccgaatgccggaacacaccaagctgcctagccctctttcagcacctcggccgcaatattacgctgcctcaaataattcaaagccgcgtcaatccgtaccggttcatcatcgaaaatggccacgatgccctctaccggagtatccgcgacgatgtcgatatctccaaagattatgttgacatcgatgccgaaccctttagtaatttgcgacaccaacgcttcagaaacttccttggacacatattgcatccggaccaatcgttggccttcagacaatctcatcaaaagggagtcatggttctcttttcatatctggcgataacgcatatcaaatcagcaatcagcgcaaagacgctcggtcgctccatccggataacaactttgccgtttcgcctaaggtgtcgatgacatggtcaaccggtgcgtcagaaagagcttcagcatagttctcgatgcgatagtcgaaataacgatcggcgcccagcgcgctgctctccgaaagcaccgggacgaacgccgtcagcattcgtaacaccttgggagcgctcaaacgcgcggggctcatcaccgtggcacgcggaaccggcggcgccgaacttgcccacaccccccaaggaaatcactctgctcgatatccatcaggcagtggaatccacgaacctcgatgatgtgatcggcatccacgagagagggaatcacacatgccccgtggctcggaatatccacgacgttctcaaagatgcgtatgctccagtggccaaagccatgtcggattccatgagggaagttacgcttgccaatatgcttgccgactaccgaaatcgcattggggtcaaagcccggcaattggaacagtagtgggcaccgaagcgtaagccccccctactctctgatccgcataaacagataaggcgtgcgccatcaagaccgatcgatgacgcacgccttatgcagctcagaccacggattcctagtcagccagcagccccagctcctgcagcttgttcctgatatccactgcagagggttccacttggaacgagccgtcatcgtaccgcaccaccggaatgtgcatctggccgctgatcgccacggcacggtcggcggcaccttcctcttcctcgatgttgtgccaagtgtatgccgcgcccagtttgtcgagagtgttctttgcctggcggcagtcgccacaccatgtggcaccgtagacgtcgatggtcatatcgggtcctttctttgttccgccgcgcttgacttttacgcggtgcactatcaaaccgtattcatcgtaacggggatgctgtgatatcgcggttggcataatgcgggcggtccgcttaaccaccccagtcggctacgccgacagccctctgccagcggaggcggaaccagagcataaaaaagcggctccggtgtggcacaaccgacgccgctccccaggagtagaaaaataggcagaaaagaattagatcaggcaaacaccccccgaagtcagctgttggaacacgtcgaagtcggcatgccgatcgatgtaacgggcgtaagcgatatcgaacgcctggccgagatcttcgatcagatcgttggcgtcctcgatgccaacggcgagacgcaccaattcatcggtgatgccgatcttcagacgctcctcgcgaggcagttcgaaatgcgtcatacgacacggcagctcggcaagagactccaccgcacccaacgacacagcaagacggaacaggtgcaggttgttgagcacgtcagccggatcaacgccaggcacgacctcgaagctcaacacgccaccggcccccttgagacctttggcagccagacgctggtcgcctgcgccgggcagacccgggtaatgcaccgccttaaccagcggatgcaccagcaggtagcgggcgatggcattggcattctcctgctgacgatccatgcgaagggccagcgtctgaatgccgcggcgcaccgcgtcgcactcagcaggagccaacacaccacccaaacggttctgcgcgaagtacacgcggctcgccagatcctcaccggaaacgaccaccagaccggcgttcacatcagaatgaccggccagatacttggtggcggagtgaatcaccacatcggcacccaaagcaagcggcttctgcagatacggggtcacgaacgtgttatccacaatcgaaagcgccccgaaacggtgggccaccgtggagatggcgcgcacgtcgttcaccttgagtagaggattggtcagggtttcaaagtagacggcttgggcaggcacgatgccgttcgcgcggtcgcccttgacggcggcctccaatgctgcgatgtcctgagtgtcgacggcctcgacgaggattccccagcgagtgaagaactcattgagctgggaatacgatccgccataaatattgtcaccgaccacgatgcggtcgccgggcttgaaaatgctcagcaccgcgtgaatcgccgcgagaccggaggcgaacgcaaaaccacgcgttccctgctcgagctgggcgatctgctgttccaggaagtcacgtgtgggattgccgcttcgtgcgtagtcatagcggggcatcgcgtcaaccttctcgaaggcatatgtcgttgagttgtagatcggcgggttcacggctccggtgttgttgtctccaaccggcagtccgtggacgagctgagtgttgaacctggtcattgcgcacccccttaaagtgttgcgtcatctgcgcgaagccgttccccgcgcggcacgattacgaccttaacgcaaaacgccggcccgaaggccggcgttgctatatgtgttggttatggacgggtataatcagacctctccgtcctgcaagaatggacggcctgacgaccggcccaacacacctcgccgctgccgcggctcggcgtcgcctacggacagtccaccggactgtccgtcagacggctccgccttctaccacgatgtcatcggggttgacttcgttgccgtagaccggctccagagtctcctggtaatccttgtggaagaagttgtctttgccgagcttgacgatctcgtcgttcacgaagttcagcagttcggtgttgcccttctgcacggcgggcgcgatggtgtcgtcgtcaccaaggtgggtgatgccaaccttgaagcccttgttggacttggcccaggcgagcacctcggtgttgtcggtggagaaggcgtcaccacggccgtccagcagcgcgttgtaggcatcggcgtactggtcgtacttctgcagcttgacgttcggcgcgttcttctcgaaccaggtttcggcggtggtgcccttagcgatgatcagggtcttgccgtcgagctgactgacatcggtgatctgggcgctctccggggagaccacaccaagcgccaccttcatgtacggcttggcgaagtcgaccttctccttgcgctcatcggtgacggtgaaattggcgagcaccagatcgaccttgttggaggtgagcacgtccacacgggcagccgggtcaaccgacgtgtattccggctccacacccagatccttggccagctgttcggcgaagtagacgtcatagccctggtacttgccgtccttgtccacgtagccgaatggcgccttgtcggagaagacggcaatcttgatcttgccgctcttcttgatctcgtcgaggctgcgggccttggcattggcgctggagctggtgcccgtgtcagaggacttcgcttcgctcggggtgcctgccgacggaccgcatgcggccatggacgccgccattaccaatgccgcgcctgcggcaatcagtgctttgaatgatttcccaaccttgatactcattgggttctccttctcttgttgttattgatatttcttctcaaatacgtcgatatggcacaatcgaatcactcgaattcgaaggtgtgcaggaactgctgcgcacgttcggtttgcgggtgttcgaagaacgcctgcgcatcatacgattcctcgacgatgcgcccgccgtccagcaagatgatgtggtcggcgatggctcgcgcgaactgcatttcgtgggtgacgataagcatcgtctgcccggacttggccagttcgagcaccacgtcgagcacttcacgcaccatttcggggtcgagagccgccgtaatctcatcgagcagcagtacttccgggtgcagaatcagcgcacgacaaatggccacacgctggcgctgaccgccggacaattcgtgcggccaagagtccttgcgatcggcaagtcccacgcggccaagcaaccggatcgcttcagcctccacctcggacttatcgcgtttctgcacgagcaccggcgccatggtgatgttgccgagcaccgttttgttcgggaacaaatcgtagctttggaacaccatgccgatacgcgtgcgcagttcactggaccggtcggatcgtccggctcgttccgtgccaggcttgccggcatcgatcacctgatcgttgatggaaatcgtgccgccctgaatcggttccagaccggcgatggtgcgcagcagcgtcgacttgcccgagccggaaggacccagcaccacgagcaccgaaccatgctccaccttgaaggagatgtcatccagcaccggcttgtcggcattcgcatactgtttgaccagatgattcacctcgaaacccttgcaggtcgtttcgggttcagtcattcgaccacctcttttccagtcggcgggccacaatggacagcggccagcacacgatgaagtacataaagaaaatcacgccataaatccacaaggttccggtcgggaactggaatcggttcgcgtcgataatctgctggccgaccttgatgacctcgaccacaccgagcagcacggccaatgatgtcgttttgacgatacgtgtcgccaagtttacggatgccggcagcatacggcgaacagcctgcggcagaatcacccgggagaaggtctgccacgggctcaaccccagtacgtagctcgattcgtactgcactttgggaatcgactgcaatgcgccacgcaccagatcgcccagctcggcgcctccccacaggatgaacaccagcacgcaggcaccggtggcatcgagattccaatcgaaccatcgagcaaaaccgtagtaggcaaggaacagcaacgccagctgaggcataatgcggatgaagtcgaggtagatgcgcatcgcggcccggatcacgggattcttcagcgtcatcaaccagcccatcaacaggccgaccgggatggacgcgcctacggatacgccggctatccacacggtgacccacaggccttgcaacagacgtgggaatacgcctggctggagcagtatttcagcgccgctcataatcgaacctccgctccaaccatgtgccgaagatggaaatcggcagcagaatcaccagataggccacgaccagcatgaacaacgactcataggtgctgtaatacatgccgatcagatccttggccatgtacatcacgtcggcgagcgcaatggcggagacgacgctcgattccttaaacaggaagatcacattggccactacgccgggaatggcggtggacactgcttgcggcagaatgactcgggtgatggtttgcgtggaagtcagtcccagcacgtacgcggtttcgcgctgcacgttgggcaccgcttccaatccgccgcgcattgcctcggccatgtaggaaccgcccaagaatccaaggccgactatcgcgcaggtttcggcggaccatactacgccgagtttgggcaggccgaagtacagaaagtacagctgtaccagcaatggcgtattgcggctaagttcgatgtagattctcacgatttgccgggcgaccgggatacgcgcgatttccacgccagcgcagaccagacccaccgcgatggcaagcaatatgccaaacacggatatgaataaggtcatcaatgtgccgttgacgaagaaaggcgcgtaacgctgcacgaacgaccaatcgaatgtcattgggcgcgctccttcctttgcttctcgtttcttctcctgcgcataaacggtcttagccacccatgtacgatttcgggggccgaacatacctgtccccctgccgtgtcatcgtagagtatcagaacacgtggcacggccgctgcgctatacgcattacttatgggacgttactcgatgggcgaacatcagggcattattgtcgcccaaacggtggatacactgaggctatgaagatcaccaaagctctgacccgtttgaccggtcccgaaaccgctccggtgttcgtgctgttgcacggctggggttccaatgaatacgatttgcccgatctgctgaactattgcggtgccggttcggctgattatgccagtttgcaggcacccatcgcctatggcatgggatatacatggttcggtgcgtgggcgcatgaaggtgtgccggagggcgaatcattagacaagcaggcgactgaagccgcccaagccattgatgcatgggttgcggagcatattcccgccactcggccggtggttgccatgggattctcgcagggcggcctcttggccgcgcatcttttgcgatgcaatccgcaacggtatgcggcagcggtctcctgctccggctggttggctccggggccggtctctggagacaccgagctggctgcgttgaagccgccggtgttctacgggcatggtgctgcagacgacatcttcccgaaagccgatgtgacggcgatgggtgagttctggcacgagcacggcacgttgaccgaacaagtgtatccgggcatggcccattccattaatatgccggaaatgcgcgatattcaacggttcttggagaccaacggattcattcggccgcagatttggtagtcaccacctcacatggcgtagtcgacgtgggcgaattcagggaccttataccatttgacggggtagccggcaccgtgggcgcagaagaccgagtcgggggtgttgtccagatctgcttcgggatcgtaagcggcggctgcgatgatctgttcggcgtcatggcatggcttgtagccgccgaaagtggcggagaaacggccatggccgtgcgtgtactggttcacgtccatcgcatagtcgcgcatctcggacaccggcgcctcgccttcgatcacggcgtattcgccatcggtgaccggggattcgaaggtgccggccatgcgctggatgtcgctcatggcacggccgatcatgtctgctggcacttcgagccggaaccggtaccacggttccagcagtcggcagttgccctcccctgcggtgtccggacggctctcgaccggcgtctcgggccggccactgactccagctctggcttccataagcccctgacgaatcgcacgataggtggcttggcggaagtcgccgccttcggtatgcttcagatgcgcgcggccagccaccaaagtcatcttgatatcggtgagcggcgcgccaacgagcacaccgagatgctcacgctcggtcagatgggtcagaatcagccgttgccaattgcggtccaaatcgttttcggacagggccgaggccacagtgactccgctgcccggctcccctggttccagcaggatatgtgcttcggcataatgacggagcggctcgaaatgacctgcgccttcgattggcgcagtgatggtctcacggtacaggatggagccggggccaaacgacacatccagaccgaaccggtcgtgcagggtctgctggatgatctccagctggactgcgcccatcaattgcacatgaatctcggccagccgttccacccacaccacatgcaacaacgggtcttcgtcttccagctcacgcaatgcggtgatgaccttatgcaaggtcagatcatcgaactggggacgggccggcgagctattgtccgccgcggtctggcgagcggtgtcgttctcctcattgcggccggttcccgacttggcggcatcatgctcggcatcgtcctgattcacgctgttatggccggcgccaccgcgtttggccgctcccgaggtgccggccgtatcggattccgctccggcgggcaacaccgtgtaggtcaacacgggttgcagcgacggtgattcggcgtccggttccgctcccagcccttcgccggggaaggtccgcgtcagtccggtcaccgcacacaccgatccggcaggtatctcggtgaccgtctcgaatttggcgccattgtagacgcgcacctgatcgactttctcggaccataccgtgccatcatccccctgtaccggcgacggtgctgtcgacgccgcggcgcacgaggatgaagagacgatctccttggctttgagcgcaccgccggtgacgcgcagccacgtcatacggttgtgctggccgtcgtgggcgattttgaacacgcgtgcggcgaaggcggccggccattcacgttcgcgggtgaacgtctccagcccgtccaggaattcctcgactccttcgagtttcaatgccgagccgaaatatacggggaacagctcgcgcacggcgatcatcgatcgcaatctgtccacggacagcgcgccatgttccagatagtcgttcatcgcctcctcgtccagggtggcgatatcctcggcaagcgcgtccaacggtaccgcgctgccctcagtggactgctccattgccggcagcggatatatcgcatcgctcaggcgtttgcgcaactgtgccagaatggcctcgcggtcgaatccggcggcgtcgcacttgttgacgaagatgaacgtcggcacaccgtatctggccagcagacgccacagtgtctcggtatggccttgcacgccatccgtgccggagaccacaagaatcgcgtaatcaagcacacgcagcacccgttcggtttcggctgcgaagtccacgtgccccggcgtatccagcagggtcagtcgcaggtcgccgtgttcaaccaacgcttggtgcgcgaagatcgtgatgcctcgcgccttctccaaggaattggtgtccagaaacgcatcgccgtgatctactcgccccaatttgcggatctcaccggtacggtagagcagcgcctcggacagcgtggtcttgcccgcgtccacatgcgccacgatgcctgccactatctgtttcatcagctgtgctcccttcccgatgcgccgcgcaattgccggccgcctaaccaatatatccgagaaaaaccgggagggaataattttaccgtcagaccgggatgccggtacaataagtcaccgaacaccgactgatatgaggagcctccgtgaccacttccggcattaccgttttcggccaaccatcccagcccaatcatggtgccggcgggcgaatcgccatggacgatgccgtcttccccaccgattatgtggcgctggatttggagaccaccggcttttacccgaacagttgcgccatcacggaaatcggtgccgtgcgcgtgcgggaggggcatatcgtcgatcaattccagcagctggtgaatcccttgcggccgattccgcgtcagatcaccacgctgaccggcatcaccgatgcgatggtggccgacctcgatccgattgacgaggtgcttccccgattcatcgcatggctcgctaccccggctgccggtcccgccgtcgagccgattgtcggccataacgtcagcttcgatctgcgattcctggattacaacacccggcatatcgccggctgcggctttgcctgcgcggattatgacacgatgcagatcagccgcgccctgttccccgcgcagcggcatcaccgtctggccgacctgatcgtacgcttcggcatcgcggacaatgaggagcaccgcgcattaagcgatgccatccaaacccagcagtgcttcgaatggatgcggcattatgtcaccgagcatcacgaatccgaagcgatccgctggaagcaggcgccggccaaaaacagcgccgaaatcctccaccagcagttggtggtaaagcggtagtttacagcccgtattccttggcgatgacggaccagaggtcggcagcggcctgatcaacggtttcgttgacgatggtgacgtcgaattcgctttcggcggcgagctccaccttggcggtctccaagcgacgggcctgctgttcggcggtttcggtgccgcggccgatcaggcggcgctcgagctcttcgaagcttggcggcgcgatgaacacgtacaccacttcgaggtcgagctcggcggcgcgctgcttgacgcggcgggcaccctgcaggtcgatttccagaatcgtgggcacaccggcggccagatgttcctccacaggcttgagcaatgtaccgtagtgggccatgccgtgcaccacggcggtttccaggaactcaccggccgcttcgcgggccaggaactcgtcttcagtaaggaaccaatagttgacgccatcaacctcgcccgggcgcggagcgcgtgtggtggcggagacggacacccacacttcggggtggtcggcgcgcagcttggcttccacggtgcccttacctactgcggtggggccagtcaggacgattagacggccagcatgggtgttttcagtcatgggttcctccggagatgatgtggtgtgcagcgattatgaatccaacgtggtaacggctcaccggcgagatgaccggtaactgctacagccccgacgaacagggaagaatatgaatcgtgatgcgacgtacgcgatgagatagacacgtacgcatgccgcgacatctgattccgttctgattactggttttccgagccttcgacagtggcttccatcagcgcctgacgtacgtcaagcgcaatcgactcggtggcttggctcagtgcggcgatatccggcccatgcgaggcgataaagcgggacacggtgaccagcacgttgccgcgcgtaccgcggaacacggttttcagatccttggcctcggcaccctgccaaccgtaaccgggggaaagaatcggaccggtgaacttggaggggtccacgccggaatcctgcatccattggccgatggtggcaccgatgatcagacccaccgagcccatgccttcgatatccacgttatgcttctgcgcggtggaggcgatgccgtaggccacggtacgtcccttgtaatcgccgctctggcgcaacgcggtctgcagactcatgccttccgggttggaggtcagggaggcgatgaacacgccgcgtccgttttccagcgcttcggtaatcaggccgttcaacgaacgcgcgccatagtacggcagcagcgtgatggcgtcggccagcaacggtgcaccgggcttgaaataggcgtctgcgatggcggaaatcgtggtggacaggccgccgcgcaggcaatcgacgatggtgatgacgcccatttgtcgtgccgcgtagagcacgcgctcgagcgcttcgaaacctttggctccgtagcgctcgaacatcggcgtctggaatttgactgctgcggcgcgcccgttggcggcctgcagcatacgcatggagaagagttcggcgccttcggcgtcgacgttgtatccccagtcggtgaggagcttgcgatgcgggtcaatgcccacacacagcggcccgtatttggccattgaattgcttaatcgcagaccgaaatccgaacgttgtgcctgcaattcctcactgctgagtgtagtcatcagaactcccgtcgctccaattcgaacagctgcttcgaatgctcctgaatgctcatgatctgataatcattatgcttcacggcctcgatagcgagcagtgcggcctggaactcggtgatggtggtgaactgcggcagatcggcggcaatggcggcggcacggatggagtagccgtcggaacgggagccgcgcgagttcggcgtgttgaggatcatgtcgatcttgccttcctcaatgagctgaaccacgttcttgcccacggatccggcagcgtgatgcacctcgaccggggcttccggatcggtgtccacgcgggtgctgatcttgtccacgatgttcgactcgatgccgtaacggcgaagcacggaggcggtgccctcggtggcccagagcttgaatccaagctcctcgagacgaacggcgatcaacggcagctgacgcttgtcggtgtcgttcacggagatgaacacgttgccgtgggtcggcaggccaccgtcgtaggcggcgagctggctcttggcgaaggcgtgcgggaagtcacggtcgaagcccatgacctcaccggtggaacgcatctcaggtccgagcaggatgtcgacggtcttgcccaccggggtgcggaagcgcttgaacggcagcacggattccttgaccgcgacctgctggccggggtggatgtcgccgccgtcgcccttgggcagcagcagaccgttggcacgctgatcggcgatggtttcgccggccatgatgcgggcggcggccttggccagtgccacgccggtggccttggaggcgaacggcacggtacgggaggcgcgcgggttggcttcgatcacgtacagtgtgttggccatgaaggcgtactgcacgttgatcaggccctgcacatggcagcccttggcgatggcgtaggtgccttcacgcaggcgacgaatctggtcgtcggacagggtggacggaggcagggtgcaggcggcgtcaccggagtggacaccggcctcctcgacgtgctccataatgccgccgatgtatagttcctcgccgtcgaacagtgcgtcgacatcgatttcgatggcgtcttgcaggaacttgtcgatgagcagcggggagggcaggcgaccggagaccacggtatcggccttggcctcggtaagtgcgcggtccacgtacttgttgagctgcttgtcgtcgtagacgatttccatgccacggccgccgagcacgtagctcgggcgcacgagcaccgggtaaccgatgcggtgggcggcttccttggcctcttcgaggctcagggcggtgccgtaacgcggggcgttcatctccgccttcttgagcacttcgccgaacagctcacggttctcggccaagtcgatggattccggggtggtgccgagaatcggcacgccggcagccttcagacgcgcggccagggacagcggggtctggccgccgagctggacgatgacgcccttgaccgggcccatcttcttctcggcctcgtagatctcgagcacgtcctcgaaggtgagcggctcgaagtagaggcggtcggacatgtcgtaatcggtggacacggtctccgggttgcagttgaccatgatggtgtcatagtccttgccaagctcctgcacggcgtgcacgcacgtgtagtcgaactcgatgccctgaccgatgcggttcgggccggagccgaggatgatcacagcctcgcgttcgcgcgggcgcagctcggtttcgtcggcgtagcagctgtagtagtacggcgtggcggcgtcgaactcggcggcgcaggtgtcgacggtcttgtagaccgggcgcagaccgtaggtccagcgcagttcgcggatggtgttctcgccttcatcgcccaaaccacgcaggtgggccacctgcacgtcggacagaccggcgagcttggccttcttgagcagcttcggggtgagggtttcagcctcgcgcaccgtcatggcggtctcattgatgaggaagatctgcttcaggaaccacgggtcgatcttggtggccgcgaacacctgctccagcgtggcgccgccccagatggcgcgcatgagctgcaggtaacggtgttcggtcggggtgtggatggtctcaagcagttcggccacttcttcggcggacggcttctcgccatcccaattgaagcccatgtggcgcttgtcgatggagcgcatggccttgccgagggactcctggaagttgccggccagggccatggcctcgcccacggacttcatggaggtggtcagggtggggtcggcgcccgggaacttctcgaaagcgaagcgcggcaccttggtgaccacgtagtcgatggtcggctcgaaggaggccggcgtggactgggtgatgtcgttgcgaatctcgtcgagcgtgtagccgagggccagcttggtggcgatcttggcgatcgggaagccggtggccttggaggccagtgcggaggaacgggagacgcgcgggttcatctcgatgacgatgatgcggccggtgtccggatgaacagcgaactggatgttgcagccgccggtgtccacgcccacgccacggatgatggcgatgccgatgtcacgcagcttctggtattcgcggtcggtcagggtgaagcagggggccacggtgatggagtcaccggtgtgcacgccgaccgggtcgacgttctcgatcgggcagacgaccacgacgttgtcgttgcggtcgcgcatgagctcgagctcgaattccttccaaccctcgatgccctcttcgatcaggacttcgtcggtgggcgagtaatggatgccggcgccggcgatgcggtgcagctcctcctcgttgtgggcgatgccggagcccaggccgcccatggtgaagctcgggcgcacgaccagcgggtagccgaacttctcggcgatcttgtcgacttcctcgatgctgtgggcgatgtcggagcgggcggattcggcgccggcctcgtcaacgaccttcttgaacagttcacggtcctcgccacggtcgatggcttccagggaagcaccgatcagttcgacgttgtacttctccaggacgccggcctcgcccagcgccatggcggcgttgagtgcggtctggccgcccaaggtgggcaggagcgcgtcggggcgttccttggcgatgatctgctcgaggatcggggtggcgatcggctcgatgtaggtggcgtcagccatctccgggtcggtcatgatggtggccgggttggagttgacgaggatgacgcggatgccttcctcacgaaggacgcggcatgcctgggtgcccgagtaatcgaactccgcagcctgaccgatcacgatcgggccggagccgatgaccatcacggatttgatgtcggtgcgcttcggcatatcacttaccttccttggagttgttcttcataagttcgcagaaacggtcgaacaggtaggccgcatcgtgcgggcctgctgcggcctccgggtggtactgcacggagaatgcggggatgtccacgcactgcaggccttcgaccacgtcgtcgttcagatcgatgtgggagacgaacaccttgccgtacttgccgttttcaaacggcgcgtcgacctgcttgccgatcggggcgtcgaccgcgaagccgtggttgtgggcggtgacctcgaccttgccggtggtcagatccttgaccggctggttgatgccgcggtggccgaacttgagcttgtaggtgccgaagccgagtgcgcggccgagcagctggttgccaaagcagatgccgaagaacgggtagccggcgtcaagtacctggcgcagcagctcgatttcgggaccggcctgttccgggtcgcccgggccgttggagaagaagacgccgtccgggttcaggttctcgatttcggcgaaggtgatggtggagggcaccacgtgcacgcggcagccgcgttcggccatgcggtgcggggtcatgcccttgatgccgaggtccacagcggccacggtgtacagcggctccttgccttcgtactcgccgcacggttcgatggtgtaggtctccttggtggacacctcgtcgtacaggctcagaccctgcatctgcggggtgttcttgacgtcttcgagcagctgctcgatggtcttgagcgcgccggtggcctgatcggtcagggcgtcgccggagaagatgccggcgcgcatcacgcctgcggaacgcaggtggcgcaccagcttgcgggtgtcgatgtggctcaggccgacgatgccgttcttggcgaggtcgtcgtccaggctgccttcggcacgccagttgctcacgttcggagagggatcacgcacaatgtatccggcaacccagatgcgggaggactcagggtcttcgctgttgacgccggtatcgccgatgtgcgggaacgtctgcacaacgatctggcgatcgtagctcggatcggtgagcgtctcctggtatccggtcataccggtggcgaagacgatctcaccggtcgtctcgccgagggcaccgtatgactcccccacatatacctgtccgtcttccaaaacgaggactgcatcgtccttgtcatacatcggaattgcgatggtcccggactcgttctggctcaccaaaacccccttatgtttttcgggtattcgtaccaaggttaacggccagcgcagactcacacgccgttgggcgcaaagtctcaccccgctggcggggctgtcggcaaggtgccgacttgagaatgtacggcggcacaagtgtccgcccatgaaaaagcctcccgaatggggaggctgaacaacaaatgactaatcgaccgtcggctgaatctcagcggacggggcagcaggctcgtcggatgcaccggacgaatcgggcgaatcggaaacatcgccctcatcggtcggctcggatgcggcggcagcggaatcggacgattcctcatcggcctcttctgccacggactccggtgccggtgctgcgttcttggcggtgcacaccgcagacagcaggccatggatgaaagcgggcgaatcgtcatcgcacagggtcttggccaatgccagagcctcgtcgatggcgaccttgtccggcacatcatcggtgaacagaatctcccaagcggcgatacgcagaatgttgcgatcgaccacgcccatacggcggaccttccaacccgtggagtgttcgtccagggtcatgtcgatctgacgacggtgctcggccacgcccttgacgatttcaatggcatagtcgggaagcggggtctgggcaccgggatgtgcgatgcgctcgtcaagcagggagagaatatcctggcttttttcgtcggcttcgtacagggtgttcagagcccttttgcgcgcggtggaacgtgccatactgctgctgtcctagtcctttatacggtcggtcgtctgttgaggatgcggagatcagttgttctcgcggccggtgtaggaaccgtcctcggtgttgatcttgacgcggtcgccctcattgatgaacagcgggacctgaatctcggctccggtctcaacggtggccggcttggtgccggcgttggagcggttgccctgcaggcccggctcggtgtgggtgatggtcaggaccacggagcccggcagatcgacgctcagcggggtgccgtcgtggaaggagaccaggcagtcagtgccttcgagcaggaacttggccttgtcgcccacgagggtcttcggaaccatgatctgatcgtaggtggtcatgtccatgaacacgaagttgtcaccgtcctcgtaggagtactggagagtgcggttgtccacggtctcgaattccatcttcatgcccgcgttgaaggtcttgtcgacgatcttgccggagagcacgttcttgatggtggtgcgcacgaaggcggggcccttgcccggcttgacgtgctggaacttcatgacggtccacagctgcccgtcgaggttcaggacggatccgttcttgatgtcgttagtagtctgtgccacgttattcacctatttcaaattcaaactagcttaggcaaagcccaaaaattgcctcggctattatgccacaccgggtatacaggaagtgaacgctggggtttcccatgtgcccccggctagactggatgaatatgcgatccttcttcgaagccatatccgtgtcctgcgtcatccccgcgcaatcgccggcggacgacgaacgcacggtgttcgagaacctgtcctttgctgtggagcgcggcgagatcgtcgatctggtgggaccgtccggctccggcaagtcgagtctgttgaccgcgtgcgcccggctcaacccgcatgcgcacggcacgttcgcccttgaaggcaagggcagcggcgagttcacgccgcagcagtggcggcgggacgtctcctacctgccgcaaaaaccgatactgaccggcaaggacgtggccgaggcgatccgcctgccctggacgctcgcgattcgcggcaagggcggcaaggccgagcagctgctgcccgacgaacgcatccgcacgacgttggacgcgatgggatgcgaggacatcgacctggcgcgcgcgccacatgacctgtcgggcggtcaggcggcgcgcgtggcgttggcccgcacgctgctcaccgacccgaaggtgctgctggccgatgaggcggacgccggactcgacgacgacaacgcatccaaagtggccgcgatcatggcggacgcggccgcacacggcatggcgatcatccgcatccgacaccgtccgccggacggacgcgccacccgcacgctgatgctcgatgcgggacggctcaccgatctgacgcgggacaaggaggtgcgcccatgaacggcgcctacgacatcgacacctggggtcttgttctagcgctgggcatggtggccgtggcggccatcatcagcgaactcatgcatatgggcatcggcaagaccctgatgtggtcgtcgtgccgcgcattggtgcagctgtgcgccatgggcttcatcatcggctacgtgatccggtcgaacagcgtgtggatggtgttcgccctgatggcggtcatgctggtggcggccgtgcagatcgtgatgtcccgcgcacgcggcatccccaagggccttgccgggccgatcttcctgagcctggtcatcaccatgctgctgatgctggcgctggtcaccgagctcatcgtgcgcccgcacccgtggtacgcgccccagctggtggtgccgctgaccggcatgctgctgggcaacaccgtttccgcgcttgctgtcgggctgagccgattctatgaaagcatggaggaacgccgcgacgaggtggatatgatgctggccttgggggcgacggcatgggagtccgcccgtccatccgtcatctcgtcgattcggctgggactgttgcccaccaccgcttcgctggcctccagcggcatcgtgaccatcccgggcatgatggcgggccaggtgatagccggcggagatccactgaacgccgccaaataccagttcgtggtcttcggcgccatcgccgcgctgaccttgctggccgacggtctgatcatggccatggtctatcgcacctgcttcaccaccgacgaccaatatcagacgcctaaagcacgatagcctcagtatcgatctcaggccaagcctcaggcgatggtgaccggcgtgccttccggaatttggttgtagaaccattcggcatcggccacagtgagtcgcacgcaaccatgtgaggccggctgaccgagcttgttgccttcctcttccatatactcgccggagttcgtcccggtcggcaccgagtggaacagatacgggccgtagaattgcacccaataatcggctcccatgccttcagatgcattatagaaatgatctccgcgcgcactgatggtataggtgccgtgcggtgtgacgtcatccatgccagtgctggcgatcatcgtgtagatggtcttgccattggacttgacgtacacctcttgcttggcgaggctgacgtccacgctcaaattggaatactgcgataggttgggttgcttaccagtaggattgctccaccgtgcgcgttgtgcttctttgttccgctgttcttgaatcgcatggttgaagacaggcacctgctggcgctcaacaaatgaagttggttgcgtcacggattgcttagccgctgattgagatggcgttgcgttcccattgccgctgccggggcggggccaagcgcgcatggctcccatagtcgagaaaactgccagcacacagcacaccagcgcgcatacaaacactatgattcgtcgtatggtatagattcgtttgcgacgtttatctaccgctacagggcgcttttgagccatagattccttctcatcagaaaggtattgcctgattgattttaatcagacattgcgacgcggcatttcccgagataaagcaatcgtgatacaaacgagaatcgtctctactcagcttgcctcggggcggcttcgggcaatgaagtgcccatggtttcgagacgcatgaggaactcgttggcgttcatggcgttactcaacagcgtgccctccgcaaacgtgcctccgatggaacggatgaactcaacctgatccaaagtctccacgccatcgaacaccacatggaacgcatcattatcgcgcgaaatctcgagcgtgcgctgcatgatctgtttcgcgcgaggcgtacggaaatcgcgaaccaccgtcttgtcgaatcgtgcgaaatccaacggaagatgcgcgaacgcagcaacctccgaatacgtggtgccagcattggtcaaacccaactcgacgttcggcaaagcggcaagatcggcaacctcatcatcgacttcatcatgcgccacatgaatggcatgcgaacccaactgcaaaccgaaacgcagctgtggctgctcatgagtcaactgctccaaacgctcgtggaagatggacgcacctaattccggaccgttcaggcaaatgtccacaatatccaattcgggtgccaccttgcggaacgcggtcatgtcttttacgcaggtttccagcacgtcgagtgtcagctgcacgctcatgttgagacgatgcgcttcggccgttacgaaatacggtgccagcgtacggcccttctcgtcatgcacgcgcacaatcgtatccagcgaagtgatgtgcttcgtattcacatcgaaaatcggctggtagagcacggaaatcgtattgtcttcgatcgcatggcgaagcacatcggacgcgttgacgtaatcgtttgaatcattttgcgcggcaagcatggccgtcgtgccgtcgaccgccggcagattggaactttccgattcgtaaatatgcacgctcgcatcggcaagcagcacggcgaaaccgtccgtcgcattcgagaacgaaatactgctcgacacctccacggaaacctcgccctcttcggtgtataccggcatgacggcaagattgcgcatgcgtgtggccaactcctccacatcactggttgacgtcacatcggtcacgatcatggcgaattccgcgccgttcacacgcgaaagcgtggcgttttccggcagcagctggcctaaacgcatgcctacggatctcagcacggcattgccgattttgcgtccataatgttcgttgacggcgcgcaaatgctccactccgaaatgcaccacagcaaccagattatgcacattctcggtctgcaaactcttcaaatgcccgatgaacgcacgatacgtgagtgctccggtcagcgtatccgtttccgcttcggtgcgcagcagtgtcacttccttgttcacgcgcaacgattcggcaagcactccgccgcaagtgagcaatatcgtttcgtcggtcgacatgaacggacgattcaaaatgctgcgttccatcgcaagataatactgtcgcgagccggtggaaataggcgcggaatagcggtaggaatatcctcttttatcaagattgtttgcatcgctgacgaaacagcgcatgtgggcaaggccacgattgatgcgcctcaccacggtctcctccggcacttgattcggcaacggcagtgcgtcgctcacattcgcaatgcatttcagcgcgcttcgggatcgcgcgagccggctcatcgtatcggccgtcatcagcaacagcgagtaggcgatcagtgccagcatgaacacggaaagcacggtggcggtatccgaaccaatattggcgaactgcagaatttcaggaatccacacaatcgctatcaaatcagccaaagccatggcaagaatgcgagacagcgaatactcgtgcatggcttcacgaatcggaatttgcgtaaaaaagaacgttacaatatcgcaaatcaatcgaataatcggcactgcaacagtcataatcagcaatggcagcaaccaattctcaaattgataaggattaaatgcagcattgacagaatgctggttgatagtaatcgacagtacgtgagaagtattcgcaaataatattttgattaaagggattggcgcaagcgtggttccggcgtgaagaatgccgattttcagactgcgtgcggtgataatcgacgtgatgatggtgacgatgatcaggaacatggtcacgtcgggaaaatagccggttaccagcagtatgacggtcaacggtggcagcacggtgtgttcggcggcaacgcgatacgacgaacgctttttgtggtagatcaggcacagcagaaggcaggccgaccatatgcagatgtgtgcggggtcttccatgaaccgctgtacacccgcttgcgcatgcacggcgatcgcggccgcaatgcacaacgcatagatgatggccagaatggtgagtctgaccggctttctgatgccgtcttttgactgactgccggtggttgtctgatgtttcgattgcttcgatgccatgattgttttttcgttcccttgttgcgcgtcacttttgatggaaagtagcgactgccttgtgttaccgccttgtattgtgtctgtggttgcgcctcgctgcagcaagcgtttatagcaccggtccgatgatgcgccacggtgcgttggcgccttcctcggcgctgtctggctgcttgttttcgttgttgcccagcgattcgtagatattgccgttccagatcaccttggcgccttgcttgtacagtacgtctggcttccatgtggggtaggcctgctgcgaggaattccagcttgcgttgtcgaaatcgacgagcgtgcccggtgtgcctcggaatcctgatcctagggtggtggcgaattcgccgcccgtctgtttcatgccgctgcagaacgttttgagcgtgtttgtgttcgtatagttttcgccgcattgctggtcgcggttcaacgaccacatgcttaagtgacccaggcttgtttccagtgcgaacgtgttgatatcgcgcgcattgtcgagcgtgaaatactcgtttttggtgtcgttctggccgatgagcacggtggctcccagcagttcccagatctgatggtcgctgaagagtttgccgcgactgtacagcaaggttttgtattgcgcatgggccgcgttcaacgagcttttgatcagggtggattgtgtgatcgacgtggatgccacgttgaaatccatggtcatgagattcacggtggagagcgtcacgccggcgtccagaaacgcattcacggtttgcattccttgtattgtaagacctttcatgtcggctggaagcgtcaggctgatgatcagatcgtggctggtatcgtcttttcctttgtttttcgttttttcattggcgatgagttttgccacggcctgcgctcgtcgggttgtggtttcgctgtagccgtcgagattcgtgttttcgatatcgaagtcgagcgaggtgacatgatagcggtcgatcacctgctggtatgcgtcggcaagcgcgtcgacgtcagtgcatgcggcggccagttcggtaccgttctgcccgccgaagctgacggttatcgtgcggtcggttttgtaggtttgcgcgatgcggctgtcaagatcaagtgtggaggccgcttcgtcaagcgtgtaatagccgccccagcttggctggcagccgtcgccggcggtgatgaaaccgagggacatattctgatagacgttgcccaccttggattcaaacttgtatgagggtgttgcggtcacgtccacatagccgccgaaccagggttccggcaattccttagccgccgttcgcgtgaaggtgatccacgaccatgtgccggccgcaacgagcgcgatgcacagtatcgctatgaacaatcggaggaaggaaaatcgccttcccggaaacacgggtttcatcattccctttcaaaaatcgttcagtcgtcatgccgatggggttatcgggtggccgagcaggctgtgccccccccgcttggcttcagtgcgcaggcgggggattttacggggggttgggtgtgcctctcgtgcgctggctttcttatatctcgcttacatcaagggagcatagtatgtggctggtacgacgatttaggcaatgacgtatgtttttgcgccggtgaggcgttgttgacgatgcaaagggggtttgaggtggcaaaacaggggggaggtaataaaggcggcgatcgcaaacatcaatggggagcggaaacctccacgcaaccacttgcgattatgcatgacaagccttcgccgacgcgagttgtgctcggctatgttgcgattgcatgcacggttatttcatggcttatctacatgatcacgatgattctgtcattgttcgtcaacaatccctcactcacattgcgtttcgtggttgaaagcgtgctgtacatgacgattgtgaccacgctgattttcagtgcgctcgtctacttggccacacggcaaggagcgctataccgcttcatccggcatgaacgcgtacctcgagccatgctcgacaaccatttcgcacacaactacggcaaaggcattaccgtactcatcccatcgtatgcggaaacagccaaaagtcgtcgaaaaaacaatctggtcggcggcattgcaggaatttcccgaccttgccatcgtactgctgattgacgatcctccgcatccgaaaaatgatgaggcacgggcgattttaaaagcgagtcgcgaactcatgccgaaggtacttgccgaacttgcggcgccggccgaacgcttcacgaaagcgcgcgacgaaaccgctgcggcgctcgtcgatcagatggctgcgaggcgtagtgtggtcgcacgctgtgcggaagactatcgtgcggccgtgcaatggctggaacataaggccgatacttggctgatcgaagatcataccgacgatttcttctgcgatcaggtattgcgcggtcttgcacgcgacttgcgtttgacggaacaggcgttgaacgaatcaatcactttgcagcagcatgtcgacgcgaatcgcattctgcaactgtacgaacgtttggtgcgtatcttcaccgcaaaaggatggtctttcgaacgcaaactgtacgcatcgacttctcgcgaaggcaacaaggccatgaatctgaattcgttcatcgggttgatgggccactcgttgaagcgtgtggaaacgtcggatggcgtgattttgcgtgacgtgcgcaaggacgaatctccggatttcgtgatgcgcgattccgaatatgtgctgacattggatgccgattccatgctgctgcgcgattactgcctgcgtttggtgtaccagatggaacagccgggcaacgagcgtgtggccgtgatccaaaccccgtattcctcgtatcgtggtgcgccgacgcgaatcgaacgcatagcggccgccaccaccgacattcagcacatgctgcatcagggcatgacgtactatgacgccacgttctgggtgggtgcgaacgcggtgattcgcaaggccgcgcttgacgacatttgcgtggtctcaactgagggcacgcgcacggtgaaaacgtatattcaggatcgcacggtgattgaagacaccgaatccagcattgatttgggctatttcggctggcatttggttaattatccggagcggttgagttatagtgccacgcctccggatttcggctcgctggtggtgcagcggcgacgttgggcgaacggtggtctgctgatcatcggcaaattcttccgcattgtgcatgcccggcatcagcagggcaatgatgtgaagctgggcgagtgggcgttgcgcgtgaactacatggcgtccatcgcatggtcgagtttcggcttgatgttcctgttggcgtatccgttcgatcagcggttgctgagcccgtgggtggtgctcgcttcgttgccgtattttgccaccatgtcgagtgatttgaaacgtaacgggtataagcgttctgatattttccgtatttacggtttcaatatcgtgctgttgacggtgaatctttccggtacgctcaagtcgattcagcagggcatgacgaacacgaagattccgttcgcgcgtacgccgaaggtcaataatcgtactgcgtctccggcattgtatgtgacgatgccgtgggtgatcattatttattcgtgcatggtgttctatgccgatacgttttcgcataattggggtaacgcggtgttcgctggattcaatgcgatcgtgacgttctgggcgttgaccgcatatatcggcatctggcattccgtgcaagacatggtggttggtctgatccgttggtttttcgtaccgatcaaggagccgcagcaggaggcggtccgcaagaagtcctcctggcgtgatgccctctatttcggcgaccgccaaatgatctacgagtcccgcccgttatagcgtgctccccgcggctgtctgcacaatccgtgatttgcggtctttttttcgggttgtgcagacgggtttggatatcacggcgtctgccacgccgattatcgtgcgaacgttctgcgcatccactcaacagccggttgcttcgaaaagcagataattgcggatcatttcgtcgatatatccgctgacggtggttggagagatgcgccggccgcttgcggcggaattcgcattcgtgcatgtctgcttacatgtccgatacatttttcccagcgaattgacaggaacacgcatcattcctccatgacttgggcggttatatggaacatgtcagcggttacggcggctggcgaggttcctgatgaaccccataactgaacccttcttctctcttctctctcagccggtggcctttctctccgccggcttttctcttttctgaacaggattcatgcgattgcgattggtgtttttcgaggcttctgctgttttcgtgggttagctgactggttccggtagtcggatgtcgagtccgcggcatcgtccttcagggcacgcagcagggacttgttgcgggcttcgatgatgcgcttgccgtcctcgccctgccaggagaagaagccctgaccggtcttggcaccaaggttgccttccttgaccttctcggcgagcagcgggctcgggccagtgccgttgtccatgtcgtcgaacaggtaggtgctgatgttgtagaacacgtcgagtccgccgaggtcgatgctggcgatcgggccgaccaggttccagcggcggccgaggctgtacttcatcacgtcatccacggtggccgcgtccgcgatgccctgctggacgatgtggaacgcctcgcgcagcacggccagttgcagacgattgcccacaaagcccagcgattccttcttgatcttcgccggcttcttgccgatcttggccatgaggtcgaaggtgatgtccactaccttcgggtcggtcttctcacccggcaccacttcgaccagcggcatcaactgcgcggggttccagaagtgcgccaccacgaagcgctcggggtgccccatcaccgactgcagcgcggtggggctcaggccggaggtgttcgtggacagaatcgcgtccttgggggcggcgtgctccacttcggtccagacggacttcttgatgtcaaggttctcggccacggattcgatgacgaagtccacgtccgccacgccgcttgcatagtcggcgtaaccggtgatgcgggccagcaccgcgtccacggtgtcgccgtccttgagcagtccggcttcggcgaagtcctcggcatccgaacgaatcgccttcatcgccttctccagcgaggcctcgccgcggccgaccagatgcaccggatatccggccaacgcgaactgcaacgtgatcgcgtggcccatggttcccgtgccgacgttcgcaatcgtcttgatatcgtccactgtctcaatcacggagaccccttctttccggcggttcgtctggcgttggtgtacgcatgaacagcaccgtgccgttatgcgtttgttcgcattctatgccgatttcgctacgtgaacatttgctgaacatttcgcggattcgactagtacaaatccccatatcagcacaaaaacgtggtgccgcaacaccgaagtgttacagcaccacgctgaaatgttcatgtcgttacgctgccgtcgcgcacccacagcggaatcgataggaaacctcaccggagtaggtgaacacgggggcgaccagcatggacggaccgaacatatactgacggtccagcgtgcggcatgccgggtcatcggggaattccacgaacatggaacgcatgaccggagtaccgttcgcatgaggctgcaggccaagctggtagacatacggcatgagttcaagcttgagcttggtgaactcgcgcaccacatccacggcggtctggccgggcaccaatgcgacgccgttcttctcgtcttcctcgtcgaacagccacggcacacggtacacggtggaaccgtgcagtcgcgagtgggagccgagcatgccgaacgccacccaacgcttgtagacggccgggtccgggaacgcgccctcgaaaccgccgatgtcgtgactccagaagccgaagccggaggaggtcagcgacaggccggcacgcagggactgggccatgccattgaaggtggattcgcagtcaccgccccagtgcacgggctgctgctggccgccgaccgtcgcggagcgcgcatacaggcaggcgttgcccttgccgtaggtttcttcgatggcttcgaacacggcctggttgtacagctgggtgtaccagttgtgcatggagagcttcggagagccgtcataccagacgacgtcgcgcgggatgcgctcgccgaaatcggtcttgatggcgtccacgccctgattcagcagggccttgaccttgtccttgaaccattcacgggcggccgggttggtgaagtccaccaagcccatgccggcctgccagaagtcggtctgccagacttcgccattgggcttgcgcaccagatagcccttgtcttcgtgcaggcgcttcagcgtggattcgatgtcgccgaagaaacgcttgtcccactcgaaatcgcaccaatggaactcgcacatccagtagcagtcgtagtggaaggcggccagcggaatatcacgctcggccataccgtcgatgaaggagttgatggtggcctcggtgttctcggaaccgatctcaaaggagacatggccgcggttgttgaccagtacgccatacccattggaggtcatgtagaacgggatgtccttgtagccctgctcggaagcagtgccgccatcctcattccagatgtcgacgctctgaccattcttcacgtaagcgccgaagcgttcgcccaagccgtatacgtcttcgccaaccgacagatgcagctggatggcaatgaacacgtcggattcatcacgggcggaaccgtccatggtcacaccgaattcgctgaccggctgggcggtgacgttcgattcggcaccgagcttgaatcggcccagcgacttgcctgcggactcagtgagcaccttgccgtcctcgccgatgaaggtcaggttccagggggcgcccttgacgaccttcacggtaagtccgccagtggtcagcgtgacatccgcgccattgacgccaacttcgccgtcgccattgccgttcgcctgaacggtcacgtaatcacggttgccgggttcgtcggcattgagcgggaatccggggtattcggtggcgccttgccagtgttcggcacacacacgaatcacgccttccgcaggtgtggtgatgtccacattgaatgtgggcaggttcagggtatcgtatcggccgcgcaccacggaggtcggggcgaggacgttgaggctttcggtggtggcatccgccgccagttcgtaggcttcacgagcgtagagggcgtcgacgccgtcacgaatcatccagtagccgttggtgaacttcattgttgctgctccttggtggagaggtggtttcgaccgccagggaacaaggcagccgaaaccaaaatcaatatgtgctgcttgttgattgaattgcctgttgtgcgaatgaccttacttcaccgcgccggtggtgatgccgtaccagtcgccggagcccatcatgccttgctcatcgtacttgccggtgtcggccaaggaaccggtgataatcttgtcccagccatattcggacacgtaatcgttgaggttggtgagcaggccttggctggcgagcaggccggacgtggcgttgcccttgttgtattccgtaacgtccggagcgtcgtcggagttgaggacctgggaggcgttctggcgaatctgttcgaaggccttcttctcgaattcgaccttgacgccggtctcacacattttcatgctttatgcaaaaaatgtgaggcatacgcacatttcccatcaaacgcacaggtgcaagaatggcagcaattcgccatttttgaaatcaccatgtgcgtttgacggcgcgtaagcctcacattgttctcagcaggaccgaatttctgcgagccccccctatagcgctcccctacgcaatatgtccgcaaacgaccacaccacatgggcgatacgcgccaattcggcgtaacggccgatggacagccactgcacacggtaccgttcgaaccacaactccaaatcggcggcaagacgggcgcggcgcgaggcatccagcgcacggccggtcacatccttggtgtcacaggcgtcctcgccgccagccaataccagcagttcctcacccagtctattgaacaaccgctgcccatccagcatcacccacagcagctccgggttcaatcctcctcgtgccgagccatcgagcaccgcgacaaccgcactgccgcaatcaatcaacgcccggtcgcaatcccggcgtcgttcgagacgggcatggttccgcaggagcaatcggcggcgcgcgtcggcgcatcccagcgcacggtcaaacatgagctctcccccgcacgaccgttccacatacgatgccacatccgtattcagcatgccggtgccggaaccgtattccagttccagcacttgcacggcgaggtcccaggggaacgacactccatcggagtcgatgcgagcgagtgaatccataagccaaccggattcgtcgccatacgccagattagaaatccgatggttcatttcgcatgcgtcaattgcaaccgggttccacgcgttttgcgcaccgtagcacagtcccggcacgctcaaccgcggatcattgacatgcccatagtcaccccaatcggtgaccaccatgccttccgcaccatatttgagcccagccaccgccatgcggtacgtgttcagccaggcaccgtcatagtcggggaagaaccggctccacgcacgcacggcagggcacacgaattggcggcggccttgtgatgcgatggtctggatcttgctttcgtcgatatccggctcatacatccagttgagcatcgtgatgtcgccgggcagcaagtccatggtgtgcggattctcgagcgcgatatccgcccacagcatcggttgtagaccacgatgggcaagcgtgctgcataggtctttgacgaaatcggcatacagctcatcgcgactggcgcccggcgagtcctgtacggaccggccacggcccaagtcgaaagtctcatcgccaccaatattgaaggaccgcgagcggaacagcggcgcgtattcctcgattaggcgcgaggcgaaatcgtgcgacttggggttggctgcgttcagtgtgtggtgttccattcgttcgatgaaactgaacggacggtcggcgtcttcggggaactctcccagtccacgatgttcacgggtgcgcaggttcatatacatgtgcccgaaagtggccaaggacggcaccagttcgatgccgtggtgtgcgcagtattcgtccaggaacatgatgtcgtcggccgtgagcgggtcagtgccgcgccacgcttcgctgagctcgccgaaagcgaaggcatgttccacgtacagctggaattggttgtacttatacaacgccagctggtcgatgaaccaggtgaggaacgccatcgtcggcacacgcccgcgcgtcacgtcaagactgtaggcgcgcaccgcgaacgcaggcttgtcttggatatgcaggcagggcaaggtccgcgaggtttgcctgatcatctgccgcagtgtctgcatgccgtaccgcaatccgctttcgctgccaccacgcacggcgatggtatctgaggcgaacacatccagcgtgtattcgtcatgcgccaatcgcgcatccacacacaacaatatgacggtgccgttcatcgctgccggcgcacccgcgcccgcacccgcacccacgcccgcatctcgcgctttttcggcggcattggcaccggcgtcggcttcatctgtggctgtgagtactcggcgcgtacggacggcgacgccgcagtaacgctcgagttcgctggacagctgctcgattggcagcgtttcccaggtctcatcggcatcttcggtgacggcatattcgggaattcgtttctcgatcgtcaccaaggacccgatcatagccgtgccatgcgtgtattccaatgtcaccggagcgggaatcagggtgagacacggcgttgcggcatcagccttatattcgaatgtgggcacagctgttcctttcatactgtttttattatcgttcatccgctgacggcaggcgacacgcggtcacgccgccatcagcggacgaatcgtttggtgaggtacggcggcatacgctatttcacggcaccggtcgtcacacccttcatgatgttgcgctggatgagcatgaagaacaccaccaccggcaacgagaaggtcaccgaagcggccatctgcccgccgaaatcggtgcccatggtgggtgtcgagaaggacgacagccataccggcagcgtgtacttcgactggtccttcatgaacgtataggcgatcatgtagtcgttccaggcgttgatgaacgcgaacaccgaggtcgagacgatgccgggcgcggccagcgggaaggtgatcttccacaggatctgccagtcgttcgcgccttccacggccgcggattcgaagatgtccttcgggatgttcaggaagaacccgcgcatgttccagatcgcgaacggcagcaccatggcgatgtacgccaggatcaggccgctgtatttgttgagcaggccgagctggttgtagatgatgatctgcgggatgatgccgccagaggtcatctggatggccagcacgaacaccatgatcggcttgcgcccgcggaagcggtacagggtcagggccgtgcacgcgaagaacgcgacaataatcgacaggacgatcgagagatgcatgggccagaacacgggggtcgtggtcatgatctcatcgcgcggctttacggcggtgataatcatccagtagaccgggaagaaccatacgacgcagaacagcagggcgaggatagtggtgccggcgcggcgcgcgatcttgccggggttggttcggcggcggggcggtgcagactgcgctgcgccatgcgatacggcccgtggattctcaacacatttcataaggacgacccgctatttcagggattcgccaatatcagcgtgccagtcgccatttccggcgtcggctatggcagcgccaccccttccccaccgtcgacatcgacaaccgactcgcttcacgcaagctcaccgagcatatgttggggcgcgggtatcgacgaatcgcctatatcatcggaccgtcgtacttgccgacgtcgacgccgacgccagcgtgcccgcagctgaccaccgtgcgccagccaatggacgcattcggcgtcagcttggctaccctagtgcttgaccagatcgaggaccggccgttccagcgcacggggctcctgcccaccgaggtcgtagccagataggcgcgcagagaacggttctcaataatgtctgtgcacacttctctacgcccgaagcacacatggaatatgccctaatcactgccatgtcgccatttgcgatgatgtgagattgttatgttcttgttcatttgagcgcacagatactactgagaaccgttctctgcgcaaatagacaatgtggataactccataagctggaaccacattgccctgcctggcttgcattcaagtccaaatcagctttacggtcgcaccatgagctcttttatgcatgaggatattgtcggccgacgccgagcagaacgtgaacgctgcaatgatgctgcgcgccgttcgaaaggtccattgctggtgggatacatcaatgcggccaactactacggcgcgcccatcccccgacattgcacgctatctgttgatgccgtgcacgcctgtgtttccagtgccaacaaacgcagacgaatcaaaggcgtggtcttccatgtgtttaagggaaaactggatatccgcaaaaaggattatgaacagttctggattgcctcgccggtcatgatgtgggctcagatggcccaatactctacattggaggaacttgcggccattggagcctctttgatgagccgcgataaacggcgcagaatggccactcgcaaggatttcgatacttacttggaaatcagtccgcggttcataggtcgtaacaaatgccacgaggcactgccctacatgacagagaacacggattctccgccggaaaacacgctgtttgggatgctgaaggattcaggcttgggatgccccaccgccaactatcgcgtgaatatcggcaactcatacgtcatattggatatggcatatccggactgccgcgtcgcgttcgaatatcagggagcctatcacgccgatccggcacaaatgcgaatcgacgcggcaaagcgaaacgcattgcaactgctcggctggatcgtcattctcgtcactgcggatgacctgagaacagccgacacgcggcatcgttttatcgagatggcccatgtcgtggtgtcccggcaacgcaatctcgccgattggaaccgctcatgggccattacctcttagcatcgcaccgacaatgcgctatgccgttatttactgcgaggcacccgccagatatcgggctcaacgtagatctcccattcataccaaggcagcgcggcacggcgtcctcgtccatgtgaatggcctgcaggttaatgagcctatccacgccgacagtgcgctccattgcctcgaccaccaggtcgcgggtgctgtggtcaagcgattcgcccaccagcagcgaaccggacttaaacgccaacgccgcctacaaaagtgtgaggctgcgcaggctcacactgccaacagccgttcagccaaccctcggaaggtctggccaatgccatccgtacgcaaagcgccgtcggcgtccagcaccgccggccggccggcctcgccggtctcgcgcacttcgggttccagcggcagctgggccatcagcggcacgtcatagcccagcgcctgagtgagctgttcagacacgcgctgaccgccgccggcaccgaaaatctccagcttctcgcccttgtgctcgtagtagctcatgttctccaccacgccacgcaccttcatcggcacctgcagggccacgagtccggagcgcacggcgatgtcagaagcggagggctgcggggtggtgaccaccacgagttcggcgttgggcagcgcctgggccacggaaatcgccatgtcgccggtgccgggagccaagtcgagcaagaggacgtccggctcgccccaccatacgtcagacaggaactgttccaaggagcgctgcagtcgcggcccacgccacagaatcgcccggtcagcaccggcgaacatgccgatggagatcagtttcacgccccacgcggtgaccggcatgagcatgccattcagattggtgggctgtgtatgcacgccgaacaggcgcggcagtgagaagccataaatgtccgcgtcgatggcggccgtgtcgaagccgagggccgcaaacgtggcggccaggttcgcggtaaccgaggacttgccgacgccgcccttaccggaggcgatggcgaagatgcgggtcttgacacccggtttgctgaaggggttctgcttgcgttcggccttgaggtcggcgaccagatcggccagcttgtcacggctcatcgaaccgacttcgatatgaggcagcagctgtgcgcccggataggagctgaccgcgccattgatctggctggtgatggtctcgctcagtgggcatccgggaaccgtcagctcaacgtgcacggtgacgtcgtaagtgccggcgtccgacgatgcgggcgcggcttcgatggcggcaatcatgccgaggtcggtgaccgaacgaccgagctcggggtcgatgaccttgctcaggcgttcgtagatgtcggcttcgatctgacgtgcgtcgctcataaatccgtatcctcctttagggcctgttctaccctagcgtgtgatgcggcggcatgccagagggagtggagtaagtcacactggggcgggattcgctttttctctcccccagtcagcctaaaggctgacagccccctcatcagaggggggttaatgaagcgtctgagggggctattttagatggtgccggtggctaggagctgggcgaattgggtttcgctcagcatggggatgccgagttcctcggccttggcggccttggagccggcgtttgcgccaatcaccacgtaatcggtcttcttgctcaccgaaccggccgccttgccgccgcgctcgataatcgcctctttggcggaatcacgcgaatagccctccaatgaaccggtgaccaccacggttttgccggccagcgtctgcggcaacgaactggtctcggcctcgtcgacgcccacgccggcggcctgccaagcacgcaaagtcgcgccgcgccagtcgccgggttcgcgggtggcggcgaaccagttcaccaccgattcggcgatttccgggcccaccccgtcgatggccgtcagatcttcaatcgtggcgttttcgatggctgccagcgagcccatcgccgaggcaatcaggcgtgcggtaggcggaccgagccggcgaatcgacaacgcgaccagcacacgccacaggtcggcgtgacgggccttgtccatttcgtcgaacatcttgcgcgtgttttcgccgggccgaatgatcaccggtacatccgtgacgccagtgcgcgtggtcttgtgatccacgcgcacgataaccgcgtcggccggcacgtcatactcaggataggaggctgcggcaaagcccggcatagtaccaagtggcgcctcagccccggtaggtgcgccggtcgtctcgctggcggtacctccctgtgtttcggcagattcgattgcggcctccccttgcgcgcgttcggccagctgcttggccgtgagctttttggccggcgtgggcgcggtccagaaagcaggcacctgatgccacaggccagagccgccgacacgcttacgcacctttttcttcttaccgttcgcaccgaccgtctcatgcacctcgacgattgcggcctcacgccacacgcgcacgtcgcgcagatcggcggcggtcaggttgaacaacccggattcgttggacaacaccggcttctgcgcgaccggcaattccagcccttccaccggctcgtacgggtcaggctcttcgccgggggcgaccagaacctcggtgatgttcggcgcgtaggtcgccaccgaatcaggccggttctcctccgggttggtcagagcgatggccgattgttcgcccaagtgctcgatgtcgaacgccttgcgtgaggccagcgaaatcacgcgctcggtcaactgggccgggcagctctccacattcgggcagcgaatgtccttgtccccctccttggcgggtgacagtttcgcgccgcatgaagggcagaactcgggcatgacgaattcgcgcagctggtcctcacgccctttgcgccgttcaagcaccgggccgaccagttcgggaatcacatcgccggccttgcgcaccaccacggtgtcgccgatcagaatgcccttgcgtttgacttcaaatccattgtgcagcgtggtacgagccacggtggagccggccacgtagacaggtttgagcacggcgaccggcgtcacgcggccagtacgccccacctgcacggtgatgttgagcagttcggtgttgacctcttcgggcgggtatttgtaggcgatggcccagcgcggcgcgcgcgaagtggcgccgagggtacgctgcaggcccaggtcatcgaccttgacgacgatgccgtcaagtgcatgctcgatgtcgccacgatgctcgccgtagtactcgatcatgtccaggatctcctggaatgaggtcaccgcacgattgtgcggggagaccggcacgccccacttggtgtatagatcgtaggcctgcgactggtcggcgaccacatcatgggtgccgcgcggatggtccggcccccaagtgagctgccccagaccatgcgcatagaagctcaggcgacgggtggcggtgatgcgagggtctttttgacgcagcgagccggcggcggcgttgcgtgggttggcgaagggcgctcgtccggcgtcctcctgctcgttgttcagggtgtggaaatcatcccaacgcatgaacacttcgcctcggatttccacgaagtccggaacgtcttccttggggccgccgaggtttgcgggaatggagccgatggttcgcacattcagggtgatgtcttcgcctgtaacgccgtcgccgcgcgtcagtccctgttcaagcacgccgttgcgatagatgaggttcagggcgaggccgtcgattttgacctcgcaactcatgggcaggggcttggattcaggccaatcgaggtcgcgaatcaccgagtcgtaccaatccttgagttcttcgatggagaagacgtcgtcaaggctcatcatgcggctggggtggcgcacggaggcgaagtcgttggagaaggagccgccgacgcgatgggtgggcgactgcggattgtccagtgaggggaacgccgcttcgagtcgttcgaggcaacgcatgcgcgcgtcgtaggcggcgtcggagctgacgggtgagtcgtcgatgtagtaggcgatctgatcggattccacccatgcggccacgcgagcccacaggcgggcggcggcctcagcggtcatcgtgttcacgtcgaaacggtcgaggcgtatcgcgtcgtcgtcagtgggctgcagtgcggctatccattgttcggagccaggggcaaaacgtgcaataccggtatcaggccggacctcggccacatccccatcgtcgaaatcccatgccagttgttcgttcgtgctcatggttgtctatcctagcgggctcggctcccctcggccggctataccgtcaactcccctcaggcggctacgcggatagcgagcgcaggaactgggcttggatgatgtcgatgttatcgccttcgccgtcattcatgcgggccacagccaccgagagcgtgcgggccggcacgaacatgtcctcatccacgcacacgcgagcggcgtcacgcacgatgtcagccacttcgatatgcggccagaccggcagatcatgcgtggcaagcacatgggcggcggcctccaccgattcaggcaccggtatgcactgcgagtccgcacgggaaaccagttcctgcagttcgctttccagcgaaccaatggccccgggagcgatgtgatcgctcataatgtaggctgcggcggctgtgtcgaaccggtcaagcatccattcggcgtacgcgaaccggtaataggcgaacgcggcatcgtcgcggtccaaggccacgcgcagagcattcaggcaggcggcgcgtgccgaatcccaatcctcattgcgggccagttgaatggcgagcttcagatgtgagagcgggtaggcgggcgcgtacgccaccatacggttgagatgcgggatggccgcctcggcacccttgatctgactcaacacgtcagccagctccatgtgcgcgtagaacagattgtccgggataagcaccgtacgctcgtccaatgtggcgaacagccggttgtagaccacgcgctcggcataggagttgaagtatcgaggtacgccatggcctgccgcatacacctggtccaaatgggccacggccgcttcggccgcttcgatggcctgatcggcttggcccgagaacagcatatctcgggcgcgcagacgctccttgtcaagatcgtcggcaagcgtgaacgtgaagtccggcgtgtccttgccatcgatcaacgcactggtgacctgagaggccaaaccggtcagttcgggatcgcatatcgattcgatgacctgcatggctcgctgggccttttccacggagccgagcgacgtgttcctggcgatatcgtggaattcgttgacgccatgctgcagcaggtccactcgctggatagccagtccggcactattctgtgcgcccagcacgtgagcggtcgccggactgaattgacggtcggccagttcgggctcctcctgggatccggtgggagagaaccggctgtccgccaagtcgaagtcggcgctgatgggtttcagaccaccttcgccgtccacgtccatcacggcaccgaacatgcggtaggtttcctcgggattgtcaagcccagcggtgtccagtcgcttgaggaaggcatcacgggtgaaggtgacggtgaccatattgcgcacggtgggattgcggcgcagcacactcatcggatcatcgtccatgccggcggccccatcagcaccgtcagtgccgacgccctcgccgccgataccgcccaggtcgtcgcctgcgccagtatcgtccggcatgccgaacgccatttcgtcgatatcgatgcccttcatcaggtcttcgaactgcgaatcgatggacgcagcgccatcggcgtcagcagattcggccgcggcctgatccgtagcatccgcagacggtccggtaccgttgcctgctcccccggccgtgccgcgttcgtcaccggacgccgtctgcccgaacgtctcctcatgggtgatggggcgggtcgggtcgccatggaaatcaccatctttggggtcggctttggaacccacacgccccaaatcgccactgcgtagatgttcgaaggcgcttagggcctcgctcatcatcgcctcgatggcggaatcctgttcggcaatcgcctcttcaagaccaatggaatcgatgtgcaacgacacctggcgcacggattcgctggtgccgaaactcagcgctgccatcatcaggccgacacgcaggttgtaggcggcgctcatcgacgcgcgttcggcgctgctcagcgcacgccacgtacggcgagtggtgtcataccggctatcgggcatcatcgaggtgccggcagtggtgaagccaatggccacttcacccgaatccaagcgcgaccggaactccacatcaaaccgatacggcaaccgtaaccggcgcaacagtgaggagagggtctgacgatacacccattcgtcgctcctcgccggcgaacacgaaggccgagcggcttgagtgttggtgtcgctcttattggtccgctctacagcgccctcaacactctcagtactttcagcgcccgcagcattcgtcacacccgaatccggcacgttctgctgggtcagcacatctcgaggatcagggaattcactgcgaatctgcccagccgtgcgtgcggcgatatcgaccaggctcagcacggcccgacgctcctgctcgccatcatacgggtcaagcgccataatcgcagggttctcaatgagtttcatgtcgatttgcgcggcctcggcacgggtcaccgtatcttccgtagggttgcgccccaaggaagcgttgcgctccagccaagcgctcaccgcagcgaatcggttgaggttgccttcgatcttcaaggatttcagcgcctgcccgaatgccaaggacttatcccacgtaaagaaatagccgctcgaatacgtcgaggtgtacaggtgcaacggttcggcgccatgcaccgcttccagtcccggcgtggtgtcgagggcgccggcttcgcgcatcagattggcgaagtgatcctccagaccggaggcccgcatgccgtgggctcgtgccgccaaagtgtcacgcaccgaacggcgaatcgcaccgattggcgcctcacggttgagacggcggaagatattgccggaaccgaatccgatgagcagaccattgatctgcggcaacatatacgtggcgaagaacgcgatggtaatggcatcgcggtattccaaatcatgacgcatcacaggcggcagattggcacgcatctgctcaagcgtgtaccggttgccggccttgagccatgaggcgagccacgtcatgcgtccggtgtcgtcacgccccaccacgccaccggtaatggccttcacgccgtcagcaccatgaccaaggccacgccccaaaccacgcccatgatgcagcgcacttcccaggccatggcctgtacgggagaaaccggaacgtgaacgcggctcgtcgctttcgcccagccgctcaccgtccggcagagtcacttccttttccttgccgaacatgaatcgcgcctgcatatcctgcacgtccatgttggggtcggtgcccacgaatacgcggccatgcgtatcggcgaacgccacctgcgcaaaatgatcgcggtcggggaaaatgccaagcgaaaagccacggcctctggtggagggcagctgcgcccatccaagcaccagcccttccggcacgttctccaattcggggaaggtgcgccgcttgattacaggactcagcgccactgcatggcgagtcagttcgtcgataatgccgcctttacgctcactgatctcccgcaaggcatcgccgaacggattcgtatcgtgcttcttcggcttggacagtcccagatcggccgcgagcgcgttcatcgaatccttcagcccgcccagcagtggcgtgcggttgtgcttcccatggtccgatgtacgttttggcatgattcacattgtctcttgtttgcccgacatcaagcccgaataaagcctatagaataaatgcgtgcattccatagaccacactcgcgcagaccgtccgatgccgtcgaatcatgaacggcacctgcccagccgcccggatacccggcaccggctgcgtttggtgcgcctgctgatcgccttgctggccgccgtcgccgccatcgccgccatggagtgcatcgtgttcaacctgccgttctggcgtacgctcggagcgagcacggatacgaacgccgtgcataacacgctgggttcgggtctcacgcgccggaatgatggcatgttgaccgtcaccgatccgaccaaggcctatcttgaactgaccgcggacggcacgtcggattacctacgcatcgataccgagagcagcaaggtcatcgataaggcccgcgagcaggccgaggccgaatccaaagcgaacgacgataaggaagtcttcaaaccgctggcgaccattcatgtgcgcgcggatgtcgatggcatcaccggcaaggcccagtcgatgaatcccgacgctattcgcagccattatgtcaaggcgccgggtgccggcatcgtgcgtatttggattcaggaagagcgcggcgcgatcgtaccggtcaccgacgcccgcgccaacgtgcgcgtaccgttcgtcatcaattggatgcgcgtgctcgccatggccttggtgttgctgatgattgccgtctggaggccgggatcgcgcctgtggcgtatcacgcttgacccgtccagcactcggcaacgacttgctttcgtggggcttctggcgattcctaccctgcttatcggcgtatccatcatccacgaactgtggtacacgtcttcgctcgtcttccacgtttccggcgattacacctatgatttcgaccagtatgggcatgtggccgatgcgctggtcgccggccggccctggctcgacttgccggttcccgaacagctggccgccaccgagcacccctatgacgtagccacacgtgcccagctactcgccaatggagccagtccgctctactgggattacgcgtattatgacggtcactggtattcctattttggcgtgttgcccgcagtgctgctgttcgtcccctatcgtctgctggccggtcataatctgccgacatccgccgccgagtatattctcgtgctgctgttcatcatcttcttctccttgctggtgctgcgcgtcatccatcgtgtgatgccgaagacttcggtggcggccgcgtcgttagtagtggtctcatcgttggtgagcgcgcaaatggggtatttgctgtatcgcacgaacttctatcagataccgttcgccgcatcgctgacgttgacgtcgctgggactatggctatggctcggcgcggacacgtcccgccgtccgctgagaccatcggaccgatggcaggcgggcgatgccaagcctctctccctgccacgactggccttgggcgccttgtgcattgcggcgaatttcggatgccgaccgacgttcaccttggccgcattgcttgcgttccccctgttctggccgcagattcgcgcgctgggcaccggtctgcgcacacgccgcatcaagccgttgcaggcgttgcgcgcgccgctggcggtaatcattcccgccattctcgtcgtgacgcctctgatggcgtggaacatggttcggttcgattccccgttcaatttcggcaatgcgtatcagttctccatatccgatatgacccggtataccaccccgtccgcggatatgcccgccaacatctggtattacctgttcctgccgctgcgcttcatggatcgtttcccgtggctggcgggctctcccgccccgatgccgcaatggggttattacgaggtgatggtcggcgcgattttcacggccacgccactgaccttgatggctttggcgctgcccctgctgcgcagattggaaacacacggcatgcggccatggctgatgtcttgcttggccgtggcggcggtgctggtcgtattcgacagccgcgtcggcggtttgggatggcggtattccgccgatttcggctggctgatctcgctggcgtccataccggggctactgtggctggtcaatgggcgcgaaccgagccgctcattggcgggggccaacgacgccgcttcaggcgatggcatcgcccgcgtcactccgtggcgttggctgatgcgctgggtcgtgatgctggccgtattgtgggcgctgggcatagccatactaagttgcttcgtgcagtcgcgcagcgattcgatgatcgccaacaatccgacgctctggcatcaggttcagtcttggttcaccctgctataggaccggaccgctcggcgacccgccaagcttcagtattctcccagcattccggccggtgttttccaagacctgcggcataatgtatgtgacgtaattcactaatcgtttacccatactgtcgtgagggtttccccgtgtccactgccgtccgtagtcgcgtcttcaaaatatccgcagcagccgtcaccgcagccatcgccattggtctgtgcctgttctcacaggacgacgtcagcgcctccatcaaggaacgccgcgtggagcggctcaacgcccagatcgagaacgtctataccgacgaataccagcagatgatggacaccgagatcgccgacgagcgcgacgccaaagaacgcacagtcgacagcatctacaccaaggtgaacccgtacggcaccaacaccacgtccatgtacgtgtacttcaccaccgatcaggcctccaccgtcagctacaccgtttccgctgaggggtacccggattacacggccaacgccatcaccagcgatgaggcggccgccgcataccgtgaggccgccgccggcgacgccgacggttccggcaatgtcggcggtaccagcacggcgagtcagacgaccacggtatcgagcaatgacatcgcctccaccgagcacgagtttctggtgttgggactgatccccaaggtcaagaacaccattaccctgaccatcaccgacaccgacggcaacgccaccacgcgcaccatcgagcagaccggcccgaaactgctcggcgaggaggaagtacggctcgaacaggccgtcgcccccgacgaatccacggtcaccacgctcggcaatggcctgtacgcgattctcggcaatgattccaacgagcaggatttcatgtactactatgacgcgaacggtgtgattcgcggcgaaatcccggtgctctactaccgctcgcaccgtctgctgttcgacaatgacggcatcatgtggttctccgcctccaccaagcatttcgtcggcatgaaccgcctaggcaagctggtcaagatcatcaatctgggcgaccagtacatcctgcaccatgattacgcgctggattccgacggcaatatcgtctctctggccaccgatctgaaacattcggaccatgccgtgcaggatcaggtcatcaaggtggacaccgactccggcgaggtgagcctgctggtggatttcggcgacctgttccccgattacaagcaatccaccgatcattccggcatcgacgaatccgatccgaccgccacgaaccgttgggactggatccacttcaacaccatccagctcatggatgatggctccgcgttgctgtccgcacgtgagacctccacgatgatcaagatcaatgacatcgaaggcacgccgtcgctcgactacatgattggcgagccgagcgtatggaatggcatggatgcgcagccctccttcctgaccaaggtgggtgattccggcgacaccggcggccagcactcaatcactgtgcagtacgattcctcgctggaggacggccagtactacatctacatgttcgataacgacttcggttatgccatgacccgtcctgatttcgattggaccatgatcgatggcatttcgaccgcgcagagctccaaggatgagaactcgaactcccagttccgcaagtacctggtcgacgagaacgccggaacctacaccgaagtgcaggacttcgatgtgccgtattcgccgtatgtctcctccgcacaggaactgtccgatgacctgaacctggtggacatcggcatgcagggcctgttcggcgtctacgatgacgacggcaacctcaaggcacagtacaagatggtgctcagttcgggatacatctaccgcgtctaccagtacggcttccgcggcttctacttcgcgtgaggattggcatcgacctcacggccgatgccaatcctccaacggccgattcctatctgctaccgcttcgcagcctcatacttgcggcgaatcagatcctcataaaacgccacagcctcagccggcgctccgtcaaacgcgaccgcgtgctcgtccagcaccagtacgcggtcgatggcgtattcgggccggcggatcatatccgtgtcatgcgtggcgaaaatcacctgcttgttgtagctgaacaacgccttggccacatgcgcggcgccaatctcatccaatcccttgctcggctcatccgccacaatcgcactcggctcaaagctcagcgcggccgcaatagccagcaggtgccgtttctcggagtccagttcgctggccttggccttggagacctgcgccaaatcaaaatgcgcgaacagattgccgatgcgcgcatgacgttctgactcgggcaccttgtgctttttcagcgcttcggaaacagcctcggaaatattcgccgcttggtaaaagctgttcggaatctcctcgcggcgaactttgccgaccagattatcgatgcgcttcgcgtccttcttcacagccgggtcaagacgttcctcaccgcccgcaatggtcaccgtgccggcgttggccttcaacgaaccgtccagcagacccagcaatgtggatttgcctgcgccgttcagtccgatcacagccacccgcagctcgctgatggtgatgtccgtgggagcaagtcccacgtgcccatcatcatacgtatgcccggcctgatccaaagtgaacgtcagcgacgccgggcgtggcagttctttcggtctaaacaagaatcccatgccgctattgtacgtggagtacaggcgtggtgccggcaaacaccggcctatcgcagcaaagcggcgacggtattgagcacggcgcggatgccacgctcgaattcgtccggttcgggtagcagggaaacggccaggtatccattggaagtcatgtcgaagaagtagccgggctgtccggtcagtttgtgctcgtcaatcaaccgcagcaccagctcgttctcatcgatgactgaaggcactcgtagcagcacgttccagccgccttcggcccgtagcacgctgaccagcccgttgggatcggcgtcaagcaactcgtgcaacttggccaggttattgcgcacgcgctcccccacccgtctggtctgtgcgggcgcggcgttcaataatgcgggaatccgttcggcgatgatgtcactcatcggcagataatcatcggcgatgacgtccagtcgacgctgtgcctcggcaacgtcctcggcaggtccggacacctgaatccacccgactttggcgtgcggcgcggccagcattttggagaatccgtctagggcgaaggtgagcacgccgcgctcccctgcgagccgtgcgttgccggggaaaggttcgagagagtaatcgaagaacacttcatcggcgataagggcgatgccatgctcacggcacaatgtcacgatacgtgcacgctcggttggttttacgtacgaaccggtcggattgttcgggttgatgagcaccaatgctctgatgcgttcgccaccgggctcgctgagcagccgctcgagttcggcgatgtcgatgaaccaggagccgtcgaattgcaactggtattcgaccgtgtcaacgcattcaagccgtgcaatcgactcaatcagcggatagccgggtttgggtgccagcaccgcgtcgccggcatcgcaaagtaacttaatcagccacgaatacgcctcggacgtggagctcagcaagtacagggcgtccgggtcaacgccctcgatggcggtattcgcattgttgaaagcggcatggcgctcgttcccgccctcgctggcggcgggcgaagtcgactgagggctgcttgcgtctaccgcctttgccgtattgaggaatgcggccaatgcttctcgcgccgcacgcggtccacgcgggtcggccgtatacacgctcggcaccaattcaggtgccagcccgtggcgggtcggattggaatcgttgagtttgctgagtgcgatgccgtttgccttggctgccgcctcggccgccgcaatgggattcggcgcagaaatatccacacgagaagagaaatgcacgctcataccctcccacgatagagcgtggtgccccctgccccgctctcaaacgcgcaacattcccggaaatgcgtcgctctggacccgaatcacaccctcaaacgcgcaacattcccgggaacgcgtcgccacagacctccatacacacgcccactttgcgcaacattcccgggaacgcgtcgcatacctttcctatgcaatgcaaaaggccgcccgactagtcggacggcctgaagcatattcgcgggtcagcgctgcacacccacgctcactggctcactgctgcttggtgctggcatagtaggcggcaccgacgatgccggcctggttacgcagcttggcgggcacgatcggggtcttgatatccacgtacggcaggaacttttcgctctgacggctcacgccgccgccgacggtgaacaggtccgggttgaagtacttctccataaggccgtagtacttggtcagacgcttggcccacttcttgtagcccagttcctcattctcgcgaatcgcggaggaggcatacttctcggcgtccagatgcttggcgctcaggatgatgtgtccgagttcggtgttcgggatgagcacgccgttgtaaatcaaggcggtgccgatgccggtgcccagtgtggtggcgatgaccagaccatcctggcccttggcggcaccgaactggacttcggccaggccggcggcgtcggcgtcgtttaccacgacgaccgggcggccgcaggcttcggagaacacttcagtaacgtccacgccaatccaagactggtcaaggttggccatgaagtcgagcttctggccgggcttgatcggcgcggggaaagcgatgccaacgggtgcggattcaggcacttcgaagtggtcgagctgctgcttgacgattttggccacggcctgaggagtggagacctcgggagtgagaatcttcaatcgtggctcggcgaaatcgcccttggtcagatcgacaggtgcggccttgatgccggaaccgccaatgtcaacaccgaaagcctgtgcagtttcaatcatcgttgaccttcctttccatacgttttcatcagttcgtaaggttgcgcccagtttaacgcgaattacgctcaacacgaaaccattacacatcaattgtgcaaacgtgtgcatcgtcgccggtcactacgtaccctattcgtatcgtttttcaagcctgacaatgggcaatgcatgcgatttcgcatactaggaaaaatcggcgtctatggtggcctgactctgtgtcgcgcgcgataatgggaggtatggcagaacatacccaacttattgatgcaattaacatccgcaccgccgtacgcgcctacgatgatgagccgatcgacgacgatacggcccgccagctcgagatggcgcttcagccgatcaacttactcggcgatctcaacattcagctggtgcgcgaccagcccaaggtgttcgccgaagccaatgcttcaggtcatctgaccaatgcggcgaattatctggccatcgtcggccccgcgaacgatgaggaagccaaagagcgtgccggcttctatgccgaacgcatggtgctcacggccacgttgcgcggcctcggcaccttatgggtcgccggctcatgggacaaggcggaggcggccaagcattgccgcgtcacctctggccaggagctgtatctcggtgtggtgatcgggcatccgaagaatcatctggattatcaggcgaaatcctatgaggagctatgcgaagcgcaacgcacgcaccgcgccaccaagacctatgagcagttcaccgccacaatgagcgatgaggggcgcgaggccgctccggattggttcaagtccggcgtcgaggctgcgatgaaggcgccgagcgcgatgaaccgtcagccaatcaccttctcgtataatccggccgacgataccgccgccgcgcatatcgatcagagtgcggaagatgagcatcacgcgttcaatgacatgggcatcgccaagctgcacttccagatcggtgccggccaaggccagtgggcttggggcgacggtggcctgttcatccataagtaacctgtagtgacccccctcatagaggggagccactactacggctacttcagcgacggcatgggcttccaggtggggtcgtgcatcagcttgcgcgagtcccaccagcccttggcaatctgtaccaaaccggtcttgaggtgctcgcgatccaccatcaccaggcgaatgacttccttggccgcggtgagcacggtacccagtccaaacaccagcggacggaagtcaccataggtcatgaagtaccgggccatgtatccgcggttgcgcatgatgtgataccggttcatgtcggatgtggagttgagctggcgcacgccggcgatatcccaattgccgatttcgcgcgtacggcgcaggatcacgtcgggcaccacaatcgggttggtgaccttgctggcgcggtagccatacatcgtgtcatcccagtagatgaagaagcgcgggtccggcagaccgatttccgtaaccacacggcggttgaacaggccgccttcgaagcacagcgtgtccatcactcggtatccggccgggccgaatgcggcgggcgcaatcgggttcgggatgcccagcggcacaatgaagtcgtactgccagtagaacgggccgccatcgtagtcgaatcgggagccctgaatcacctcgtgcttgtcggtccacttggacagcttggcaatggcgtccggcagcacggccacatcgtcatccatcacccagaaccatgcggcacccagctcgtaggctttggccacgccggcggagaaaccgcccgcaccacccaggttctcggtctgcggcgcatagaccacacgttcttcgttaccggactggtcggccacggtggtgccccattggccggtcaccttgccggcaaacgcagcgaccatgtccgccgtctgatcggactgctcattgtccacgatgacaatgcgccacggtgcctgttcaagcgccagaatcgaatcgaacagtgtctcaagcaactgctgacgtttgtaggtggtgacgatcagggcaagcttgtcgatggtgttgttgggtttcttcacttcagccatggctcccattgttgcacttgaccggcacaagacgaatttctgcacagtgaaacgcgggttgcatacgtccggcgcatggcgtatgaataagcctgtcagtttcagggaaggtgcaattccttactggcggtaacctgcaccccgggtttcataacggggatggcaggaagcccgcgacccgcgcaagcggctgatccggtgagattccggagccaacggtatagtccggatggaagaaacgagggctcattatgagtgtatcttcgcgtattcgcatgcaagttgttcgttctgtggcacccgaggccgagggttcggccagcacgtccaccgccagcaccagcgccaaacttggctcacacaccactggtgtggccgattctggccgctggtccacgcgccgtatcgccatgtatgcactgttcgtggcgctggcgatggtcaccagcttcattgaattcccgattacgccggtcacttggctgaagtacgacccgtccggcatcgtctgcctgattgccggctttgcgtatggcccggccgccgccgcaatcgtgtctgtgctcggctttgtgccgcacatgttcgccaatccgtggggttcgctgatggctgtgctggtggcgctgttcctgtctgtgccggccgcgttcatctaccgtaagatccgtacgcgcaagggtgccgccatcggcattctggtgggtgcggtgctggccatcgtggtggcgctggtgagcaacctgattgtcacgccgatttacgcgcacatgacctaccaagctgtggccgcgatgattctgccgattctgctgccgttcaacgtggctaagatggcgattcacgccgtgatcaccttcctgatctacaagccgatctccaacctgctgtccaagcagcagtgactggcctgagacgggccgatgcccgccacgactaacgaccactcaaagaccactcaaagaaccagaacgcagaatcccggcacgggccgggattctgcgttttcgcctatcagttacggattgctgtttcatgaccgttgcaccccattccttcgacgccgacgagttccacgattctgccgaacctcacgcttccgccgagcctgcctcccccgccgccgtgctcaaggacattcgtttcagctatgaccgcggcacctcatgggctttggatggcgtttcactcacggtccatgccggcgagcgcctatgcttggtcggtccgaacgggtcgggcaaatccacgttagcccgtctgattgcgggattgaccgcgccggacggtggtgaagtgacgttactggggcaacgcgtgtacgcagccggcccgaatgccgatgcctatcgtgctgcccgccacggcatcggtatggtgttccagaatcccgaggatcagctggtcaccaccgtgttggaggatgacgtggcctttggcccggagaatctcgggctggagcgcgagctcatcggcgagcgtatcgttgattcattgcaggccgtggggttggcgaacttacgccagtccgacccgacccgtatgagcggcgggcagcagcaacgcgcctccatcgccggcatgctggccatgaacccggcaatgctggtattggatgagccgaccgccatgctggacgaatccgcacgcgccgaagttatgcgcattttggatgatttgcaggcgcgcggcaccactattgtgcatgtcacgcatcatccagatgaaaccgttcatgccgatcgcatcgtgcacatggaggccgggcgaatcattggtatcactgcagccgtcgataatcgatccccgctagcggaggctgtctcgcaaagcgagactgagggtagtatcggcacagaagccgcccccagtcgccctacgaacgacagcccccgccagcgggagcgcgaagacggctccgaactgccgctgctctccgatggcatcggtgatatgacgaaccccattattcgcgtctcgcatctgacctatcgctatccttcggccaaacgggcggttatcgatgacctgtcgttcaccatcgcgcgcggtgaaaccgtggcactgatgggcgtgaatggttcgggcaagtcgacgctggtgcgcatgttgtgcgcactgactgcgccgaccgccggcagcatcgaagtggccggtgttccggtggcctcgaccggcaagcgcggtcgcaacgtgcgcccgaagtcggcgaatcgcaagcaattagcgcaattgcgccggcatgtgggttacgtgatgcagcatccagagcatcagctgttcgctgacacggtagccgaggacgtggcgtacggcccacgcaaccaagggcttggcgagaccgaggtagccgaccgcgtgcgcgaatcactggaactgctgcatatcgggcatcttgccgaccgctcccccttcgacctgtccggcgggcaacaacgattggcagccattgccggcatgctggcttgcaatcctgacgtgctcatcatggacgagccgaccgcgagtctggacgcccaagccaagaagcgtatccatgagctgttgcgcacgctcaaatcgcgtggcgtgaccgtgctcatcatcacccatgaccgggaggaggccgagcaaatcgccgaccgcgtggtccgtatgccgattgccgcccccgcatccggcggccccgtcacggccaccgtcaccgagccggccgtatcctccaacggccctgcgcactcagtgatacaccgacttgacccgcgcgtgaagatggtgggcttcctggccgccatgttcacgatgttcgcggtgaacacgccaacccagctcgcgctgggcatcgccatcaccctggccgttatcgcggcggcacgcctgaacccgttacgggtgcttgaatccattcatccgattctgatcctgctggtgctgatgggcgtggtcaatctgtttgtggtacgcaccggcacgccggtggtggcgcttggcccgctaagcatcaccgatcagggcgtgaccatagccgtgctgtacgcctgccgtttcgcattggtaatcattctgggcgcggtgttcctcactaccaccacgcctaccgccatgaccgacgccttcgccaccttgatcagtccgctcaaccggctcggtatccatgcccaagaaatcgcgctggtcatgagtctggcattgcgattcattccaacgctgaccgacgaaacccgcgccatcgtcgacgcccaatccgcgcgtggcggttccatcgaaaccggttcactggcccagcgcatcaaggcgatgagcgcgattatcgtgccgattttcgccggcacgttgcgtcacgcggacaacctgagcctcgcacttgacgcccgctgctacgaggagggcatccgccgcacccactggcgtgccctgaccatcgccgcgcgagatctcatattcgccgctgccgtcatcatctacatcgcggccatcatcgcgctgtagggcggcaaacagcgcagacagcaccggttgctatgctggtgtggttatacgaaagatgtaaggaaattcccatggcattgaccaagaagcaaatcaagcagctgcgcgcgatggcgaactcgctgaagcccctgttctatgtgggcaagaacgatttgaccgagtcggccgtcaatcaggccgatgagaccattgagaagcacgagctcatcaagtgcgccgtgcaggacggttctggcctgaccgccaaggaagccgccgccgagcttgccgagcagctgaacgccgaagtggtgcagtccatcggcaatcgtttcgtgctgttccgtcgctcccggcgcgacgatgtggagcatatccgcttggtgcgcgagtaatgttcgccccgctcgatcccgtagcttgatatgagtaatggcggttggaatcagtccgattccaaccgccattactcatattcgcccagcgagcaccgtcactgatccaagatggacccgacgattcccgcaacaatggtcaggaccaaggaccccagtaccgaccaccagaaaccgtgtacgaagacgcccacgccgaacagactgaccgccagccagctggcgagtcgcatgaacagccaattgataatcaaggtgaccagcccgagagacagaatcgcaaacggcagtgcgatcagatgcacaatcggcttgattgacgcattaatcagcgccatgaacaaagcgaacgcggcgatgccgagaatcggaggctcccccaccggggtcatgccgggagtcaccgcgaccatgacggcggcggcgatagtcataatcaaccagctggtcaggaaacttctcatggcccaatcgtagcgcggcaggttttactattgggcaaaacatgagatgatgttgtgcagaaacggtaagaaggtattgccgttcccgattgagaggggactgacccgcatgactgataatcaacaacaaccgtacggttcggacagtgttccgcagccggcacagcccgcacagccggcacaaccgtcttacggccaagatgccgcacagcagccgcagggctatggcgccccacagcccgccgcatacgctcaacccgccgccggaagctacggccagcagcaaccgcaatacggccagcccgccggcgcatacgctcagcctcagtacggccagccgcagtacggccagcccgcacagcccgcagcgggctacggccagcagcccggctatggacaggcttaccagcagccgaacgcctacgcgcagccgcaatacaccgccgctccgtatgccgccgccccggtggggcaatcgtccaagtccaagctggctgccggcctgttgggcatcttcctcggcggacttggtgtgcacaacttctatctcggcaacaccggcaaggccgtggcccagctgctgctgacgcttgtcggctggattctgctcggacttggcccaatcgcagccgccatctggggctttgttgaaggcatcatcattctgtgcagcaagcccggctcaccgtggcataaagacgccaacggctacgaactatcagactgaaactaacctcgggccacgttcattgggcccctgattaaccacgcctctgcaggtatcatctcgatgccgcagtcgcagcgggatgcgacacgccggccgtgtacatgagttcatgtacacggccgttttctttgttgctttcaccctcaaaacaaacatttatcatgttcacttttgcaagatatgaacatcagacatcacagactaccataacttcccaattgcattaccaatagattaataaccggcaaaacggcttatatccgccatttttcatgctaggctttgaaaccagcacatcaacaaagtgcacaatccttttctacagagaaggtaacatgttgttcaattcatatgtgaatcgaacaatgccagtacttccctaggtgcttgcttggggaacgccatgctgaaaggaacacattatggcggagggaaaagtcatcattgtcaacccggatatgttcggcaaggacccggattcgaaaacaaccaaggccaatgaagtggccaagagcttcggcctgagcgacgcggcgttggccgaggtcgaggacttcaaggcacaactcaccaaacacaacgcctgggatctgccgttcatgggatacgtcaacgaggatggctacggttacgcctacgtgcccggtgccgccgtggtgtacgacccgtactgggacgcccaccaagcattcctggcgctgcctaaggacgtgcagaccgcattcgccattcgtatgctgttcacgcaccgtccggtcgaccgctatggcgccagcatgttcctgcattaccagcgtggcttcaacgtgaagttcgagggtatcggcgcgaaccagtactgattggtactgactatcaaccatctttttcggattgcccgataaggggcgtataacaacggtgttatacgccccttatctgtattcagtgtcaggcgatggccgcccgccgcccgacacaggcgaatcagtatcgcacgagattcaacagttcctgctgtttggcatagcgggaaacgttggtcagggcgatgcggatgatgtgttcggaagtcttttccaaatgattgccgccggccacatgcggggtgatcaggcaatgcggctcatcccacaacggactttccgccggcaacggctcaggctcggtgacgtccaatccggcaccgtggagccgtccattgtgcaaggcgtcagccaaggcctcgggatcgatggcgtcgccacgcccggcattaatcacgatggctgtggatttcagacgacccagacgatccgcattcagcagatgatgggtctgcggcgagcgcggcaccgccatcgccaccacgtctgccaatggcaacagcgtctccagccgctcgaagccatacatcttttcaatgcccttggccggcacgtccgcatgacggcgcacgccgaaagtacgcatacctacggattgggcaagctgagcgaaatgcgacccgatgtcaccgacgccgataatcagcgcgatgccaccttccgggctcaataccggtccttcatcctgccactgatgatcacgctgattggaggcataccggttgaggttcttcatcaatgcccacatggtggcgaacatgtgttccgacacgctttggccatacgcgccgctcgcattggtgaccatggtgccgcgaggcagcacacccgggcagatgtacgcatccacaccggcgctgaaggtctgcaaccattcaagacgggtgtattgggaagcctgcgagaccggaaagttgccgatgactgcggtagctcgggagcgaagctcctcgggaacagcggccgaccagaccatgtcgccgcggtgcgcttcgtcgcccacgaattcctgcggcacatcgcgagccgccttggcgaaagcccgccgttctccttcgttgagtggcaggcagttgacaatcagcttatgcgtgttctcaatacccatggttcaccaaactaggcggcagggcagatattatcgcggtttcctcatgctgaaccaatgccgaactgctaccggaccaatgccgaatccgccccatcaaaccccaccaaaccaagggacaacccattgcgcatcgaccgtagcgtccgccccgaaccgtacactcacaggtggttttgtgattccatagcgtgcagccaaggcagtacgattgccggtttatccgcacgcacaggtacctacgccggttggtaaaccttacattccataccttgcaaccgaacgtttaggagcatgtatgcctgagcagcatattgataacgagaagattcccacacgtcttatcggcgcgattgtggctgtcggctcacttgccttcattggcattctgaccgaaaccgtgatgaccgtgcttttccccgcactgatgcgcgaattccatgtcgacacggccactgtgcaatggattaccacgatttatctgttggcggtggccgctaccatgcccatcagctcgtttttgaagcgccgattcgcgctgaaaaccatttttcttgcggctgtgattctggccatcgttggctcgctgatcatgatcgtcgcccaagccttcccgctgctgattgtcgcccgcattattcagggcattggctcaggcgtggccacgccgttgatgatcaacatcatcctggagcagtctcctcgttcgaaaatcggccgattgatgggcgtaggatcgctggtcattaccgtggctccggccatcggcccgaccgtcggcggcgcggtgaccacagtgctgccgtggcgcgcgattttcgtcatcgccattccgctggtgctaatcgcagcatgcatcggcatgaagtgcattgagcagaagacaccgaccgaggctgcctatcttgacccgattcagcttgggtccattgttgtcgcgctggtcggtctggtgctggcgctcaaccaaggtggcgtggccatcagtgcggcggtgtccggcaagtcagccacacgctccggcattatcgccattgtcagtctgattgcgggcctcgccttgttgatcgtgttcgccatgagttccaagcgtgccttctccccgctgctgcgccttggcattctcaaggatcccgccgtactgttacacgcctgcgcatatctgctgctgccattggtcgccatcggctacggctatgtcatcaccaatgtggcacagctctcgctcggtaccacggcatttgtggccggctctctggtactgcccggagcactggtcggcgctgtctgtgccccgcttggcggctggttctacgataagttcggcgcggtcaagccgattctgattccgatcggcatcgctattttgggcccagtgcttatgctggtgttctcgatgcagcttacgcccttgctgctcgccggattctatttcattttcggtctgttctattccatcggcaatgcgaatgtgatgaccagtggcctgtcggaggtctctcccgagttcaagccggacggcaacgccattttcaacacgtgtcttcagtttggcggcgctgccggtaccgcactgttctccacgattctttccgtggctcaggccggcgcaggagaagaaggcaccgctgagtttgctcacgccactgccgtcggcggcacatggacgtttgccacgatgacggttatctgcctgattggctggtgctgtctggccaccgcgttccgcattcgcgcggcacgtaagcgtgcataaatccgatcatcaatagagtcccagctttccaaacacgtgtggggcgtgccccgggagaaccccggggcacgcccacacgctaatgaaaggaagaaaaggagaaagaaagctttggcgggcagtgccggctgctgtgaccttgccatcacagcagccgggctgatcccgcctattcagttatggtgtgtgtcgtattcggtgcggagaccgagcgggcaagcccgctattttttatctccgccgaccgccatcaccgcgcgctgaagcacaacgaagacgaggatcatgagaccgataacgatggtggtccattcggccggcacaccgaagtcagaggtgagcggatcgaggatggagcggaccagagagccgagcacggagccgagcacgtagccgaagccaccggtgatgatcgtaccgccgatgaccacggaggcaacggcgtcgagctcccagccaacacccacagtgttcttggcagagccgatgtttgcggtgtacacgatcgaggccagggcggcgagagtcgcagaggtcaagtagatgatgtactgcgtgcgcttgaccggcagacccatgagttccgcggaggaacgggagccgccgatggcgtagatggtgcgtccggtgcgggtatggtgcaggaagacgtagccgaagaccacaaccaccagtgcgatgatcacgccgacgttgaaggacagatcgttggagatcttcggattgtcgatgatcttgatcacgttggagatgaacgagaagtcattgccctgcgggaaggtcagcgagtcggtggagatgatggaggcaagaccacgggccaggaacatcgtcgacagggtcgcgatgaacggctgcatgttgaattcctcgatcaaggtgccggccagcaggccgaacacagcgccgatgagcagcatgatgatcatgaccaggaaggcgggcacgccggcgttcgccagcttcaggccgacgactgcggtgatggccacgatagcaccgacagacaaatcgataccaccggtcagaatcggcagggtcatggccacagccagaataatcaggtaggcgtggtcaatgaacagggaggagatgaagcccagtcgaatgtaggtgccgaacaacgcctgacccatgatgatcatcaggatgaagatcaccacggccgcgagggtcgggatcatctgacgatcgagcttgaagcccttcttgggagccttcactttgtttgccgtagctgttgtcatgctgccaccgccttagcttgagccttgagcgcgcgcttgcgtttcatattcgcgctcaggttgtgaatcttcggagcctgcatcacgcagatcacaatcacaacgacggcgaagaaggccggagttgcctcggcgttgacgcccagggtgatgatggtcttgcggatcatggcgataattacagcaccgacagcagagccggcgagggagaacttaccacccagcagtgaagtaccgccgatgacgactgccagaatggcgtacatttcgaggtcctgaccggtcttaaccacgtcgacacgcatcacggatgcggtggcgaacagaccagcgatggccgcgaggaagccggaaatcgcgtagacgaggaagaggatcttcttcggcttgataccggtcatacgggaggcttcctggttgatgcccacggcctcaatcatcatgcccatagcggtcttgcggcacagcaggccaacgagaatcacaatgataacggcgatgacgaagttggcgggaatgcccagaatgaagccgttggcgaaccacttcagcggttcgttgccagcaactgcggaggcgtcggtgttctcaccggaggtgatgaccttggccataccacggccggcgagcatcataatcagggtggtgatgaacggctgtaggcccaggaaggaaaccagagcgccgttgacgcagccaatggccagaccaacagccaaggcgatgaggatggagagccacacgttcatgccattggacagggtctgcatggcggcggcacctgccactgccataacggaaccgaccgaaaggtcgataccggcggtggagataaccaaggtcataccggttgcaatcatcaggtatcgggcagattcctggagcatggtgatcagcgggccggccagaccaccggtgttgctgttccagctcaaagccaggaagtcatgctggaagatggtgcagatgatgaccagaagaatgaatgcgacgatcgaccaggtcaggttgctgctcagcagcttcttgacaaagttgttgccctcggcttttgccttttcagccatctcatgcctcctttccggtgtttacgttggtgttagcgatggtttcgacgatggtcgcctgagagacggtgtcgtcgttttcgatttctgcgatcttgtggcggtccttgagaacctcgatgtcgtcggacagacgcacgacctcttcaagctcggaggagatgaagacaacgcccatgccctgagaagccaggtcaagcacgacctgctgaatttcagccttggcaccgatatcgataccacgggtcggctcgtccagaatcagcagctcggggtgcgtggccagccaacggccaatgagcaccttctgctggttgccgccggagagattcttgaccgggcgatccgggtcggcgggacgaacgttgagttccttcatgtacttgtcaacgatggcgtccgcttccttcttgggaatcggcttgaacataccgcgcgttgcctgcagggcgataaggatgttctggcggacggtcaggtcgccgatgatgccctcatcacgacggttttcggtggagtacgcgattttgttcttcaaagccgtgtacggatcggagatgttgaccttcttgccgttgagcgtgtaggtacccgaatccggcttgtcggcaccatacaggagtcgaccaagctcggtacgaccggagcccagcaggccagcgaagccaacgacctcacccttgtagatgtcaacatcaaccgggttgatggtgcccttcttgccgaggcccttgacatcgacgatcggcttctcgccaggggtgatttcacggcgagccttcttggcaccaatctgggacagctcggcggcggacttaccaatcatcatgccgatgagttcgtcgcgcggggtgtccttggtcatgacctccttgatgaactggccgttacgcagaatggtcagacgatcggtaatctcataaatctgatcgaggaagtgggagacgaagaggatggccacgcccgagtcacgcaccttgcgcatgatcgcgaacaggtccctgacctcgttggcatccagcgaagaggtcggctcatcgagaatcagcaccttggcgttgataaccatagcgcgggcgatggcgaccagctgctgcatagcgatggagatggagctcagcggagtgtgcgggtcaatggattcgaggcccatctgtgccaaatacttcttagcggcctcgtgggtcttcttccagtcgatgccgaaggggccgcgcttttcgtggcccagcatcacgttctcaccgacggaaaggttggtgcacaggttcacttcctgatacacggtggcgataccggcgttttgtgcgtcgagggtgccgttgaactgctgaggcttgccgtccaccataatggagccggcgttgatcttgtacacaccggtcagagccttaatcatggtggacttgcctgcaccgttctcacccatcagggcgtgaacttcacccgggtagagagtcaaatcaacaccatccaaggccttgacgcccgggaattcaatcgtaatgcctttcattacgacgatggggtttttatctgtcatgtctttgccttaaacgagaatgagatgttatcgttttgtgatatttgagccacacatgagtgatggcgtggaaggaacatccttctcacaccatcacatcaattatttggtccagttatcaatgagtcgcagcagacttatcagtaggcgcgggtgttgttgtccagggcttccttggcggaggcggcgtcgaaggtcttggactcgatctcgatgtccttctcaacggtcttgccatccagatagtccttgacggcctgagcggtttccttaccgaagatcgggttgtactcgatcacgtaggagaggtcgccatcaacaagagcctgcagagcgttcttggtaccgtcgatggtgatgatcttgaccttgcccttgaggccggcggcgtcaacagcctgagcggcaccgaggcccatctcgtcgttctgagcgaagatgaactgcgggttgtcggacttgtacttgtcgagcagaccagcggtcacggtcttggcctcatcagtggaccagttagcggactgggactcaagaaccttgacgttggaggcaaccttgttgtcccaaccagtgccacgatccttcaccacggacaggccggcagggccttcgaggatgaagccgttggcgccatccgggaagttcttgttcacgaactcggcagcctgctcgccgcaccagacgttggacggtccgatgtgagcaacgatggccttcttggcctcggcgtccttgacgtccacgttacggtcaacggtgaagaccggaatctcagcctcagcggccttcttcagggagtcatcccaaccggaatcctcggtggaggacaggatgatggcgtcgacttcgtcgttaacgaacttgttgaacgcctgaatctgcttctgctgatcgttgttctgggtcggagagtaggtcaggtcaaagccggcatcctcgaatgcctgctgaatgtccttctcgttggcggtacggaagccgccctcagggcccacagcaacgaagccaaccgtcttcttgccggagtccgagctgccacctgcgttgctggaaccgcatgcggcaacgctgacaagcgcagcagcagaagcaacgagggcaatggccttcttccaattcttcataaatactcctcctcgagcagtgtttatttttttggatgatctttcatcctgtttggtgactgttcgtcatcgacaatctctagtgtgacgctcacaggccaaatgttcaatcgcatgcgataacagtttgataacaggtttataacagtttgataacagtagttcaaaaaacggcttcacagcgccgttttgccttgttattaagccataataagaggtggttgcacggcggcaatgccgctcgtcagccgagcgacaaagccgccgcatcacaacacaagaaaagttattatgaacaccgtttttcttataccatctactgcgcaccgagggcagtgacctggctatcggcgatggtccaggaaccgtcgagtgagccggaaacggagcgcacaatacccaaatcgtccacaatggccaggcgacgggacaggctgatctgccccgatgccatcgacgttatgattccattgggtaaacgctgcgcattggccgggcctggtgccatttgacgccatgcctcttgttgttcgctgtttccctcaggaggtgtggtggcgtacaccagattcagatcattgtagaacgtgagcatggtgacgtgcctgagcacactcacttgggtggccgctttgctcagaccgctcagtgttttatcaccgttgcgcgccacaccggtcatcatcacgccgttcgtgtcctcgccctcgactgccaacgccaatcggcacccttccggagaaaccgccaatgccacaatgctgtcggcagcaccaagccaatcaagcttcagatcggtttccttgcccccatctgacacatgcaattcgcgcccgttctcggatacagcccatacttcgccatccagaccttcggtaatcgatcgcatcggctcgccggagaacatcaccccacaggacgcaccatcagatttcaggcattcgaccacgccgtccgcacgcaacaccgcgccgccggatgaggaaaaaacgaagccccgagcatcgtcatatccgggggcctcccctacacgcaacggactggagctggccagggaaacgatatgaccaccggtcaacgtgtatacgcccgctgtcggctgctcggtagtaagtttcacatttgcgtcggcatcggaatagtccactccatcgccggtaatcctcagcgcgtattcggcattgccgtcgcccatagtcagacggatgcgatgtaccagcaggcctcgttcttcctcgttcaacgcattgataccgctgttgaggtgtatctccaccacattgttcttcaccggcacgctgtcgaccgcgagtttgatggtagacaagccggcgcctcgcagcactccttccaaccaggagggtgcatccgagagcacttcaccgactgcctgggtgcgccagttgcgccagctcaaccaacgaatatccgggataagttgcttgccggaagtactcacctgatacacggatacttggcggaacacctgttcaaaatctgcggtggaaatcaccacgccgctttccaatgacgagatgcgccattggccgcttttcttcatcagcgtatagggaagcctgcgcgtttgggtgctgtttgacggcgtgtatacgccatgcgaatccaaggaacccaccacctgaagttccacttccacaatcagtgagctttccgcaccttgtggcgcgcttatggtgttggcgcgtcggcggaaatcaggggtgccgctgtataccagtgccgcagaatctccattccacccggcagaagccgagccagtcaggaattcgcgagccacgcgatagccatcggactgcacgccagcaggcatagcgtcatagaaccctttgacaatggtttccggctgtgcatcgtccgcaggcccctgaggattggtgtaaacacgctgggtctgctgttccaccggtgccagagtctgcaccgagccgctaatcggcaaatcgaacggacttgagcatgccgtcatcgtgatgcaacaggctatggccgcgcctgcggcggcaatcgttctggtcactcgtctcatagtggcctccccatcatcgtgtcgcggcgaacctcatgataatcatgtgtgacttggctggtggccacaccaaacccaccggtaacacgcaggtcatccggcgtttcagaagcaaaattcaccggcagttcagcgtccgccacctcaccttggtcggggtcacgcggcagcaataccaagaaccaggtgccctcccccactgccgaacgtacacggatactaccgtggtgcagcaaggcatcagtcatggcgatggacaggcccaatccggtgccgccggtaacgcgtgaacgtgaaaggtcgcctctccagaatcgatcgaatacatgagcgactttgtcttcgtcgataccaacgccatagtcgcgaacgctgatggccacggctttgcggttggccgcgacgcgcacttcgatcggccggtcctcagcgaaatcgacggcattggccaacagatttctgacgatgcgaatcactcgacgcgaatcgatacgagtcaaaacctgcacattgggcagatacgtgtgaatcggcacccgtttggcttgggcgatgccgtcaacttggtccactgccgtttcaattggttcgcataaatcggtttccacaaggtcgagtgccgcataaccggcatcgtagcgggagatttccaacagatcggcgagcatgtcttggaatcgactgatctggccggccaacagttcgaccgtacgcttggtggaggggtcgaagccgtcttttttcatttcgagcaggtcggaagccatacgcatggtggtcaccggggtacgcaattcatgactgacgtcggacacaaatcgtttctggaaaacgcttgcttcctccagctcatcgatcttctggttgagcgcatcagccatcgtattgaaggattgctgcagcacaccaagctcatccttacgatccacggtaacgcgcatatcgagattgccggaggccagtgtttccgaggccgctgccactcgttcaatcgggcgcacgatgccacgaatcaccagccagattactacgcccaccacgatggacagcaacgcacagatgaccaccagactgagctgaatctgcgtcaaggactgctgctggaacgtgtacgaataaatggcgaagaattcgaggttgccggccacgccaaagtccaatacggtgccgagcaccgctgcgggcgtcccgctgcccggcatgccggaatcaccgggaatttcgaccggctgatagaacacgctgtcatccaagtcggaagccacggatgaacggatgtcgtcagaaatcagactttgatagctgggttcggtggatacggggatgatggcacgcgagttggtatcacgactccacaaatacacacctatcaggttggaggacccctcggattgcaacgaggacgccaagtcattgaccagctgttggagctgcactgcggtggagacatcggccgcgtccagactggtttgggcctgctgcaccatgtttgaatagtcggcacgcgactgcgaagtgatttgggtaagcagcgaggcgcgcactgataccatcgatacgccagagaagacgatggccacggccagcgtaagaatcacggtgagggccacggtgcgggcctgcagtgagcgacgaacttcagcgcgtccgtggcgcagcaagcgtttgaggctgaatcgagggcgcaggttcattgttcaggagtgacgaacttgtagccaataccgcgtacggtctgcacgatttgcgggttctcggggtcgtcctccactttggccctaaggcgttgaacatgcacattgaccaggcgcgtatcgccggaattctcgtatccccagacattcttgagcaggctggaacgactgatggcctcgccggcggcggccgcaagcatgaacagcagctcgaattccatcggagtgagattcaggtccttgccatccttggtggcggtgtgttccaaacggtcgatgacgatgggtccgcgttccagatggttgacgtttgcattgccaccgcttgcgccaccggtggcaccgtcttcggcggccggcttggcgatgcggaagcgtgcacggatacgcgccagcagttcggctactttgaagggcttgggcacgtagtcgtcggcaccggcttccaagccggccacgacgtcaagtgtgtctgatttggcggtgagcatgataatcggcacattagaggtagctctgatgcggcgggccacctccgtgccgtccagcccggggagcataacgtcaagcagaatcaaatcgggcttgacgatggggaacatttccacagccctcagcccgtccaggcaggtcacagtctggaatccctcgttttccaaaacaagactaagcatttcgccgatggcctgatcatcgtccacgatgaagatggtcgccatggtgtttgcctcccctttttccactgttattgttgcgttacactttactcccctatgttcatttctgttcgggttccccaccatgcagtatcgggcgaatcttggcaagacgctggctgacttcgtgttcatagccgcgatcgttgggatggtagtactcggtgccacgcagctcttcgggcatatattcctgtggcgccacggcaccgggccaatcgtgcgcatatttgtagccctcgtggttgccccactctttcataagcttggtgggggcgttcctcaaatacagcggaacagcgccgatcttgccggcatccacgtccgcgagcgcctggttaatggcgttatagctggcgtttgatttgggcgcggtggccacggcaatcgtagcttcggccaaaataatacgtgcctcgggcatgccgaccagcgccacggcctgcgccgcggccacggtgacctgcaaaatctgcggggcggccatgccgacttcctcgctggcggcgatcatgatgcgacgggcgatgaagcgcggatcttcacccgctttcagcatgcgtgccagataatggatggcggcatccggatcggagccccgcatggatttgatgaatgcggaaatcacgtcgtaatggtcatcgccgtctttgtcgtagcgcacggtggcggtgtccattaccgtagccacgatttcgggggtgatgatgggtcggcgtgcgccctttttgcgggcttcgtcgccagtgaccgcgccagccgcggcctccagaatcgtgagactcttgcgtgcgtcaccaccggccatgcgcacgatgtcggcgatggcttcgtccgtggctttgacctcgcccctgagaccgcggtcatcagtcagcgcgcgctgcaccagttcgatgagctgatcaggctccaatgactcaagcttgacgaccaccgaacgggagagcaacggtttgatgatggaaaagctcgggttctcggtggtggcgccgataaaggtcacgtcgcggttttcgacggcgggaagcagcgcatcctgctgggatttggagaagcgatgtacctcgtcgatgaacagtacggtttcctggccgcgtgacacgagccgttcgtgagcgcgggtgagtacgtcgcgcacgtctttgacgccggatgtcacggcggagagttcctcaaacacgcggccggattggccggccacgatggtggcgagcgtggttttgccgacgcctggagggccgaacaggattacggagctcggcgcggtgagactgcctttgctggccggattggcgaggcggcgcagcggcgagccctggcccaacacctgcgtttggccaatcacctcgtccaaagtgcgtggacgcatgcgcaccgccaacggccgcgtcatcgactccggcgcatcagccgccccaaacaaatcgttctcactcataacgtcctatagtaccccagtgttcgaacagacgttcgagctgcaccctggcttccctcagagaggggagccaagaaaggaatcagttactcaccttgtagtcgtggaagactacttcgccggtgtcttgggtggcgtcgaggtccacgatgccttcgatggcccaatcgtgatcgccatcggaatcatcgataatctgacgcaccttccacgtatgctcgtcgttctcgtgcttgtcatccaacatgaacagttcgggcgagcgcgcttcggcgccgatgcccacgtactcgtgctcgtcgtagtagtcgtcgagcacatcttcccattcgtgcacaccgtagccccagtctttgtcgagcgcgccgagcttgtccggctggtcgaggtccataagctgcacacggcggaacatggcgtttctgatcagcacgataaggcctcgtcggtcctcgaccaccgcgttcttcttgcccggcgccgccaaggaggccgccgcctcggactggtcggcggaatcgccggcgttctcccattcgtccaccagcgaggagtcgatggagcgcacgagcacgcgcagccacgagatgatgtcttcgagttgctcgtcacgcttttcgggcggcacggtgcgcgccagcgtgcggtaggcgtccgagaggtagcgcaacagggtgccttcggagcgggcgatgttgtatcgggtgatgtatccggtgaagtcggaggcggtttccaccatgtcgcgcaccacggatttcggcgatagccagtagtcgttggcccacggcacatcgtggcggtactggtcgaacgcggcttcgagcatgtcttccagcggcttcggatacgtaatctcctgcagcttatccatacgctcgtcatagtcgagtccgtcggccttcatatcggccatcgccttgtctcgggcctgacgctcctgggcacgcagcacctgcttggggtcttcgagcgtggcctcggccatggagatcacgtccagcgcataggtgtcggactcggggtccagcagttcgagcgcggccagcaggaacggggagagcggctggtcgagggcgaagtcgtccggcatatcaagggtcatgtagtagtccttgccgccgtccttgcggccctcggtttcgatgacttcggtatcgaacagggtttggaaaatctcgtcggcccgctggtgcagatgctccttctggtcgggggtctgcgcggaatcgtcgatgagatcgtcgatacgggcacgggcgtcgccgccctgcgccacttcgttgagcaccatcgaatgcgtgattttcaggtgcgggaccagggtttccggttcggcgtcgatgagcttgtcaaacgtgctctggttccaggtcacaaaaccttccggagccttcttgcgcttgaccttcttgagcttcttcgggtctcccccggccttggcgatggccttctggttttcgatttcgtattcgggagcctcggcgatcaccagtccctcggtatcgaatcccatacgaccggctcgtccggcaatctggtggaattcacgggcgcgcaggcggcgcatcttggtgccgtcgaacttggtcagggccgtgagcaccacggagtgaatcggcacattgatgccgacgcccaatgtatcggtgccgcaaatcacgggcagcagaccctgctgggcgagctgttcgaccagacggcggtagcgaggcagcatgccggcgtgatggatgccgacaccggtgcgcagcagccgctgcagaatcttgccgaaggctgtggtgaatttgacgcctttgatggcttctgcgatggcttggcgctgttccttgctggacacgccggtggaggcgagcgcctgcgcggtctccagcgcggcgtcctgcgagaaatggaccacataaatcggggtttcgccgttgcggaaggcgagttccacggttttttccatcggatcgagcgtgtattcgtagcttaacggcaccggtcgcggcgcgtcggcgattacatccacgtccggggtgtcgttcagatcggagagcttgtcggcaatggcgtccacattgccgagcgtggcgctcatcagcaggaactgggtctgcggcagcgtgagcagtggcacctgccacgcccaaccgcgctccggatcaccgtaataatggaattcgtccatcgccacaaggcccacgtcggcatgggtgccttcgcgcaaagcctgattggcgaggatttcggcggtgcagcagatgatcggcgcgtccgcgttgatgtggctgtcgccggtgatcatgccgacgttgtcgcggccgaacacttcgaccaagtcgaagaatttctccgacaccagcgccttgatcggagcggtgtaataggagcggcggccagtgcacagggcggcgaagtgcatgccaagcgccaccagcgatttgcccgaaccggtcggggtattcaaaatcacatggtcgccggccaagaggtccataatggcctcttcctgatgcggccatggttcgatgcccttgacgtcttccacccagccgaagaatcgttcgtagatgtcatcggccgtaagattccgttcgcgtccgtcgccgtcccattcgggggccagccgccccagggatccgtattccttctcgtcagtcataatgctcagtctacctagtggcctattccggcgacacgagccaccctccgtcgctatgcgacgcctcccgccagcgggcggagccatgcgaagagccgtgccatgcgcttggctccgccagtgggaggatcgctcacgccaaccggcggcgcacctcgtcggggtccacctcgggttcgaggggcggccaggtcatgttcatgttcttcaaggtggtgcgcagcagttcggagaccactgctcgcgaataccagcggttatcggccggtacgaggtaccaaggtgcggcggccgtgctggttttctcgaacacctcctgccatgcggccatatactcatcccatcggtcgcgggcctcgaggtcggagatatcgaatttccagaacttggtgggatcgtccagtctcccgaggaagtgttttttctgttcttcctggcttaccacgaggaagatcttgaggatggcgcatccgctggcggccagttcacgttcgaaatcgttgatctggtcgtagcgggcacgccatacgtcttcgggataggtgccatagacgtgcggcatgaccacatcttcataatgggaacggtcgaatacggcaatccaccccggcttgggcaattcacgcttcacgcgccagaggaagtcgtggtcgagctcctcggccgcaggcttgccgaagccatggtaatggatgcccatcgggtcaccttggctgaacacgtgacgcacgatgccgcccttgccggaggcatccatgccttgcagcacgatgagcagccgccgtgtcgagcctttgacgccattcgcgtacatgagccgctggtatcgggcgatttcggaggagctgatcgaaatgaactcctcggcgtcctctttattgccgtcgaatccgggagtggaatcgccttcgacatcagtgacctgcatgccgtggtggaacataagacgttgagcgggcggcaacgaccatacggcgctgagcagttcactggatttcgccgcacgtgccagtcgttcaggcacgctggcactggagtcgatggtgtctatgcgatccgccgcgagctgtaataccttgtcgatccggcgatcggttttgtattcctttcccttgccattcttgttgttctttcctgaggattttccggctgtaccccacttgccggcctcttcaggcttgttggttctgtcgtcgtccttggccatgctcccgattgtacgtcttgtaactcaggagacccagcaacgtagcgacattcacattccacttgttactgcaaatctataggcatgcagtcgttcggaccgtaattgttggctttgcaccaattccaagcctcatccgtcgagtcgaagccctcaccggcaagaatcacatagtatttgtcggaattgctgctgtaggtgggccagtcacccgaccagataagcagtacgtttgacttcttgttgtgcatcgtgatgaattgcgcaagaatatcgtggtagttccaggtcttgccttcagcttccatgcccttgcgcttgctggacaactgcgcggtatacgtggaatagacccgaaaaatcgaacacggcatcggccacgacattatcgtcgctgtcctgcaacgtgagtcgggtggccgaatcattgaatttcgtggatgcgttcttatcatcacaattcgaagtggccagaatcgtgactatcagattgtcgctcttgatcgaggagactttcatatcgggagcggcatcgcaggttttggcaggctttgccttgtcggggtcgatgtatgccaccagatatccgccggctttgatgacggtgtccgtattcgttacttcgctggcgccgatggtgtagtgcttcttggctttcttgccgctgtcgtagatgccccagcccttcacgtcaacgtctgtggagccggtgttcttgagctcggcccaatcgcaacgcttgctatccgggtctccggcagctttcgtattgccggcatagacctcgttgatgattacggatggtttggcagccgtgttctgttcggcagtggtctgctgctcgtccgcagtcgcagcgggcacgccgatcagggcgatgctgctcagtgtcaccgcagcggtgagcagcgcgactgaactttggctgaattactgctgaagctggttcttggatttgcgtcgaaccgtccgcattccgccgacaatcgcgattacagcggtaccgatagctacgctgatcaacgccggtcgttgcacggcatggagggtggcgagatccggcccggccgcaatggcactgttttcacccgccaagctatccgacgccggatgattgcccgcgtcgatgtgctgggcattgaccacactcgggccggcaagcgccacttggtcggcggtctcgaccttggccacatcgccgtgcttatccaaggtgacgcgggcgcacagggctttggcccagttgatacgctgccagccgtcgctcgattgccatagggggtatccggaatccaaggcggtggctttcaaaatcgcgttgcgctgatcggcgtgcagttcgggataggccagtcgcagcacgtccgctgccccgcgcggggccacgaaatcagcgccggactgggcggtgtctttcgggaaggtgtaggtcaggcgtgcggtgtagacgcgcacggccgaggcttggtccacgaccggctcggtggccactgggtccagaaaatcgttggtgtagccgcccgaaccggaggccttggtgttggcgatgcagacgacgagggtagtgccgtggccgtccgcggcgcagcgggacaccagatagtcgcgcagctgccgggacgcgggcacgatggacgaagcgaattcgttatgccagtactgcccgttctgggcggatgcgccaatgcgcccgcccatgatgtcaagcggataatgcacgccgagcacgatgcggttgttgccggcctccgaagttcgggccatgatttgcggcgcaagttcgggaatcatgccggccagcgcgataccccacgaataggcgccggtagtgtggccggaggggtaggaactgtttttctgcaagttcgagtagccgggcacgtgttcgagccatgagggcgattgcttgatgtcaagcgtggcgggcagtccggcgagatcgttagtgccgccgtagctgctttccgcacggttcagataggggcgcggatgcatggccgcacgttttgaggcgtaggtggaggccacgttaaaggagaagatatcggcgacggcattgagtttcccggatttgagcccttcgctcatatatttgccaagcaccggaccgagcgcgtccggcatggtttcctcggcttgcagatcggagtcgacgagtgcacgcttgcgttgggcgttcaggccatccttatcgagattttcggcggctttgtggttaatggccacggccaaatcttcgtcgagtttcatggtatcggcgtcgagcaccttgccaccgtgctcggcatcggcgggggcctgccagtagttcttttcgtagtcggagagcaatgccagccaatccgggttggacagctggtcggcctgtgcgattgcaggcgtcgcggctagcgtggccgccaacgccagcggcgcaatggtcgcaatagcaaaaacggaggataggtgccggaacatcttcatatgttccaacctatcctccgtgaaggctacgtagccggagcccagtcaaacactcagtaaattcttcgtgccggcttagcggcgattgagctgactgtcaggcctctggcttgtcctcaggcttttgagactcctggaattcgccggtttccgggtcaacctgtgactcgggctgggtggcgtcatatccctgttcgtagcgggtgcgccgccagttgcgaatcgaggcgttggtgccacggtgatgcacatggtatttgcgcggcgtaccgcccagcggcagctcttcgacctccttggccacagcgatctggttgacattggacgggtcgccggcggcgatcggcgccagcggctcgggttcggcgggtgcggccgtacgctgctgcatgcgcgagggcagccattcggcgagcctcgacaacagccagcaggcgatgaagtaaatcaccgcggccatgaccagcgtctgcaggatgttgaagtacatcgagccgagtcggcgcgattcctgcagcaggtcggtatacatgatgatcgagcctagggcggtatccttcaacaccacgaccagctgggtgacggcggccggcagcatggcgtagacggcctgcggcacctcgatctccatcagcgactgcgtttcggtcaggcccaaagcgagcgaggcctcacgctggccgcccggcagattgccgacgccggagcgcaccagttcggcgaccaccgaaccgttgtacagcaccaaggccagcaccacggcccaataggacgggctgggcaggcccgcgaacgcgaaccatcgccagaagaagatcatgagcagcagcacgggaaccgcacggcagaactcgacgatcacggcggagacgccacgtaccaacgggttcggcagcagtcggcccacgccgaacaccaagccgaacaccacggcacccaccacggccacgatggtggccttgatggtcatccacagtccgggcaggtagaagtcggtccacgcctctcgttcgacggcgggcttccacagctcccagctgagctggttctcgccgtccggcgggttgtgcaggcgcatgaggataagcacgagcaccaccgcgaacagaatgcccgcgatccagttgacgatgcgaatggtgcgccggcccttgggaccgggcgcgtcgaacagcacggaattcgaagtatcggccatatccgtcacctccttacggcgagtttgttggacaggtacgtggtgagcatgccgatggggatgatcaggatcacgtagccgagcgcgaagatcaggaagatttggatgatcacgtcgggacggaattcgatcatctcgctcatcagcgaggatgtttcggtggccacggatgcggcggcggccacggtggagttcttgagcagggcgatcagcgtgttgccgagcggtgccacggagcctcggaaggcctgcggcagaatgatctcggtggcggactgcatgaagcccaagcccagcgctcgtgcggcctcggcctggccaatcggcacggtgttgatgcccgaacgcagagattcgcacacgaacgccgccgtgtacaggctcagaccggtgaccgcgagccagaagaagttcgtggtgaaggtgtcggagaagctgagcttcagctgcgcgtaggcacccagcaccatgaacaccatgatgatggtcagcggcaggttcttgaacagttccacatacgcaccggccacggccctgagcgaggaaatcggcgagatgcgcatcaccacaaggatcacgccgaggatcagggagaacagggcggaccatagggtcagttcgatattgaccagaaacgcgccgagcacgtcatactggctgaagagttccaggaatccgctcatcaggcctcctctccttcgtccggggtgggcgggttgtagcgtacgtcgggcgtgtagttggtgcccttggtgttatcgctgatggcgttctcccacgagccgtcctgaatcatgtccacgatggcgttgttgattttggtggccagctgcgtgtcgcccttcttgatgcccacgccgtagtattcctgcgtgaacggtttgccgaccaccttgagcttgccgcgcgaggcggaggccaggccggccaggatgatgtcgtcggtggttaccgcgtccacgatgccggagaacagggcggtggcgcattcggcgtaaccgggctgttccataagctggacttcggaggcgaacttctccttgacggtggcggcggaggtcgaaccggtgacggagcataggcgcttgccgttcaggtcttcggggccgttgatggagttgtcgtccttgcgcacgagcagatcctgtccggccacgaagtacgggccggcgaaggagacggccttcttacgctcgtcggtgatggagtaggtggcgaggatcatgtccacgtcgccgttctgaatcatggcctcacgctgcttggagggagcttccttccagatgatctggtcttcggaatagccgagtttcttggcgatgtacttggccacgtccacgtcgaagcccacgtaggtgccggacttcttgaagcccaggccgggctggtcgaatttgatgccgatgcggatcttgccggtttcgtccgcgccgcaggcggccagcgacattgtgcaggccacggcggcgagcgcggcgatcacgcggcaaaccttccgtttgaacgtattggtgaatgtcattggattgcgtacccgtctttcagtgggttcgtcagtgggtgaggatcttcgagaggaagtccttggcacggtcggtctgcggatgctcgaagaactcgtcgggcgtgttctcttcgagaatctggccgtccgccatgaagacgatgcggtcggcggccttgcgcgcgaagcccatctcgtgggtcacgcagatcatcgtcatgccttcatgcgcgagttcgaccatcacgtcgagcacttcgttgaccatttccgggtcgagtgcggaagtgggctcgtcgaacagcatgaccttggggcgcatggcgagcgcgcgggcgatggccacacgctgctgctggccgccggagagctgggagggcatcttgctggcttgggagtcgacgcccacgcgggcgagcaggtccatggccagttgctcggcttccttcttgtccatgtgacgcaccttgatgagggccaacgtcacgttttcaagaatggttttgttggcaaacaggttgaacgactggaacaccatgccaacttcggccctgaggttcgcgagctccttgccttcctgtggcaggggcttgccgtcgatgcggatgtcgccggaatcgatggtctcgaggcgattgatggtgcggcacatcgtggacttgcctgagccggacgggcccacgaccaccagcacctcacccttggtgacggtcaggttgatgtccttgaggacgtgcaaagcaccgaagtgcttttcgacgtgggtcagttcgactagcggacggttcgggtcctctttgccgggaaccagcggggtcaatttggccttgcttggtgatgttgtgcttgtcgtgcgcgaacgcactgctgtttcattgttcgtttcagacatgagtgggaggataacacgccgacgtttccaacgtgttccagtatgtccacacagttgctcagtcgatgtctcatttccgcatcagacatcgtgaaggcggcattgggcatcggcatacattctcgctgagtcgcgcatcgctcggcgtctgctgtgcgctgattgcctgctgcgtggtggctgagacgttgctgcgacggcaaagcgggcacgtgttgtcctatctgctgattccatgtttggccttggtgtcgttggcgttgctgccgtgtatgccgcagtcgggcgcatggctggcggtcactttgtattgtgtggggctggtctcgccgtttcccatgtcgtattcgtataaatgcgctaggcattttgagcgtggctagctgttcgcacacgatgagtgctgttatacggtggacgacactcccgaagcgcggtggataaccgggcgcggcacacgatatgccggtggataaccggttcgcgccgcttaagttatccccatttttcggttttgcccctgtgccaccgtggaatgcgctacgctcggcgcatgaacggatacagcgaagtgccgcacaatggcgaaatcaacaactatctgcgcaaagatcttgacgccaaagccacggccaagaacacggcctgttggaatctgctgggcaaagtgcgcacgaaacgcacgttgtgtttctcgctgtataccgcattggaattatgcggcgtggagttgccgaggcacagcacgttgccacagaaggacttttatgtgacggtgaggagcaaggggacccgctcttcattggacaatgtcgactatcgcatatggaatgcaaagttcaacagtatcgctttctcaaacggcgtaacctgcatgcatcccatggatgcgtggatacagtttgcccaatatctcaacctcactgaattagtggtgctggctgaagcgctcatcagacgttatggatatgccattgaacaattcactcaacgactaacggcctttcaccgcgttattggccgtgcgcgttgtgaggcggcgctgaagctcgtaaaaccatcggattccgttcaggaaactcgtacacgcttggcgcttatgcttttcggcttgcccataccgcaaacacaatatggcattaccgattcagagaacggatacacctacaccgttgacatggcttatccacaatacaaagtcgctattgaatatgatggcgatcatcaccgtcgcttccgcaaacaatatgtgcgggaccagcaaaaacgtcgacgtctgcggcaattgggctggaccgtcatcgaggtgttcgccgatgacctgtggaacaccgccaaacaacgtgccttcgcacaagaggttgccaccgcgatgcaaataccgcttcctggccgtcctcaaccttcatgccgggtattaatagacggcagccttaccatcaatgcgcgcaaaggggaatacaggaggcggaaacaagcaaaacacaacaaagcatcacaacattgatcaaatacggagttgcgatcgctcctcatggggcggtaatttgcccatggggcggtttgaagaaattgtgaaaccgcggaattaagccattttgacctaccgccccatggggttttcaccgccccatgggttgtttaccgccccatgaggaagttaccgccccatggaaggataatcggcaaacgccaagggggacaccgcatggtgcgaggtttgccgcatggcggaggtgccatcgggcggagtatttggcaccccttggcaggtatttggcacattgggccccacccgcaaaaagcaaatggcccttggaattattccaagggccatttgcggctaatagcaccggagcattactcctcgaaaattaatctacgcgtgcggagaccgccgtccgaagccgaaggcgcactgaagtacgtcgagtgctgaggaaaagcggtatacgctccgtagattagttttcgtcggcgtccgggtcgtagtcgacgccagtctcggcgcgctgctcgtcggaaatcggggccggagcaccggtcagcgggtcgcggccgccgccggccttcgggaaggcgatgacgtcgcggatggagtctgcaccggccaggatggacacggtgcggtcccaaccgagggccagacccgcgtgaggcggagcgccgtacttgaatgcctcaagcaggaagccgaacttctcgtcggcctcttccttggtgatgcccagcacatcgagcacacgggcttggatgtcgtcgcggtggatacgtacggaaccgccgcccatctcctcaccgttgcagacgatgtcgtaggagtcggacatggcgtgctcgggatccttgtcgaacttgtcgatccaatccttggaaggcatggtgaacgggtggtgcatggaggtccacttggagtggccgacagccacatcgtcatcatccggatcgtcggtgggcttgaacagcgggaagtccacaacccaagtgaaagcgaacttcttcggatccagcaggccttcgcgggaggcgagctccacacgcacggcacccagcagcagctgggctgactcgcgggaaccggcggcgaagaacacggcgtcgccttcctcggcaccgacggcctcgcgtaggccgttgcgctcctcatcggataggttcttggcgacggggcccttgagctcgccgttttcgccgaagaccacgtaagcaaggcccttggctccacgctgacgagcccaatcctgccaagcgtcgaactgacgacgcggcgtggcggcaccgcccttgaagaccacggcacccacgtacggggcctggaacacgcggaacggcgtgttcttgaagtactcggtcagctccaccagcgggttgccgaagcgcaggtccggcttgtcggagccgtacttgtccatcgcatccttccaggtgatgcgcggcagcggcagctggacctcatagccggcggacttccagatggcggcgatgaccttctcagtcatggccatcacatcttcctggtccacgtaggccatctccatatcgagctgagtgaactcgggctgacggtcggcgcggaagtcctcatcacggtagcagcgggcgagctggtagtaacgctcgacaccggagaccatgagcagctgcttgaggagctgcggggactgcggcagggcgtaccaggaaccgggcaccagacgggccggcaccacgaagtcgcgggcgccttccggggtggacttaatgaaggtcggggtctcgacctcggtgaagtccatgtcttccagcgcgtggcgggcggccttagccatgtcggaacgcagcttcagattgtgctgcatggacggacggcgtaggtcgaggtaacggtacttcagacgcacgtcctcgcccggcagcttgttctcggactcattctcgagagcggtggaaacctggaacggcagagcgtcggacttggcgaggatctcaatggtctcggccacaacctcgatcttgccggtggccagatgggtgttctcgttgccatccgggcgcaggcgcacttcgccggtaatctgaatcacgaattcgctgcgcagcgggcgggccatatcctcgtcgtaaatgacgacctgcacgaggccggtcgaatcacgaaggtcgatgaaggccacgccaccgtgatcacggcgtcggtcaacccaaccggcaagggtgaccttctggccgaccagggcctcggtcacttcagtggcatgatgtgttctgtaagccgtctggctcattatcttgtttctcctcgatttttcgcgcgaatacgtcagatttcgacggtttgctgggcaaccacagtatccggctcccacgacgtgcaatcggcggcaacctgctcgcccgtgacgatgttcttaacctcgtcgccagcgggctctgcgccttccgcaccttcggcagcggtggccgggaaccacacgtacggaatgccgagtttgtccgcgtacttgatctgcttgccgagcttggccgcggtgggtgccacgtcggtggcgatgccgcgcgcacgcagttggttcgcaatacggttggcggccgggcggtcctcttcattccacacagcgaccagcacggcggccgggctgacacggttggcgtgagcgccggcggtgtgcagcatgtagctgaccagtcggctcaggccgatggacaggcccacgcccgggtacttgcggttgccctgggaggcgagattatcgtaacggccaccggagcagatggagccgagtgatgcggcaccgtcgaggaaggtctcgtagacggaaccggtgtagtagtcgagaccgcgggcgatcttcaggtcggcgatgacggaaccggggcggatggcggcggcctcgtcgacgatcatggccagggtatcaagtccctgacgagccagcgtgtatgcctcggaatccttggcgatgccgtgagactcgcacagcgcatcgaacttggcggcaagctcggcaccgtcggaggcggtgagctcggccaattcgaggcaggcgcgtgcctgtgcttcggtggcgccgcaggtctcggtgagcagtcgggccacctcatcggcaccgattttgtcgagcttgtcgatctcgcgcagcacgccttcgacgtccgtcaggccaaggccgcggtagaagccttcagacaacttgcggttattggcgtgcacggtggccttggggaggccatacgcgcgcagctcttccagcgcggagaccatgaccagcggcagttccacttcatagtggtcgggcaggtcgccggcaccgatcacgtcgatatcggcctgcacgaactcgcggaagcggccttcctgcggacgctcgccacgccacaccttctgaatctgccagcgcttgaacgggaacgccaacgcacccgagtgctcgaccacataccggctcagcggcacggtcagatcgaaatgcaggcccaaccgctcttcaatcggagtgtcggattcatgaccgacctcctgcaaacggctcagcaggtagatctccttgctggtctcgccttttttcaacaaagaagcgccggtttccaccgctcgcgtctcaatgccgatgaagccgttgagctcaaaaaccttacgaagcgtatcgataacacgctgctccacaacacgttcggaggggagccactccgggaatcctgatattgatgcacctttagccacgaaatcaatataataggtgagggttgcgtcaaaacttcctggttcgcccgggatgggagacgctcccgcttatgcattctacgctttaaggagctggccatggccgacgaaactgtcaccgaacccgtaaacaccgctgcgcccgaagagcaggcaacgacacccgcacccgaagccagcgcggccacgccggcgccgactccgtcccccgcttccatgccgaaaccgcacgcgccctcccccgccgccttcgccaagaagactccgtcggccaagccgcgcgctgccgccccggccgccgccaccgccacctattccgaggctgatgtcaaggccgccgaggccttcggccgcgtggatgacaacggcaccgtcttcgtcaaggatggcgacgccgagcgcgaggtaggccagttcccggatgtctccaaggaagaggcgttggcactgtacgcccgtcgtttcctggatctcaaggccaagctcgatctgctggccgcgcgcctgacctcccccaacatcaagacccgtgaaatcgacgagtccgtgaagctgctgggcgaagaaaccgccgaaccggcggtggtgggcgacctcgcggccctcaaggcccgttacgcggaactgaaggccgccggcgaggccaagaaggccgagatcgccgaagcgcgcaaggccgctcaggccaaggccgtcgccgagcgcaccaccatcgtcgagaaggccgaagctctggcggcctccctgggcgacaacaccaactggcgctccaccgccgacaagttccgtaacctgttcgacgagtggcagaaccaccagcgcaccaccgtgcgcatcgacaagccggaggccgaggcgctgtggaagcgcttctccgccgcccgcaccaccttcaaccaggctcgccgcaagtgggctcaggctcgcgacaacgagcgtacagccgccaaggaagccaaggaagcgattatcgccgaggccaatgagctcaaggattccaccgcttggggtgagacttcccgcaagttcaacgatctgatggaccgttggaagaaggccggccgcgctggccgtaacgaggacgacgagctgtgggccaagttccgcgaagccgccgacaccttcttcaacgctcgtcaggctgatcgcgatcagatcaactcctccgagaaggagaatctggctgccaaggaggctctgctggtcaaggccgaggctctggtgccggtgaagaccgacgccgaggccaagaaggcccgccaggagctggccaagattcaggaagagtgggatcagatcggttacgtgccgcgtgacgatatgcgccgcatcgagaaccgtctcgacgccgttgacaagcagatcaaggccatcgaggatgccgcttggaagcagaccgacccggaggccgacgcccgcaagtccagcttcgaggagcagctcaacgcccagctcgccgagctcgacgccaagatcgcggccgagtccgacccgaagaagaaggccaagctcgaagccgagaaggccaccaaggagcagtggctgaacgccatcaagtaaggatctcgtgccaggttcccctctgagggaagccggcagcaaggctgactgaggggagtttacggttataccgcaagctcccctcagtcgcctacggcgacagctcccctcagcgaggggagcttcgtcatatttatgccgttttcttctgccctatactcataactccaccccatagttcctcagtcacccagcaattggtgtcttacgcctgagtccctaccggtgctgcaacaattgccgtgagcccttgatgtgcggccagatattcatgcaacggctggctgtatggcatattcagctcgccgtaattggttccggcacggaaggcggggtaactgtcgccgccctgaagcagatatgaattggatgcgataatcaccaggtcatcgtctgcaatcggtcgaccgtcaacggcgaggttcacgatacgaaccgccgcatgttcgtcggcagcacactcgtcagcgtcagcgttggtatcagcggcggcatcagtatcagcggcggcatcggcattgccgctcccaccggtcgtaccgcattcggcataccgatacgtcacgttcgaggagatgccgagccagcgccgctccagtcgcccatcgtcacggtggaattgctcggcgaacactctcttcacatcgcgcccggtgagcgtctcatgcgcggccttgaactgcaaggccatgagactatccacctcgcgcacggtgactttgccatcgccattcatatcaagccgtggagtccgcagactgccattattcgaaaatccgattaccggcaaacgatttccggcatacacatgcttcatgattgactcgcggttcgcgtccgccaccagcacaccgaccgtattcccgtgcttatccgaaccttgtttgtcgaaattcacgccggaggccaaggtgccaatcaccgcgttgccggcatgattcgaatatgttgccgccgcctggtaaatatgctgagcgcgcgatacctcatcgttcgcctcagtaccggcagacatccaagcggcttgcgccggatgcgcattaagcccttccacgcccagcacgccgtcaaccgccgtatggctggtgccattgccgaggtccacatcggccactcgcaccgtggcgcgacgcccggcaccggtgatgatcaaatcctgcacggccatattccgcccgaagctgcccgcctcgtaaataggcgcaccaccagcggtcgtaccacgcttgatcgcgtgactgtggccggtgtataccacatcaacatctcgcccaatatcggcggcggctgaagcatcggcgtgcagcaaggccaccaccgcatccacctttccggagcgcttgagttcacgggccacacgattgatcgcgtccaccgcccgttcgtcaaggtcggcatcacgagtgatctgcggagtggccaccgagccgagcgcatcagtaagggcgcccacgaaaccgatccgcttgccgttcaccgttcgaatcgtagagtcacgtacgtggctcagcagtccgtcaggcgacttattggcggcagacgcgttggcgcacagccagtcgatgccgttgctgggatcagcgatacgattgttgaaatcggcgacactgcggtcgaactcatggttgcctatcgccgaaatcgtcaatccccacgctttggccatatccagcgtgggttggtccttctccaccgccgactcatacggggagcctcccaccaaatcgccggtcgataccggaatcatattgccgggattatggctgtcggccacggtgaaggcggtggcgttgtctgcaccacgttcgatatgcccgtgaaaatcagtgatgtcggcgatggtcaccgtacgggtgccggaagatggattatcgccggaaaaaggaacggctcccgtggttcccgcacaagcataaggaaccaccagagccgtaaggataagcgctactgcaccaaaagcgatccccgatcgcttgccggcccaccgccggttcttcatattcctgctcacaccagtcacgctagaatcgtcgattgaatggccatgcctaggaaggcgactctcaggtgaattcttagcggcgtcttgggatgggaaaggcctgaccccgtactatcagggtcaggcctttgcaacccgagtcactacgaatgcgtcagcaagaggagattactcgccaaattcctcggcgcagatctcagctaccgcatccacgcacgcctcggcaatcagacggccgcgttcggcgctcgagccggccggattggcgagtccgccgtgagcgggaacgtcaccttggcgcacagggtagcggacataggatttcgccgtggcaccggcttcctcgaccatacggtccatgtgcaccagttccggcgcatagtggagcatcaacgaagtttcggtgacggccgcatgctccaatgcccagccggggaacaccaatccatcgaataccttgtcgataaccgactgcggaaccgggtcccaccaattggtttccacgatggtggctactcccccggtttcgcgggtgaccaggtcgatggcctcgacgatgaacgcctcgttttcaaaatgcgcgttcatgacgacgatcttggtgaagccatcggcgatgagttcgctcagcacgtcgtgcatttggttgatcactgtcacgccgttcatgtcgatagtgcccgggaacagcggcccgccaccggagagcggcttggacttgtatccgtagctcagggtgggcagcacggtgccgtcgatgcgttccgccagatcttcggcgacccgcgtggcgagtaccgcgtcggtgccgatgggcagatgctggccgtgctgttcggtcgaaccgatcggcacgatgacgggacgagtcttcgcctccttgaattccggccaggtcatgtggtccatacggcggttgctacccattgcagtactcctttaggttggtggtggattggatggtcgatgaatacgcccggctccctcggggaaggagccggagctgaggagatcagatgtgattcagatccttgtcggtgttttcgtgggagaggatcatcgcgaccaaggcgatggccgcaacgcccaccatgtaccaggccggggcgatggacgaaccggtcagggcaatcaggacagtggcgatgaacgaggccgtaccaccgaagatggcgttggccagattgaagctgaacgcgaatccggtgaagcgcacggaggtggggaacgtctcggtcaggtagctggacagggtaccgtcgttggcggtcagggtggcgcacattgccagctcaaccagcagcacgggccagaactgggaggtgttgaggatgaggaaggcaggaacggtgaggacgatgaacgccacgcaagcgccgatgagcaccttcttgcggccgaatttgtcggagatgtggcccatgccgaacaccatgaacacgtaggcgaccaggcagatggtggtgatggtgccggactggggggcgtccatgccgacggtgtcagacagataggtcggcaggtaggtgagcacggtgtagaagccgaccgcgttcagcacgcaggctccgaagctgatgatcagagccttgagatggttgtggaacaactcggcgagcggggcgaacatgccgctcttggcagcgatttgaccgtcggcggaggcggcgcccttggactcaagcgcatcgttcatcgactggtagacgggggaatcagcgagcttggcgcggatgtacagcacaatcagaccgagcgggccggccagcaggaacggcacacgccatccccaaccgaccatcgcgctagagttcatgttggcggtcatcagcgtggccagagtagaaccggcgagcagaccgatagcggtgaaagccggaatcagcgagcagtagatgccgcgctttgaagtgggcgcatattcgccgaggaacgtggccgcaccggcatattcaccggaggcggagaagccctgcaccatgcgcagcagaagaagcagaatcggcgcgccaacgccaatcaccgagtaagacggcaggcagccgatcaggaagctcgcaccggacatgaacataatcgagtgggccagtgcggctttacggcctttcttatctccatagctaccccagaacagtgcgccgattggacgcaggatgaaggatagcgcgaacacgccgaaggtctgcagcatggcgacggtgtgattgtcggttgggaagaacaccagggcgatagtggtggcgaagtacgaataggaggcgtagtcgaaccactcgatgaagttgccgagaaaggaagataccgcgacttttctgaccatggcctgttcttcagtttgcggggtggaattcatcagtcgtgcagatgtagtaatcgttgcggaactcatgatgtcaccgtcctttcaaggatgtgctgttcgtgtgactgaatgggattcaagtgggaattcgtttcgcagcaggtcgaccagcgccgcgatagcctcgactatgcccttgagtatttgctgaaacgtgaatcgtcgattaacccgttcggcgtagaagtggacaggttgcccagtggtgctgacgcattattcaccatgctgttcttgccatgatttcgtgagtttggcggcgaatagcagcatcgaccagttcggtttgtcgttatagtcgacgccgaccatttgtgtcactttgtccagtcggttgtacagggtttgccgtctgatacccaattgctcgcacgcgccggttttgctatcgaggttgtcgaagcagacgcacagtgtgtccagcaacaacggagaggcggcgacctcgaatccgatggtctgcaccacgagcatgcgcatcgccttgtccatatcagaggatgcgacgaaacggtcgacgagtgcggacatggtacttacgattcgcccgtatgccggttcctgattggcgatgtcacgcaataccgcgaacccgtcgaccagcgtcaccgtgtccaatgccactcggccatgcaccacgtatataccgtcgccttccagtacggcaagcgcatccatgcaatggcgtccgaatgcggccgcaccgtctgaggaatcggtggtggagcaccatccgaccatcaagtcaccttccagcatgcaggagacggcgcatcccgaccgttcttcgaaccgttcgaccatcgtcgatacatggttgatgccttccaccaccgatctgaaccgaaaagcgaatggcatatagatgcatgatccggcaaaacccagcgcttcgagcatcgcatgcgcttcctgcgcctcaaatgtattgacgtgcacgccgtcggccggacccatactcagatgatgcatcatgcccatgcgcgcaccgccgtcaatataaagggcagccaccggagacacgatggtggcgatggcccgacgcatcgtggcgtcggaagtcatggtgcgttgcgtgatctccaatgctcccaccggccgggagcgactttcaagggcgatgacggcgctcgattcgttgccggcatcgaacgcacgacccgctcgagcggccaacagaccgtcaccatcgaaaatggcgacgctttcgccgaacagcgacgcaatggtttcggccacagcctcgatattgccggtacgggacaatccctcacgtaatgaagtggacattgtgtccacctccaattgcaagtgcatctgttcgtgcacgatagcggtattgacgctctgacagatgtcgacaaaaggtacgcgagatttcaaaccaatcaacgtcaacccatgcagcctggccgcagacaccagttcgtccggcatccgcaccacaccctccaccagttcgaccaccagagcggcgacaccagcctgtgccaggcttgctacatattgtcctagcgtgccgtgccaatcggcggcgagcagagcgttgccctcgataatcagcatctcaccgcccgaaaggaagctggagacatcctctcgctcgttggtgaacacccatcgcactggcgtatcgaggtctttgccttcgacctccaccacaggatcggctcgtttgaactgcgtgttatgaagcacactgcgaatcgatacagtcatacaatctgtccattcccccgcggaacaccggtcgttccggttaacctcaccgcaaagcgtgctgttgacaataacctcagttggttacgcgggcagtcggttcacgtaaccgttcggcaacacaccagttgaaggagcgacgatgactaccacactgttcaccaacgcacatatcgccaccggagaacccggaagcacggctgcaagcaccctgccattgcaggacattctcgtcacggatggtgtgttcaccgcattcggccccggactcgcgcaacaatatgaggctcagggtggtgatctggcggccattgaggtggtcgatctgggcggcaaacttgtctgcccaccgttctgcgatacgcatctgcaccttgattacgtattcacggcccgcaagcccggtgcggtgaatgaaagcggaaccttgtttgagggcatccagcgatggagtgagaccaagtccgacttgacggtcgacgagatcaagcagcgcgcgaaaatcggcattaagaaagaaatgctgcatggcgtgcagctcattcgatcccatgccgatgtgaccgacccgaacctgacctcgttaaaggcgctgctggagcttaaggaggaattgaaggatacggtcactctccagatcgtcagcttcccgcaggagggcatgtactcctacgagggcccgcatggcgaatcgggtgccgagctggtggaggaaggactcaagatgggtgccgactgcgtgggcggcatcccccatttcgaacagtgccgtgagtttggcgagcattccatgcacacggtagttgagttggcttcgaaatacgacaagctcatcgacgtgcattgcgatgagacggatgatccgaattcccgttacgtggagctgctttcggcgctggcatataaggctggcattggcccgaaggtcaccgccagccacacctgttcgctgggatcggcggacaacgcctacttcttccacctgaccaagctgcttaaggcggcgcatatcaacttcgcctgcgcccccaccgagaacctgtatttgcagggccgtcaggataccttccccaagcgccgtggcatcacgcgagtcaaggagctcactgaggcgggtgtcaatgtgtcattgggccaggattcaatgcaggacccgtggtacccgttgggcaatggcaatatgatgctcattcttgattatgtgctgcatttggcacagatgatgagctttgaagaaatcgacgatgcgttgaagttcctgaccgtcaacggtgccactacgttgggcctgcgcgatatgtacggcttggaaacgggcaagccagcaaacttcattgtgctggacgccgatagcgtgttcaacgccgtgtatgagcgctgctcggtattgcgttcggtgcgcgccggccgcacgctgtttacccgcgaggagaccatcgacaccggactcgccctgctgtaataatccgacacaaacagtagctccccttgacaggggagctgtcgccagaggcaactgaggggtagaccacaaacgtgcacatcatgtgtgcgcaggtctacccctcagtcagcttcgctgacagctcccctgtcaaggggagctttgctggtatgcgctagctacgctatcgaaacggactactcctgcggagcgtcaccggaatcggcgggagcggattcggccggctcagtggccggagtggcgtcggctggagtctcgccatcagtggcggcaccgtcttcggcgggcttatcggcggcggccggctcctcgaactcctcacccttgaaggtgaattcgccgaggataccctcgccttccgcatccacaatcacgcgctgaccgtcttcgagatcgcccatcaggatcttctcggagatggcgtcctcgatgtcgcgctgaatcacgcggcgcagcggacgggcaccgagcagcgggtcgaagcccttctgcgcgagcaggtccttggcggcgtcggtgagttcgagcgacatatgacggtcgaacaggcggtcgttgagctgcttgacgtccagatccacgatctggcgcacctgcggctcggtgagctgcttgaagacgatgatgtcgtccagacggttcaggaactccgggcggaactgctgcttcaattcggagctgacctggtccttcatgcgctggtagctggactcgttgttggcacctaggttgaagcccgtgttggcggccttggcgatgtctcgcgtaccgaggttggtggtcaggatgatgatggtgttcttaaagtccaccttgcggccctgaccgtcggtcaggtggccgtcatcgagcacctgcagcaacgtgttgaagatgtccggatgagccttttcgatctcgtcgaacagcaccacggagaacggcttgcggcgcaccttttcggtgagctcgccgccttcctcgtagccgacgtatcccggaggcgcaccgaagagtcgcgaagccgcgtacttctcggagaactcggacatatccacgcgaatcagcgcgtcctcatcgtcgaacaggaattcggcgagcgtcttggccagctcggtcttgccgacgccggtggggccggcgaagatgaacgaaccggacgggcgcttcgggtccttcagacccacgcgagtacggcggatagagcgggacagggcggaaaccgcctcgtcctggccgatgatgcgcttgtgcagttcggcttccatgttgagcagtttcttggactcggcctgagtcagcttgaacaccgggataccggtggtggagctgatgacctcggcgatcacgtcctcgtccacgaccatcttgacgtcggactcgccttcgcgccaggagtcttccttctgcttgcgatcggcttccagcttctcctgcttgtcgcgcagttcggcggccttctcgaagtcctggcccttgatggcctcgtccttgtcggcggcgatcttggcgatcttctcgtcgagttccttgagctcaggcggggcggtcaggcgcttgatgcgcaggcgtgcaccggcctcatcgatcaggtcgatggccttgtcaggcaggttacggtcctggatgtaccggctggacagctctgcggcagactgcagcgcgccatcggtgatggtcacgtggtggtggttctcgtaacgggaacgcaggcccttcaggatctcgatggtctcggcgatggtcggctcgtgcacctgaatcggctggaaacggcgttccagagccgcgtccttctcgatgtacttgcggtactcgtcggtggtggtggcaccaatggtctggagctcgccacgggccagcatcggcttcaacatgtcggaggcacccagcgcgccgtcagccgagccggcgcccacgatggtgtgaatctcgtcgatgaacagcacgatgtcgccacgagtcttgatttccttcagcaccttcttcaggcgctcctcgaaatcaccacggtagcgggagccggccaccatggaaccgaggtccagcgagtagacctgcttgcccttcagggtttccggcacgtcgccggcttggatcttctgggccaagccttcgaccacagcggtcttgcccacgccgggctcgccgatcagcaccgggttgttcttggtgcggcgggaaagcacgaccataacgcgctcaatctcgttggtacggccgatgaccgggtccagcttgccttcagcggcttcggcggtcaggttgcggccgaactgatcgaggatggcggaaccggacttgttctgcttgtccgtcacgccgccggcgttggccaagtcgcccttgccgtcaccggtgccggtgccggagttgccgcgaatcatatcgatggtcgcgctacgcaactcgcccagatcgacgtccatcttgatgagcacctgggtgcccacgccttcgccttcgcgaatcaggccgagcaggatgtgctcggtgccgatgtagctgtggcccagctgcagggcttcacgcagcgaaaactccaacacctgcttggcgtgcggagtaaaggggatgtgcccgttcggagccgcgttgcccttgccgatcatttcttcaacctgcttgcgggtggcatccagctccacgcccttcgaggcgagtgccttggcggctacaccctcaccttcgcggatcaggccgagcagcaggtgttcggtgccgatgtagttgtgctgaagggccctcgcctcttcctgcgccaacacgatcacgcgccgtgcacggtcggtaaaccgttcgaacatgcttgtccttcctcaattgacattccgtcttactctaccgattcacgatgacgtttattcatcggattccacgaattgcgccgtgagaggagaagaaaacgatatgctggttctagattcacccgtagtcgattacaaggaggctcgaaatgagtgaagctgcaaccaagcccgacatcgttgtcggtgtggatggttccgatgaatcctttgccgcgctgaagtgggcgcttgaggaggcctcgttaaccggtcagagcgtcaacgccgtgtttggctggacgcattcctgggatatggggtccgaaccggacagcgacgaggcctgggccaaggtccgccacgatattgccaacgagctgcgtgtgtgggtcgacaaggccgctgcaggcatcgacttcgatccggcgaatctgaagctcacctcggtgaaggcctccggtacttcggccctgctgcagatcggccatgattcgcagcagatcgtggtcggccgccgctcgctgagccgtatggcccgctggttcatggggtccctgtccgcttcgctggccgaggccgccgaagtgccggtgaccgtggtgcgcatcgccggcagcgaggatgagaccgtgaccgaggccattgccaacgccctgactccgggagacaagcccgttcactacacgcagcctcagccggtggttgaggaggctcgccgcccggtggtggttggtgtggatggttccgagacttcccgccgtgcgttcgatttcgcactggaagaagcacgactgcacgacgcgccgctgcatgtgatgttctgctggcagctcaaggatttgggcgttattccgggctatgagaacgccgtggcaccggtgaaggtcggtcagcgccgcgccgaggagattctctctgagctgatggccaaggcccggattcccgatggcgtcaaggtcagcacaaacgccttccatattcccgcatccaaaggtctgatcgcggcctcgcggtacgccagccatctggtggtcggctcgcgtggcctgtccgggctggacgcgcacttcctgggatcggtgtcccgccagatcgtgaacttcgccgaatgcacggtgaccgtggtgcactgattcaccaaaatcggcatggagtgctaacgcacgcctcggtgatgggcttgcagggaggaattctttattcctgcaaccccatcaccatctacttttcgcggaattcggagtttattcctcgtccgccctgttctggcgcagctgctcaatgagatcgatgacggtttcgagttcaggagtcacatcgtctgaaggacgaacgttatcctcttcgtcgtccatctcatcatcctcatcatcatcggcaacggtgttgttgaggatatcctcttcggtggcctcgtcgtcagcatcagacttggaatcgtcgctggaatcagctgcatcaacatccacaacggaatcagatacgttctgtgcaacggactcatcaccggcagactgggattgcgaggtcccgtcgcctgccgcctcctcagcgggctcagtatcgacggcgttcccgtcaacagtcttctgtgcttcgatatcatcaccggcaggctcgcctgtcttgtcggtttcgccttcggcctcgtcctgggcagccggctcctgcttgcgcggacggttggccaccacgtcgatatgcagatcgtcgaaagcaggcttggactgcacccacagctggcttggctcgggaggttcgatttcggaatgctcgccgcagccgtggtccaaggaaaccacgcggccgtcatccggactccacttgttggcgcacacgccgaacatacggtcgagctcgcccgcgagcggcacgaagaaaccacaggtggagcacaggttgccttcggcggttttggtgctcaacgctttggggcctcgcggaccttcataccagcgcttggcagcctgcgcgcggcccagcgaggtcagcacgtgacggcgggtcagtcggaaggtctcgacggcgtcgttgacatcctgcagcgaggattcctcgacttcgccttcctcgatgcgctcgtcatccggatcggtaccgatcgaatcggtgggagccagatccgtgggctcaaggcgatccttccaaggaatccacttgggcggcatcaacgcgtcctcagtggagatcaaggaggattcgttgacggtccaggagtcgatctcctcgtcgtgatacagcgtcaccgaccattgccatccttcgtagccacggatattcgcggcgaagcggaagtcagtgacgtgatcctcaagatcatatgaggtaacgaaatcccccacctgatcgctctcgtcggccacttcgagcagcacggcgcgcgcgatggcgtgagggtccggtgtcacgatggtttcggtggtatcagtcatagatcagatcagtcctgtacatcgaattgatccgccaccgcacgcagcaacgtggccagctttttgctgtcggcagcagatgggtaacggtgacggcgcaacgtattgccggccgcatcaagcatcttgatgaggtcctcgcagatggcggccatgtcatccgccttcgggcgggtggccttgaccaagctgggagcggaggcgatcaggcgaacatccatggcctgcggcccacgacggccgtccaccacggaatactccaccttggcccccttgcgcaacgtggtgacgccagtgggtagggcctgagccggcaggaacacgtccttgccttcctcactggtgatgaagccataacccttggctgcgtcaaaccaacgaactcgaccggtgggcattgcgaaccttccttaatcctcaatggaaatagtaaaccgaaggtacagtttacctcacagggcttgacctcacgctttgggctgagtcgcctgagtcttacgctcagagctgaaccaagaagtcttctgtttggcgtccttggttttgccggtggactgcttgggctcaggagcggcgatctgctcaatcggcagcaccacggtgaaggtcaggcctcccccatcggtgccggtggcgcagataaagccgtgatgtgctttgaccacggattgcgcgatggccatgcccaaaccagtaccgcccttttcgcgggcacgggatgggtccgcggtgtagaagcgttcgaaaatcttcgagcgcgattcaggcggcacgccggggccatggtccacgaaacgcaatacggcatatcgatagccggtctgcatcgaggcacctacttcggcagcgtcgatgaaccgccgcattgacgcgtcgctggcgggcatgcgggcgagctgtcttggatcgatggcggccggcatcacaccgagcgcggcttcagcgggcgaatcggcaggcgtgtagcggtggatgttgcccacgatgttggtcaccacctggcgcagtcgagaggcatcaccgggcagtacgacctcaggccaatcgccttcggcaaggctgaattcggcgggatggttcaaatcgcgcgccggttcgagggaaatctgcatgcggcgaacggcacggtccgggtcgagcgcatgcaaatcgtcgacggcgtcggtgaccagcgacgagagtttcaccgtgccggtcatatcgatgccgcgcccctcatcgagacgggccaaagacagcagatcctcaacaagaacagtcatgcgctggctggaccgttcgatatgttcgatggactcgtccgcacgctccaaggcaccaggcatatcgcgctgcatcttatacagctccgcatagccatggatggcggccaacggggtgcgcagctcatggctggcgtcggagacgaaccgtttcatcttgtcggtggtctcctcctgctcatggaaactggattctattcgggtgagcatggaattcagcgaggcggccagagagccgacctcggtgttttccggcgcggaaggaatacgttggctcaggtcgccggctgcaattttcgcggcggtcttctcgatgcgcttcagcggcgtcatcgtgtgctggatgatcagcgtggacagggagccgccgagcagcaccacggcgatgccgaccacaatgcagtatcgggtgagtgtgttgacggtgtcgatttggtcggccagcgacaagccgatgtacaccacggcacggtccttgccgttttgctggaaggtcaccggcagaatacgccatggtgccctcgccgtgacgatggcggcatggttggcattggcagtggggttggccagtaccttggtgatggtgtcagaggaattggagtttccgttggccggatcgttctggctgtccgcactgtcggactgcaccgtgatgatctgcttggccaccgcctgcgtagtgaatgcctgaccgagcgtgatgccattggtatcgccataggtaggcagaatcggcaccgatactataccgtcctgcatctgcggcatcagcggggtcacgaccagaggattgccttctttgtctttggttccgtcggtgtattgaatctgcagaaagtacgagttcggccccgatgagtcattttttgacagcagatcgatattgttgaccaccagttggctttgcgagcttaactgggtgtcggttttctgcagcatgtagttgttcaccaacgcgcggatggagaaggaaatcaccgacacgccgatgagcagcacggcgatggtgcaggccaccagcttgctgctcaacgagatacggtcgatatgccgcatcagcatgtttttcttacgctcgcgctgctcttggaaatgggcggcgaacggcgacattgcaggcatgggattcgtgttcggggcggcgttcggcgtgctgctcggcggtacgccgcctgactgcttatcggggatactcatgagattgcgatacgttatggatggaggcgattagttcttcggttcgcgaatcatgtatccgatgccgcgcttggtttcgatcagcggagtcaccttgcgcttgccgccttcgccgtcgtcgacctcgatgccgtcgactttcttgcgcaggtaggagatgtacgattcgacgatggctgcgtcgccgccccagtcgtattgccagacatggtcgagaatctgtgccttggacagtactcggccctcgttgtccatcaggtagcgcagcagcttgtattcggtagggctcaggtcaaccggctgccctgcacgggtcacgtcgtgggagtcctcgttgatttccaagtcggcgacgcgaataatcggatcgtcttccacctgttcgcgggtacggcgcagaatggcgcggatgcgagccacgacttcctcgaggctgaacggcttggtgacgtaatcgtcaccgccgacggtcaggcccatgatcttgtcttgggtgtcgtcacgagcggtgagaaacagcacaggggcgttaatgccttcctggcggatgcgacgggtgacggtgaatccatcgatgtcaggcagcatgacgtccaacacgatgaggtcaggctgcactttttcgataacctcaatggcttcagaaccggaagcggcggtgtttacctcgaatccggcgaagtgcagggaagcgaccagcagttctcggatggacggctcgtcgtcgacaacaacaatcgatgcttcaataggcttactcatgcttcctagagtgtcgcgctcttctgggcgtttcctgaatgtcatcttggagttcggccttggaatccttcttgatctccttgcgccgatgaatcaccaccatgaccacgatgatgatgaccagcgccaccaataccacacccatgatgattatgcctacgatcaccgtggacgatgaggtggaggcttttttggatttcacgatttgatccatcattgccgttgccgcgccagaccagctcggcgggttttccagtaacggctgctgtgcggcttcggatagcttatcgacggttttgttatcgagaagccacttatcggagttcttggacacgacgaccaccaggttgccgtcattcgaggccacggcaagcatcactgtgttcggcttgggattcatggactccatcacggttgccgcccagtctcccggtttctgttgactattgaaactggaaagatacagcagatgcacgtgtacaccggtttccttctcggttttggcgatggcatccgtgacttcggccgcatgggagcccaggagattttccgtatccgtgatgttctcggtgatggtcacgccgctgtcggtgctgctgctggagctgtcagagctgtcgctcgagttatccccataggcatttgcagttatccacattgcgttcatcgctactgcagcaagggcgcaaatggcgcaaacaagccattttcggaccatattcccgaaggccgaataggacggctccgaagctaggaccacaatagttgtttttccgtcttcccgattcgttgttgacatatcctccaccttaacggccggtattggcaatcggccgccatacataccattaaccctctagaaaaggagcaacgatgccccaatatcaggtagattccgagcgaatccaatcatcctcggccgcagtggccacttcgatctcgcaaatcaggcaggccgtgggcggcatgtacaccaatctcaatgccttgcaggacgcatggcgaggttcggcggccacccagttcaccgcggtagccgaacagtggcgtgcggcccaacagcagatggaggcctcactcgagtccatccaacgctcgctgacgcaagcctccaccgtgtacgctgacgccgaaatccaagcttcgcgcctgtttgccagctagtttcttggctcccctcaaagaggggagccagaatacaaaaaagggactcccgaaggagtcccctttcagctcaatcagctagcgatcgtttgcggatcagtagcccatgtcggcaccggcggccggggcagcagacttcggctccggcttgttggcaacgacggcctcggtggtcaggaacagaccagcgatggaggcggcgttctgcagagcggagcgggtcaccttgaccgggtcggtcacaccggcggccagcaggtcttcgtaggtgtcggtggcggcgttgaagccttcgccatcaggcagggagcggacggtgttgatgaccacgtcaccggacacgccggcgttctcggcgatctgcttgatcggggcctcgatggcgcggaacacgatggcggcaccggtagcctcttcgccggtcagggaggtgacggcctcggtcttctcggccttggcagcagcctgaacgagggccacgccaccgccaggcagcaggccttcctcgatggcggccttggcgttacgcacggcatcttcgatgcggtgcttgcgctccttggcctcgacctcggtggcagcgccgaccttgatgacagccacgccgccagccagcttggccagacgctcctgcagcttctcacggtcgtaatcggagtcggtgttctcgatctcagcgcggatctgggccacgcgagcgtcgatgtcttccttggagccagcgccctgaacgatggtggtctcgtccttggagacgatgaccttcttggcgtggccgagcacggaggtgtcgacggactcgagcttcaggcccagttcgtcggagacaacctgagcaccggtcaggatggccatatcctgcagcatggccttgcgacggtcgccaaagcccggggccttgacggcgcaggacttgaaggtgccacggatgttgttcaggatcaaggtcggcagtgcttcgccgtcgacgtcctcagcgatgatcagcagcggcttgccggtcttcatgaccagctcggccacgtgcacgatgtcctgctgggatgagaccttgccggaggtcagcagaatgtacggatcttcgagcactgcggtctggtcgtcagcgttggtgacgaagtacggggcgatgtagcccttgtcaaaacgcatgccctcggtgaagtcgaggtccaggccgaagcggttgttgtcttcaacggtcacaacgccgtcctggccgaccttgtccagagcctcagcgatcttctcgccgacctcagggtcagcggcggagatggtggcggtagcagcgatctggtccttggtctcgacgtccttggcggcagcgacgagttccttgacgatgacctcggtggccttctcgatgccgcgacgcagggcgatcgggttggagccggcgaccacgttcttcagaccctcgtgaaccagggactgagcaagcacggttgcagtggtggtgccgtcaccggcgacgtcgtcggtcttcttggcgacttccttgaccagctcggcgccgatgcgctcgtacgggtcttcaaggtcgatttccttggcgatggacacgccatcgttggtgatggtcggagcgccgtaggtcttgtcgagcacgacgttgcggcccttcgggcccagagtgaccttgacggtgttggcgagcttgtcaaggccctccagcatgccctgacgggcttcctcatcataagagatgatctttgccatggttgcgtattcctccaaatggctaggtataccggttatcactcgcaagcgtcaagtcgtgacgaccagccgtcagctgccgattatcactctcgacctccgagtgctaacccagacattagcactcgcgcccgccgagtgccaacaccatcggcggcgattgcgctttgggcatgaaaaagccccaaccgtcgaaacggtcagggccttcaatgcacatccttgcgtgcgtgttgctcactcggagcgggcttcacccgaagacagcttgacaacatcctttgcctgcgtgcctttgccggacgaagcgggcgtatactccacgcgatcgccttcgtacagcattttgaacttattggtgctgccgtcgtccttgatttccgcgtagtgcacgaaaacgtcctcgccgccgtcgtccggctggataaacccgaaccccttcttggcaaggaagaacttcacggtaccttgtgccatatctggtctttcctttgttcccttgggcgtcgcgacacaaaacctatagggaacgtagaaagaaccgcatcgcgctccccctacctcgcgactagatgatgattgtacagtgacgagggaacaatctcaaccgcagtggcacattttcggtacgaattattccataggcgtgagaacgctcacagttttcgatgtatttctcgccgatatcaggggcgcatcaacaacgctagttgagcaacaccaccgtaatgggaacggcgagtccttgcacctgctccacagccgaaatgccaagcgtggtcgccacatcctcagcggtggccttatcggtctcattctgataccacaccacggaagaagccggcaatgtgccgctcggattggtcgcctcgacactggtgtaaccggcggtctgcagcacatcggcctgctgacccgcatatccttggattcctgtggcgttgaccacacgcacctgcgtggccttattcacagtcgcgatggcttcggactgctgagactgctgatcggagttttgattctcattcgaggatgtcgtgtcactgtcggtatcggactttgccgaatccgaagtcgagtccttggacgaatcggtcgaagtggacgaggaatcatccttggtgctgttcttggtctcagccttgctggacgaatcggacttggacgtggtcgccgtctgggacgatcctcccactacattcttgtattctccggaaatccatgcccaggccccgacaccgcacagcgcggccaccagaataacgacgatgaacgggcagaggcgggccattaccgaacgagcgccacggtgaactcccaccggtcccttcggaggattgtcgaaggaatccggttcataggattcgtaggtcatcgtgtcgcgtgccataatcgccctttcttcctatcaaaactacccatgagtgtaatcggcaaacaactcatcagtccaccacaccacgccccatgcaccggatatgcacgtttgactacagtggtgagtcatgatcaaaccattgagcgaactggtagagccagggtgggcccatgccttggccgacgtggagcccaccatccaccatatgggcgattttcttcgtgcggaaaacgccgccgggcgcccgtggctgccggcaagccacaatattctgcgcgcgttcaccatcccgttcgattccatcaaggtgctgattgtcggccaggacccctacccgaccccgggtcacccggtgggtttgagcttctgcgtggcgccaaatgttcacccgctgccgaaaagcctgatcaatatttataaggaattggttgacgaccttggggtgcccatgcccaccaacggcgatctgacaccgtggacggaacgtggggtgatgttgctcaacagatgtctgactgtcggcgtcgggcggccgaattcgcatcagggcaaaggctgggaggaagtcaccgaggccgcgattcgtgcgttgaacgcgcgcacggacgccgacggcaagccccagccgctggtggcgattctctgggggcgtaatgcgcaaagcctcgagccattgctgaccaatgccttcatcatcaaatcgcctcatccgagtccgctgtccgcttcccgcggattcttcggctccaaaccattctccagagccaatcaagccctagtcaccatgggtgccgacccggtggattggactctttaggcaggccaacagtcattgtgagtagttacagtggggggcatgactttgttccccacgcaaccgaacataccttcgccgaccaccgccgcacgaccggtcgccgttcccgcgcccggcgtgtcggctccgctgggtgccgatgacgccaaacgcgcacgtatcctggccgacgccattcgggcgaggttcgcccagacactggtgggtcaggataatctacgcgaatcgcttatcgtgaccttggtggccggcgggcatattcttatcgaatccgtgccgggcttggccaagaccacggccgcccagacgctcgccacctgcgtatccggctcgttcaagcgcgtgcagtgcactcctgatctcatgccatctgatctggtgggcacgcaggtcttcgattttgcgtcgcagaagttcaccacgcagatcggtccgattcacgccaatttcgtactgctggacgagatcaaccgttcgaatgccaaaacccagtccgccatgcttgaggccatggccgagggtgccacgaccatcggcgggcagcgtatcgccttgcccaagccgttcatggtgatcgccaccgagaatccgatcgaggaggagggcacgttcaacctgcccgaagcccagatggatcgtttcatgatgaaggccgtcatgacctatccttcgcccgacgaagaggctcggatgctggccatgctcacccgccgcggctccgatatgatcggtcccgacaccatcaccggcgaacgcatttccgtgtccgacgttgattttttgcgcaaggcggcacgccgcgtgcatgtttccgacgcgatcatgcgttatgcggtcgatatcaccgccacgtcacgaggtgccggctcccgccccatcaagggactgtcgtccttggtgcgtttgggcgcctcgccgcgcgccaccatcgccttgacccgtatcggccaggcgaaggcgttgctgtccgggcgcgactatgtggtacccgaggacctcaaggcgttcgctcatgaggtgctgcgccaccgtattatgctgacgttcgaggcactggccgatggcgtggtcagcgatcagatcgtcgacaagatcgtcgaaacggttcctgttccgtgagttccgattccgttcgcaagaagatcgaggcccttggcactcagctgagcctgcctaccgtaaggaaggctttgggcgcgctggagggcgaacacgcatccgggcgtcgcggcggcagcggcgatgcgatggatgtgcatgcctatgagccaggcgacgaatcccgtcttatcgattggaagaccagcgcccgccaaggccgccccatggtggtcgagcgcgagcgcctgtcgacgtcacgggtctggttgctgatggacgtgggcctggagatgactggcgtatgcccttccggagaacgcgcatggcaggttgccgccaatgcgctgcgtatgttcgccgcactgtcgttgcgccggtcggacgatatttcgctggtgttcggcgatgagtccagtatcacccgcgtgccgttcaacggtgggttcgcgcagttcgaacgcacgctggacaaggcgcttgaccgtgattgggatcatcaccgtaatatcgacgcgctgctggaatatgcgcgccgtatcaaggatcgcgaggcattgatcgtattggccaccgatgagcatgcgatggaggagcggcatatcaccacgatccgtcgtattacccgcacccatccgatggtgctgatcgatgtggcgacgatgaatccgttcaaggccgtctcatcccgccacgctcccaccgacggcttgagtgcacggcgtgtgccggcattcctgcgcaacgccaaggcagcggccgaggtcgatactcatcgcgcgtatatggccgcggctttggaacaggagctcacccgtgccggttcccatatcattcgatccgcatccagcgaatccatgttcgatcgtttcgtcgccctggtgtcccgggcattggcccgcaccacacgcaatagactgggtactgcacccgaactggtcggactgactttggctggtgatctatgatgcacagcatgttccccatcatcccgctcgccactgatcccggcgatctcaggcccgtggagtcgttggccttgaccactcccctggtggtggccatcgtcgcatgcctgttgctggcggtaggtctgatcgcgttgatcatcatgctgtctcgccccgcacgcaaacctcggaacagcgaccgcgcgcgtggcgctcatagcaatgccagctccaaggccgagtggcgtgcccgcatcgacgatgtggtggcccgtcatgaatccggagcactgccccggcatgaggctttcgtcgaattgtccgtcatcgcccgtgatttcgccggtgccgcatcaggcaaggagcttagttccagtacgctgaccgatttggcgtacctgaatcgcacgcccgcgaatcgccaaggattggacgcattgaagcagaccattggcgcgttgtatccaccggaatttgccgatgatgcccgcaaccgaatcgcccagacgaccagcgtgcagcaggccgccgagtgggtggcgaatctggtggaaaggtggcgttcatgatgctggcatggcattggccttgggccgctctggccggcgtcttggcgacgctggcgattatcgtgctgattgtcgtgttcgcccgccgtaacgccgccgacgacacccctgtattctcgatggacgacgatctcaataccgagcacgcttcccgcctgttccgtcaatggcgcgctttgggccgtctcgccatcagcgtgctggtgcttgcgctggcgctggccattgtgctggtggctcgccccagccaagtggatgccggtgacgaacgcgcttccagccgagatatcgtcctgtgtctggatgtgtcggggtccacgctcccctatgatcgcgaggtcatcgacacctatttggaactggtcaagcatttcgagggggaacgtatcggtttgagtatcttcaactcgacctcacgcacggtgttcccgctgaccgacgactacgaactggtcaccaaacagttgacctccgccagcaaggcgctgaaaggcgtcgagtcgcaggatgacatcgataagatgtccgatgccgaatatcaggacatcgccaattggctcgaaggcacgcagaaccgcaaggacgccacctccttgattggcgacggcgtggtgtcttgcgcggcgatgctccccggtttcgcttatggcgaagccaatcatgcgaatgccgaccgtcagcgtgcggcatccatcgtgctggccaccgacaacgtcgtgtcgggcaagcccacctattcgctgaccgaagcgttggatttgacccagcagaccaaaatcaccgtggacggcctgtattccgggccgaaagccagtgaatcggaccaaaccacaacggatatgaagtccgcgatcgagtcgcatggaggcatcttcctcacccaatcgaatggcgcgtcgatagatgagctggtacgggatattcagtcgcgtagagatacggatgtggagaacaaggcgaaatcctcgatggtggacgctcccggtctgtggacgcttgctctggccgtgatactcattatctggatcgtatgtgcatggaggttgaggcgatgaacggattcaccttctcccccgccttgggctgggtcgccggcggactgctggcggccgggctcgccgtactggccattctcgaaatcgcattatttgttcgtcgccgtgcttccagtgacgagaccgtgtgggcttgcatacgacgtacgcttatgctgctcatcgtcgcggtgatggtactgactcccagcgtggtatcgtctaccacctcacaggccatcaatgccaccgacgtcattgtggcggtggataccaccgggtcgatggcggtggccgacgccacatacgggtccgagaagaccattacccgcatcgatgccgcacgccaggccgtgcatgatgtgaccgccgcttatccggacgccagtttcgcggcgttacggttcggtgcttcggggacgcttgatgtgccgctgaccccggatgcgccggccatcgataattgggccaacacgttggcggtggaagccacatccgtgtcggcgggctccagtctggatgctccgatcgatcaattgctgctgaccgtgaagtcgattcgtgaagcgcacccggatgatgcgattgtgctgtacctcatcactgacggcgaacagacctcgaatgtgacgcgtcgtacgttctcgtcactgcgccagtatctcaatgatgggtttaccgtgggcgtcggctcgaccgagggcggcaagattcccgtcatcgccgatggcgtcagtgccggcgattccaacaccacggaccactgggtggtcgacccggataccggcgaacccggcatctccaagatggatgagaagaaccttaaagacattgccgacgagatcagtggcacgtatgtggccgtgaacgcttcacagactttggcggattcggtttcggccaagtcgtcgaagcagtggcgcatgaccaccacggtcagggaacgcacacgcaccacgccggtggtatggccgttggccattgcgttggcgatattgcttgccatggaagtcggtgcatggatcgcaacctcaaggagactgctgtgagaaacagtaacgaaatccacgagaacgatggctcggcgaatactcggatgcgggcgaagtgtccgctttgggcacgtatcgtcctggcttgtggcgccgtattgctgttgctggttgccggcgtggcggcagtaaacctgtccgcttcgattacgttcaatcaggccaccgcatcattgaacgccaatatcaaagcggctcaggacgagtccacggatatcaccacgctcaaggcgcaacagcagcagaccgacgcgcaattcgacgaggccgggcgaatgcgcacgcttctgttgccgcaagtcaaggacgccatcgacaccaatgcttcgatttcttccgagctgacaaagatcaccctgaaacaggccgaggcgcagaacagcggttccgattccgggcaagcccagtcggcacagcaatccgagaattcttcatccaatgccaaaaagggcggcgcgttgaccgacgaacagaagaagcaggtcgaggagctgatgaaggccaatcagcaatccaccgatacccagtcgaacaccacccaatccgagcagaaagcgacgcagaacaagggtaccggggctaccaagccgtggtaagcagtcgttcacagttgttcttttttctcacaccctcacgggtcatggctttatcgcggctgtttcccggtttcggctgtcggctttggcatttatccaattttcgataggccatggctgatccaaggtatgtccaaacaggctatttgtggataatcgttacgactatgcacaacacttggggataacttcacccaaaatcggcaagctagaaccacattggtcgttccggctggacaagcatgagtcttgtccttttagctggatatatgaatacctacaccagcaacccagcacccatcgatcccaccggcggctttgccggcaatacggtgacgccgttcgattacggcacttgcccttgccatgcggcggtacagcgtagtcgcgacctcatgtccgtccagcgtgcggccacactggcgcaatcggaccagacggcggtggccgtgaaccgctccagcaacatcgtgtggaccggtaaagccgccgatctattccgatcgcggctcagtcgcaccgcacagtattcggccagtctcgcgcaagacatggagaccacccaccgattggcttgggggtcgtcatgagcgagcacgattactggcaagtggaatcgtccgtttacggcggagtgggatatgcgccagccactcttgaagaatatgccgccatagccaaggctctcgatgacgaggcggcaggatttgcggccatagccacggcttgggaatcggccgcattacagttgcagtcacatcggcatagtgcgccgatgtgcgtcaccttgcagtcgggcgatccgagcgccgttgttcccggccatgtcactgcaccatatgccgcgctgggcaatcggtgttatgaccatgcaacggcatgtcagcggttgagcgatgatctgcgtggcgcggccgatctgctgattcgcgcacactctctgtattctcaggcggagatgacggctcggcgcatgtttaccgaattattgcaggccggcacacaggccaaaccgggatatgccgcggcgggtgttgccgctgtggcggcgggcggctttctggccggctggactattgacggcaaaccgaacccggcatggatgtccacgttcacctatccgttccaggaaggagtgcttagcggcgcgggcggaatcattggcggcgtacctatcggcaagagcattgcgcacaccgatgaggtcaacaaggctgcggggaaaatcgccaatttctccggcccggcgaaagacgtcgtccaaggcaatcatctggacgtgcgcgaggtgcaggcgaatgccgacgttgtccgcgcaagcggatcggtggccgagtcaatggagaatctgcgcaggctcgccgaagagcggctcggcaaaatcgagctgaacagcggactcgaatatgggaccatcgccattcaacgctatgaacgatctgatggaaccaactcctggctggtcaccatcccgggtaccgatggacagcctgactcaccatttggctgggcgcagaacgtggaactgatgagcgccgatcaggagcgccgcaggaaagcggacagcgctcgcatggttgccgaggcgatgcgtcaggcaggcatcggcaaggatgagcccgtggcgctgatcggccattcccagggtggtatcgttgccgccacgcttgcctcggattgggcggaggaatataccatcgagcatgtggtgacagccggatcgccggtggccaatcatccgattccgcaacgcacgtgggtcaccagcgtggaaatcgatgatgaactggtcgccgcactggatggtgccgccaacccggtcaccgataactggctcaccgtacaagggcatgtatcgcccgcgcccgcggcaacaccatccacagtgcattcggacggctcatgcactcccggcgcaacgcccatcaccggtctgaccccatatgacgccgcacccgtggctggttcgaccaacggcagggagttgtcgcactggatcaaataccatcaggccgcctatcagaacgccaccgacctcggctcccccgccgtgcaacgccacgaagcccatttccaggaagttatcaacggagagctcaaggaaacccgctactaccaaggccgcatgacccagtccgcgaccattgcccctagcgagcgaaccaccgagttcagcacgttcggcggttaaaagtaaataccacacttgacagagttgtcaagaaaggagttaacaatataatgacgagtaggagatggctcatcaaactgatgaagcaagcggcagaacgcaagaatgtcacgtttgaaagtatcaggcaaggagggagtcatgagatattccaactcgatggacttatgattccccatcccacgtcataacgaaatcgacaacaacctcgcggacattatttgcaaagaagcagaagccaaactcgggaaaggctggtatcagcagtgaaaacatatcaggtcatcgttcgtcctggcgaaaaatactggattcttgagattcccggtatcggtttcacgcaggcaagaacaacagcagagattgaaagtatggcacgcgaccttatcaccgtcatgacacaagatgctgatttcgcactcaccgtagagacaaagctgccgcaatccgtgcaggagcatcttgatgaagctcggcgactgcgcaaggaagaagcggaatgcagatcgaacgcagcgcgggaaactcgcgccgcagcacaagaactacatggcatgggtctcgccctacagcaaataggcgatatactcggggtctcacggcaacgggcacatcaacttgtcaatgcttagcatcaatcggctaccccacaatgcaatcaccgcagagacgcggctagcgccactttcccgggattgttgcgctagcatgcccgaaaccccctctatcagcgcaacattcccgggaaagtggcgcgcaaagagtgtcaggcgcgtcgctcgatgagtgcgcggccggatgcgaggcggtcgagcacaccggttttggcgatggccagcatcagatacctggccatcacgccgctgataagcacgccgccggtgacctcggaaatcatgtgcacaatgccacgcgggctgacgaatgacacacccacgtagcgaaacagcatcagatatgtgccgtattccaaggcgaccaacgcaccggatgcaatggaaatcggcagattgaacatgcggtaacgggtcaaggcgaacggaatctcagcgaaaacaccttgcaacagcgccgagataatcacgaagcccaaatcgaactggctaccaatcaccgtttcgaccagcgtgccgataaggttcacgtacagcgccgctccgggtttgcgcagaatcagcaccgccagcgtaccggagaagtaccagacggcgtgcacgatgctggcgaaaccgggcagaatcgcgccgaataccgaagagatcggcatgtacgcgaagttgaatccccagaagatcacgccgcaggccgcacccagcgtggcaccgaccgcgatatccaacggctgccatttcagtgacgatacggcaatcggacgtttcggaagagtatgaatggtggttgcaggcatggtgatctcctagccttaaaggccgcacacagtaatcgaaccacgggcgttccttgacctgtgcggctcgggcgggaacgccgcaccacagtatagccgctcggttcacggctggaagtacccttggaggttatgaagcttaccgatatttcccccgcaatcgcattgaccccactcgacggccgttatcacaaggccaccgccccgctcgtcgaatacatgagcgaacctgccctgaaccgcgaacgcatgcgtgtcgaagtcgaatggatgattcttctggccaacggctttgagggcaacggcaaccagccgatcgttgacggcgtcaagccgttcactgccgaagagcaggccttcctgcgcgccattcccgaggacttcggcgccgaaggcatcaagcagcacgccgctcatgaggccatcacccaccacgatgtgaaggccgtggagtactacatcgatgatcagatcgacaaggctccggccgagctgaccaacatcaacgacgagctgaagaccctcgtgcacttcgcctgcacgtccgaagacatcaacaacctctccatcgcccgttgcgtcaagaacgcgatggaaaacgtgtggaccccggagttcaagcgcatcatcgaccacctcgccggcaaggccgaggaattcaaggatatgccgctgctctctctcacccacggccagccggccacgccgaccacactcggcaaggagctcgccgtctacgtctaccgtctgaaccgtcagctcaagcacatcgaaaaccaggagtacctgggcaagatcaacggcgcgaccggcacgttcggtgcccacttggccgcatgcccggatgtcgactggatcgctgtctcccgcgagttcgtcacgaaccgcatgggcctgacctggaacccgctgaccacgcagatcgaaagccacgactggcaggccgagctgtactccaccgtctcccacgccaaccgcatcatgcacaacctgtgcgtggacgtgtggatgtacatctcccgcggcgtgttcgcccaggtgccggtcaagggtgccactggttcctccaccatgccgcacaaggtcaacccgattcgtttcgagaacgccgaagccaacttcgagatcagctgctcgctgctcgacaccctctccgccacgctggtggaatcccgttggcagcgcgatctgaccgattcgaccacccagcgcaacatcggttccgcgctcggctactccttgctcgccctgaccaacctcatgggtggccttgagtccatccacccgaacacccacgtcatcgagcgtgagctggatgagaactgggaggtgcttggcgagccgatccagaccgccatgcgcgcctgcgagctcaagggcctgccgggcatggataagccgtacgagaaggtcaaggagcttatgcgcggccacaccatcaacaaggaacaggtcgagcagttcatcgaccagcagtccttcgacccggaaaccgccgctcgcttgaaggctctgacccccgccacctacaccggtgtggccagccagctcgtcgctttcggccgctgagataggcgcgatgcgagtctctcgagtccctcgagtccctcgaatccttcgcatccaccacactactgcgctgagtcacaaaccgaaccgcaaactgaaccgaacaaggacaggcgtcaggtgaccatttcatgactactgaacaggatcagtccactacggaagatcgcccgaacaaggcgacctcctccactaccgaccggccgatcgcctctggtgacggccggtcggccagttttgctgtcagcggaccggacagcccggcaaccgacgacagcaacgattccggaccatacatcgacgacatcgctccgcgccgcacgcgcgacttcggcgacctgacccgagccggtctgtcgctattgatggccgccgtggtcatggtgttcgccgtgtatctgggcggcatgacgcgcggcgtcgaatccgacgcgcataccgccgcccaagccatcaactggctggctgctttcccctccaccgtactgacgcagctggccaccacggtcatcgtagttatcgtgctcgctcagttgctcttggcccgcgaatggctgcaagctgcggtgtccgcgctggccatgtttgccggatacggcattgtgtgggtcatatcgacggcaatcagcagtctgaacgatttcaccctgccaatggcactggtctcagccgccacctcatacggctccgggctgttgcccgacatctacgccggcatggcgtccttcctgaccgccgccgggccacgccgtacccgctccacggtcaaatggagttggaatatcctgtatgccatcgccgcggtgatggtggtgctttcgtggcattcggttaccggcatgctggtttcgatagccgccggtcgcacggtgggcatgctgatccgattcgtggtcggcacgcagaacaagggcgtgtggggccaagatctggtcgccgccctgaaaggcatcggactggacaccgcctcgctgattcggcatcaggagcccggcgtcggccacggttcactggccgtcacgctggacgacgatctggccgaaggctcgcgcatctacgatctggataccacggacaaccgtcgtttcatcgtttccgtcatcgacgcgcagacccataccgtcggctatctgaagcagttgtgggactgggtgcgtttcaccagtgtgtccatccgacgtgaccgttccgtgcgtgacgccgtccagcatcatttcgccatgctgctgggtctgcacaatatcaaactgcccgcgcccgcaccctacggcatcgccgataccgacgaatccgcgattctggtgctggatgcacacaccatcgaactgcccgccaacctgaacacgcttaccaaggcggatgccgtggcctacatgcgctacctgtccgtggcgagccggcgcggctatacgcaccggcgcatcacgccggacacactcgcccggcttgaagacggcaccgccgtgattgccggctggctcaacggcgacaacgcttccggtccggccaacaccgcgctcgacaaagttcagctgctagtgctgttcgccgcgctgatcggcgtggaaccggcggtggaggccgcccgcgaggcgtggggagacacgactctgacggccttggccccgttcattcagaaggtcgcggtcccctcccccacgcgcgcgctggaatcctgggacaagcagctgctcaagggcctgaggagtcgtatcaccgcgctggctgacgaggagacggtggaatccgccgaaccggtgacgctggcccgattctcctggcgttcgatgatcaccatgctgctggtcatcgtggccgtggtcgtggtcttcacccaactgaagcccgaggagatcatcaccgcgctgaccaacgccaacccgttgatggcggtggtgacgctcgcgttcggtgtctgcggctggatcggctcgtcgatttcgctcggttccctgatggcgcggcacaagcgtgacaatatgggcgtcttcatgagccaggtggcaggcggcttcgccaccgtatccatgcctgccggcgtgggcccctcgttcgtcaacctgcagttcctgcgcaaatccggctatcgcaacaccccggccaccgcaatcatgagcgccgcgctcgtggtgtattacgccgtgtacttctccatgctggtcatcatcggcctgttcaccggccgcaacatgttctccggcgcaatcccgacaaacacgttggttatcgtgctgggcgtggtggttgtggtgctgtccattgcgatgatgattccgccgttgcgccactgggtgacccgtcgtcttatgccgctggccaagacgtatatcaaccagctgctggacgtgctttcccagccccgacagctcacagtcagttgcctgggcgcgctgttccagaacgcgaccactgggctcgctttctgggcggccctgcaagcgttcggccattcatcgaatccgattgaaacgacgttcgtcttcctgctggcctatgcattgggttccgcagtgcccactccaggcggtctgggcggtgtggaagcggcgctgacattcgcgttcgtggcggtcggagtgccgcagggcgtggcgctttccgccactttgctgcaccgcgtggtgttctactggctgcgtattccgctgggcgcggcggccatgaagtggcttgacaagcataatcttgtctgattcgtctattttcatacccccttcggggaaatagatgtgaaaacccttataaaacgcgggttttcgcagaaacatgcgctagtatcattgatgacaacatggactaagcaaaagtgcttgtcccctgacccaagaaggatgctttatggcatacaacaagtctgacctcgtttcgaagatcgcccagaagtccaacctgaccaaggctcaggccgaggctgctgttaacgccttccaggatgtgttcgtcgaggccatgaagtccggcgaaggcctgaagctcaccggcctgttctccgctgagcgcgtcaagcgcgccgctcgcaccggccgcaacccgcgcactggcgagcagattgacattccggcttcctacggcgttcgtatctccgctggctccctgctgaagaaggccgtcaccgagtgaccttctgctcgtagcgattacttcgagcattactgacgacaaagaccccgaccgagatggtcggggtctttttgttgtggtgctgtgacgtgttgtccaaccgtattattccggactagttcagcgcttccataagctgctcgaatcccagggtgggctcggcctcgaagggatcgaggagtatggcttcccggcgttcgggggcggtcagggtcaggtgggtccagtcggcggagaactgggctccgacgttcagggccgcgtccacgaaccggccacgcagggcggcacgggtgtcggtcggcggattgtgcacggcgtattccacgttgtctcctgtcagcagctcacgcatctggttgcgggctacgagcgaaccgtacaggcgaccgttggcgatgtcgtggtagtcgagctcaagctgttccatctgggcgaaggtgacgtccgggcgacggcgtttgagcgcgtcgaacagacgcttcttggcggcccagtccacgcggtcggcgagcgcatcgtatgcaccacgctccagcgcgtccagaacgcggctccactcccccataatcgtgtcgatcgtggtggccggcagcgaacttgccagcgcatcgacatgggtttcgatgaaggccttgaccgccgcataataccggcgctgcagacccagtgcagacacggattcgcctgattcgagcgtcagttcggcgtgcggattgtcaaggaatcgactgaccgtgcgattggcggcagccggatcagcaaaggcatactgctcgaatccggacggagtgccgtggcggaaggcgtcttcgatcgcgcacagcacaaggtgcgtgacggcgagcttcatccatgtggaccattgcgaacggttcgagtcgccgatgatcacatgcagccggcggaaggagtcggggtcggcgtgcggttcgtcgcgcgtgttgaccatcgggcgggagcgggtggtggccgaggagacggcctcgtccaggaagtccgcgcgctgggtgatctggaagccgtccggggtcatgcggccggcaccggtgtacagctggcgggtgatgaggaacggcagcagctggtgttcgatggtctccaacggcacgaagcggcggaccaggtagttttcgtggcagccgaaggcgtggccggcggagtcgacgttgtttttgaacacatggatcgtggcgtgtgcgccgtaggattcgcgcagcttgcgctgggccttcagggctaggttgcgcatcacgtgttcgccggcgaggtcctgggccagggcctcgcgcgggtcgcgcgcttcggcggtggcgtattcggggtgggatccgacgtccagatacagacgtgagccattggccagatacgtgttggtggagcgggaacgggagacgatgggctggaacatggtcatcgccacctggccggcgttcacggggcgttcggcaccggtgaccgccacgccgtattcggtttcgacgccgaaaatacggcagaacccgtccatctcggcggatggtacgggttccgtggcgtgcagggagcgggtgccgctgtcacgcagttggggcatcactcgccgcctttttgcacgaagctgttgacgtattcctcggcgttggtttccaaggcggattcgatgtcgtcgaggatgtcgtccaacacgtcggcttggtcggtggactcggtttgggcggcggcctgcgtggtggcgagggcgtcgtcttcctgggtcgcggcctgctgtgcttgaggttgttcgaattgttgtggcatgttgtcttctttttgggctgtcaaactcccctcagtcagccttcggccgacggctcccctcacccgaggggatccggaggagtcaaaaaattatcgctggttgatggagtcgagccacggatactgctgcaggtaatgctgcagttcgcggatgatgagtccattggaggccactacatcgttatcgtgacgccagtggatgcgttcgccgtcccaacggctcagcgtgccctgtgcctcccagaccactacggtgccggcggcgatgcccgcgatatcccacacgtgcagcatcggctcgaagtaggcgtcataggtgccgtcggccactttgcacaggtcgagcgagacggggcccacgcgcttgatgtcggccgggcgtccggcgagcgaggatgccacgtcgagcgcacgctgcgattcgccgggcaagaaggacatgccgtagcccagcacggaaccatccagcgaggaggtcatcgacggcacgactttgtcgcgcttttcgccgaccgtggttttgtggatgcgcacggcgcccgctcccctggcggccaggtaggtcaggccgagggccggggcgtgcacgatgccgatgatcggcttgggctcattgtccgggccgaattcgaacagggcggcggtcactgtccattcgctcatatggcgtacgtagttgatcacaccgtcgattttgccgatgtaccagtaacgctggccggggcggctttcggcgggtcgggtggtccagaagccgtcgaagtgggcgatgtcggcgattctggagctcataaagcgcaaaatcttgctgtcgacttcgagcttatagcgggggccgcgatcagcttcggtgctcggctgggcgaggttacgcggattgagctggtcgtggagggcatgctgaccggcttcttcgagaaggccggcgactttgagcgcaaggttgcgcaggtcctgtggggtctcttcgcgtgtttcttccatagctaccaagtctatcgttcggcgttgatggccagcgacttcagcagatcgatggcgtgttcggccgaattgagttcggtttcgcagcgcgccttggtgaaggcgagcggatcggagatgtcaagggagaacaggtgatggtcggtagcggccatatggccggcattgccgtagaattcgacagcctcgccctcgtctgcggcgtgcgggtcgcgaacagtgagtcgggaccagctggcggcggccacctcgctaccgaatcgtgccacgagtttcgccctgagccaagcgcgggtgtcttccggaggttcggtggcggcgcgtgcgatgtcggcggcgctcatcacccgttcggtacggggttcgagtttggtgaagatgctgtccgcggggtcgagcgccgcccatttcaggtcgatgaccttcagtcgcgggtcgttccagccattggccacgctgggcgcagctgccgcggtgattttgcggcgcagtttttcgagcagctgccatttgagcagccattcgatgcggctggcctcgccggtcatggccagacgttcgtcatcgtcggcggtgtgacggatggaggcgcagtcgatgagcgcctgctgccacattgccatgatggatgtggtggatttgtccggccaggcgggctcgccggcggtgtcggtgccttcgaccagtgcggcgacctggtagacggcttggcgcagtttgagctggataagccatgcgttggtttcgccgccgttggccagcggcaggcttgcgcccagcgtcaggtcgtgggagacggtgtgcatggcttcgaccgggtcggccagttcgagttcgtcgaggaaggcgttcagatcgaatccggcttcgtccgcgtgttcgagcagccacagcagcatgctcgtggtgccgagtttcagggcctgcggtacctccatacggttggcgtcgccgacgatgacgtgcaggcggcggtattcgtcggtggagtgggattcgtcacgcgtgttgataatcgggcgttcgaaggtggtttgcaggccgactttgacgtggatgtagtcggcgcgctggctgagctgatagccggggatttcgctgttctcgccgattcctacgcggccggagccggcgtagatctggcgggtgacgaagtggagggtcatcaggcgcgtgactaggtcaaatggcactgagcgggccatcatatagttctcgtgcgcgccccagcaggagcccttgccgtccacattgttgcgatgcagggcgatgggggtgccggtctgtgtgcgggcgcgttcggtggcggcctgcatgatgaggtctccggcacggtcatagcgggccgcttcgaacgggtcggtggtttccggtgccgagtattcgggatgggcgtggtccacgtagacgcggccaccgttgggggcgatcacgttggtgatgttgagttgtggggcgtcggtgagcatgtccggtcgggcggcggcacgttcgagtcgggtgccgcgcgcgtcgttgaccgggtcctcctgccggtagtcccagcggatggatttgctgtggctgtccgcggcgccgttcaccacgtcgaaggacagttgcaccgggttgtagcggtccggggtgttcagggataccgcgtattcggtttcggtgcccatcactcgtttgacggtcatgtagtgctccttgagcttgagctattcggcggtgcggatgcggcggatcgggtccatgccgttgatgcgcgaccattgttcggggtccacgtcggccatggaatcgcgggtctcgcggtattcgtcttccacggcggcggcgagcaacggcacggtgagtgccacgtccgagccggtttcgatggattccttgaccgctcgggtcttggcccggtccacgatgttcttgagcatcgcgccggagaccacatcggccaggaacaacgcatgccactggccgttctcctcctgcacgtcgcacagatggcggcgttcggaggctccgtaaatgtcatgcaccagcacggcggacaaggcgtgcgcgtcgacgccatcttccagaggcaggtcgtcggtcaagtaatggtccacgatggcgatggcctgattggctttgggccgaccaacacgaatcttgacgtcgagacgccccggtcgtagcacggccggatcgatcatgtccacgcggttggatgcgccgatcaccatcacattgtcgagtgattccacgccgtcgagttcggagaggaactggggcacgatcgtggtctccacgtcggaggagacgccggagccgcgggtgcgcagcagcgaatccatttcgtcgatgaaaacgaccaccggattgccgtccgcggcgcgttcgcgggcgcgctggaagatcaggcgaatcagccgttcggattcgccgacgtatttgttgagcagttccgggcccttgacggacaggaacacgcctttaacgcgggtttcggccgggctgatcgagccgtcgccgttcgtatcgtaacccccctcgcacagggcgttcgccacggccttggcaatcatcgtcttgccgttgccgggcgggccgtacagcagcacgcccttcggcggcttcaaatcgtaacgctcaaacagcgcacgatgctggaacggcagttggacggcgtccctgatacgaccaatctcactatccaagccgccgatgtcggcgaacgtgacgtccggggtctcctccagcaccagatccttgtcgccctcggcgggcagcgcttcgatggcgaggcggacggacggatcgacgataatgcggtcgccctgattgatacccgcatacgcgagcgcgccggaacggcggatgagcacgggattgccggaggcgtcggtaacgatcagtcgaccgtcgtcgagtacctgcttgacactgcgaatctggcccacggtgtcagcgtcgcgctgctcgaccagcacgagcttctcgttgagcatcacggtggccccggcggtcaggcgggcggcgttgacgttggaggccacaggcaccaccatgcggcgggtgccggaaatgacttcggccgacgcgtgctggatgccgtcttcatcggtgcgggtggaatcgaccttgaccatggtggcgaaggtgagcggcggctgagcgagctgggcgagctgtgacttcgccttggtcagttccttgccggcgcggctcagcgcttcggcgagcgcatggttcttggccatcaggcgatcgttcagcgcggcgagatcttcggtgtcgctcatgcgggttcttcgcttcccttctatccgggattgtcggcaacttatggcagtcggcagaccctattcgttgccgtcggaggatttcctgttacgtatcacagtacgcacttttcgcaccacgaaccatacgatgatcacaatcacggccgcgatgaccacgtcctcgaacacgccgagcgcgccttgaatcgagcaccactggtcgccgagcaggtaaccggcggaaacgaggatggtgttccacacggccgagccgagcagggtccagccggtgaagtgcaggaagttcatgcggttgaatccggcgggaatcgaaatcagcgagcgtaccacgggaatcacgcggccgatgagcaccgaccatgtgccgtatttggtgaaccagtcgttggctttgctcacgtctttgcggctgacgccggggattttgtctgccgcgagattgatgcgatgcaggcccacccagcgggagatgccgtacaaggtccaggcaccaagtacggagccgatggtggcccagatgattgcgcccggcaaactcaaggtgccgcgtgcggcggtgaagccggcgagcggaaggatgacttcggacgggatgggcgggaagatggattcgagggcgatggccaaggccacgccgataccgccgatggtttccatcagcatgatcagccagtcggtgatggtgccgatcaggccgggttcggtggtggtgcagatgggcgtagggtcggtcgcaagaatagtggcggctgccatggaaaaactcatagagggcattgtcccaaggttttccaagaatcagaagcatgacgcaagaagatgtgcattttattgacaagtccgccgagagcgaagttgggagcccggctggttctgcggtttctgtgccgacgctgagcgagcccggcctgctggttatggatgtggactccacgctcattgacgaagaggttatcgacgagttgggcgtggtggctggctgcggtgaggagattgccggagtgaccgcacgcgccatgcgcggcgaactggagttctgcgatgcgctgcgcgcacgagtggccctgttggagggcctgccgatctccgtgttcgacacggtgcatgacaagctgcatttcaccaagggtgcgctggagcttatcgacacgctgcatgaacacggttggaagatcggcgtggtgtccggcggcttccatgaagtggtcgatatgctggcggccgaaggccatatcgactattggatcgccaaccggcttgaggttgccgatgggtgcttgaccggcaaggtgctcggcgaaatcgtgagcaagactgtgaagttacacgccttgcagacatgggcggaccgtttgggtattccgatgagccagaccgtggctgtgggcgatggcgccaacgatattccgatgattcaggccgccggtctgggtctcgcgttctgtgccaagccaaagacccagctcgccgccgacaaagccatcaacgaccgcgacctaacccacgtactcgattacctgcgccggtaaaattttaccgacctcggctccggcacttatagttgagccatgactacttcaggcgcagaacagttgacgcttgcggggctggctccccgcaagcggcgtaaacgtgcgcctgcggagcatacgccggccgagcagcatcccatagcgcaagtcgtgctggatgtgcaggcgctccacctcggtcagacattcgattacttcattgatgaaaaagacagcgaggccgcacaaccgggtgtgctggtgcgcgtgcggtttggcagtcagagggtcagcggtgtgatttgggcacgcaccgataccagcgatacgccgcgctcttcgattcgctatatcgagcgagtgctaagccccgatgtactggttcccgcttcgatgcgcgaggatatcggtctggttgccaaagcctatggcggcacacgggccaatattctgcgtttcgccgtgccaccgcgcgtggccaaggtggagaccgagcagcggttggccgcgtcgttccgtcggccggtcggcggctcattgccggataatacgcaaggcggttttgccgggcgtggcaccaatcccgatgggaccaaacctgctggctctacctttgccgttgctagcaccgtttcggagggagctgcgcaggggtatcgtcgtctgaccgccaattacgccgatgtcaatgtgcttcatgatgcgcttaccggtcaacgtttccaatcttttgtgtttgattcgttgcccggtgcacaggagtggcaacggaacatggcatggatggtggccactgcgttgagtgccggtaaggctgccgtagttgaattgcccaccatgcgcgaggtcgaagacctgatgcatatgctacgcaattatggactcaaaccatttgccccggttccaaccggcggatggatgggcgatgtggccgtgctcaatgcgaagaccatgcctgcggccgaccggtaccgcacgtatctggctgtggcgttgggccaggtgaaggtggtgatcggcacccgcgcggtgatgtatgcgccggttgaaggcccggcactgttcgccattctggaggatgccgcctatcagaacatggacggtatgatgccgtatccacaggctcgcggcgtgatgcggttgcgcgccaagtcccatggcggcgtattcgtggccatggccaatgcgcgcactccgcaaagtcagtgggaaaacaccggtccaggtacggtggaaactccggtgagcggctattccaccgcgattcatccgcttgcctcgccactgaaggatgcgacgccttgggtgcgttggctcaatcgcgatgagcttgcgcgtctcgctgacccgtccatcggggcgcgcgtgccgcatacggccgtccgcgtgctatctaaggctttggaaagtggccccgtgctgctatccattccgcaagacaatgtcagtgagaccttgagctgtgcgaaatgccatcgtcaggtgcgttgtgccaagtgttccggaccgttgcaactgccggccgaccgccgggattctacaccgcgatgccgctggtgtggggctgccgccatcaactggaagtgcccgggctgtgggcatgaacgtatgcgcgtggtgcgcgtgggtgctgcaggcactgcggctgaactggccggattgttccgcggcgtgccagtagttttgtccagcaagacgcagggcctggtgcgcgatgtggcttgtcagccgattatcgtcatcgccactcccggtttcgaaccgcgcgtgcgtccggtcagtgccgagcagggatcggctggccatgagtatcgtgccgtggccgtgctcgacgcttggaccagcttgtatgcgttgggcgtggatgctcgcttggatacattgaccgcgtggatgcgtgcggtgtcgttgtgcgcgccgcgttcccgtggcggccaggcgttgattctcggcgaaaccgacccggccatcgcccaatcgctgatgctctgggattcgaggattcttgcagccaaggatcttgaggagcgtgtggagaccggtatgccgccggccgtggccgccgcctgcgtatggggacgccgtgatgcggtgatgacgctgatgcagcgtatcggcgcgctgggcggcgattggacggcctgcggcgagctgcccggcatgttgggcccggtgccgatcgcgcaaccggacacggtcgacgcccgggagctcgaagccacggacgaccgggtgaaggcagtaatccgtgtgccgcagagtcggcgagccgagctggcggcccgactgcaccgggaaaccgctcgtcatgtggcgtcccgcgaacccggcgagcttcgcttccgagtagatcccaaggacctgatctaatcgtcttcaacacgtgaaacgataattacagaacgaacatcgctagaaggaggacactatgaagggttggcctggagagccggatatggattacgacgtgctggtcgcggatggcgaggccgctgcgaacgccggcaagccgatcaccgacgtgatcttcgatttcggcaacgtgctgatttactgggatccggtcgccgtgctcatcccccgctacagccagaagaccatcgacgaattcctcgacaacgacatctccggcttctacgatgtcaacgacctgatggacggcggcaccagcaccgacgaggccatcgccatcatgcgccgtgacaagggcgataagtgggcggacatcctcgactactacatcaagaacttccgcgactccctgaccggcatcgtgccgggcgcgcgcgtgctggtcaatgacctgaaggccgccggcatcggcgtgtggggcctgagcaactgggaatccagtctgttccacgtggccgaggaacagtgcgatattctgcagcagcttgatggcaagctcgtctccggttttgtcaagctgcgcaagccgcacaaggaaatctacgaggccgcgttgaaccagttcggcatcaaggccgatggcgcgttgttcatcgacgacaaggccatgaacatcgtcggctcgaatgcggccggcatccgtggcgtacgtttccaggatccggtcaagctgcgtgaactgctcatcgccaatggcgtgaacattccggccgtgcagtgagcatcgacatttcaaggaggaccatgctcaaactcgtgttcgccggcacccccgacgtggcggtgccctcgctcaaggcctttgccgccgacccacgttttgatgtggtcggcgtcattacccgccccgatgcgcctaccggtcgcggccgcaagctcacgcccagcccggtcaaggcgacggctctggagctcgggttgcccgtcatcgatctcaaaccccgctcccccgaattcatggaggcgttgaacgacctgcatgcggatatcgccgctgtcatcgcctatggcaatatcctgcccaagaacgtgcttgatgcggtgcccatgggctggtacaacctgcatttctccaacctgccgaagtggcgtggcgccgctcccgcccagcgtgcgatttgggcaggcgacccgaccaccggcgccgacgtgttcaaggtcggcgagggcttggacgatggcccgatcgtcgcttccctgaccatcgaactgaccggccgtgagacctccggcgaactgcttgaccgtctggccgaagaaggcgcgcccatgtatgtggatgctctggccgccgtcggcgaaggcaccgccacattcaccgcgcagccggccgagagcctggaatatgcgcacaagatcacggtggaggacgcccgcatcagttggacggacgaggccgaggccatcgaccgccagattcgcgcctgcacgccacatcccggggcatggaccgaactgtttgcggaagggccaatcgccgataatgacgagtcaaccgctaaatccctcgccctgcatattctcgccgcacaaccggccgaccagtccaatcccaacactccggccgagcttcagcccggcgagctgaaggtgggcaagaagaacgtgtgggttggtaccggcagcacgccgctggaactcacccaagtcaaggcgcaaggcaagaaggccatgcgcgccgccgactggacccgaggcgcacgcctctcccccgccgcctgcgtgcgataacaagcaatatcgctcccgccttcggaagcacagtaaaggcccggcatcttcataaagaagatgccgggcctttcagctatgcaatcggcgatcagttgagaccggagagcttgttgatcagctccgggtcacgcgtcgcacccttgtcggccgagcgggcgaaggcggcgtacgccttcagcgcctgggagacgtggcggttgcggtgagccacgtagccgtcgccagcctcaagctcgcgacgacgctcgtccagctgctcgtcagtcagttcgacgttcacggaacgggcttcgatatcgatatcgatgatgtcgccgttcttgatgagcgccaccgggcccttgttggcagcctcaggcgccatgtggccgatggccagaccggaggaaccgccggagtagcgaccgtcggtgagcatggcgacctgtttgccgatgcccttgcccttgacgaaggaggtcgggtacagcatttcctgcatacccgggccgcccttcggaccctcgtaacgaatcacaagcgccatgccaggcttcagggtgtcgttcagaatgacctcgatggcctgctcctgggagtcgaccaccagagccggtccacggaacttccagatctccggcggaacaccggcggtcttgaccacgcagccgtcgggggccaggttgccgcgcagcacggcgaggccgccttcgtgaatctccgggtggttgatgtcgtggatggcgccgttggtgcggtcgcggtcgagcgagtcgaacagggtggtgtgcgtccacggctccggggagatgatgtggccaggagcggccttgtacatctgctgggcttcctcggtgcaggtcgggcgcatgatgtcccaatcggccagcttggcttccagcgtcgggtagtcgatggaatgcacgttggtgtgcagcttgccggcgcggtcgagctcgccgaggatgccggtgatgccgccggcgcgatgcacgtcggaaatctcccacttgccggacggcgaggccttgcagatgcacggcacggtgtgggaaatacgctcgatgtcgtccagggtgaagtccacgtcggcggactgggccatggcgaggatgtgcagcacggtgttggtggaaccgcccatggccacatccatggtcatggcgttctcgaaggcttccttggtggcgatggagcgcggcagcacggaatcgtcggaatcgtcgtagtactggtgagcgatcttgacgacttgcttggcggcacgcttgaacaggtccttgcggtaggagtgggaggcgaggatggtgccgttgccgggcagggccaggccgatggcctcggtcaggcagttcatcgagttggcggtgaacatgccggcgcaggagccgcaggtcgggcagacggtcttctcgtaattgagcagttcctcatcggagacgttgtcgtcggcggtggcgtacatcacgtcgataaggtcggtgctcttgactgtgccgtcggcgagcaccgtggtgccggcctccatcgggccaccggagacgaacacggtcggaatgttgaggcgcagggctgccatcagcatgcccggcacgaccttgtcgcagttcgggatgcagatgagggcgtcggcgcagtgcgcgttgcactgatattcgacggtgtcggcgatgatgtcgcgggaaggcagggagtagagcatgccagtgtggcccatggcgatgccgtcatccacggccatcgtgttgaactcgcgcggaatgccgccggcttccttgatagcctcggaaacgatgcggccgaccttgttgaggtggacatggccgggcaggaactcatcgaacgagttggcgatggcgatgatgggcttcttgcccatgtcgtctccgctgacgcccgcagcacggtagagggctcgggcgcctgcaaagacgcgccctgacataatttttgcagatcgcatttcagtcatggttctattcaagcctttgcgagggacacgccatttgtcaagagtcgaatagtggaattttcaaaaacgtaacgtttctcacagttttttttggaatacattcctctggcgagagtccggtatagggctgacagaagtccccccaaacggctacacttgcttcggttgagatagattttccaatgtctggagataagaacaatggcttttggtactgacccgacacccgacggtcttgcgaacccgccgatcgacgacctgatgaagcacgccgattccaagtacgcgctggccattttcgccgccaagcgcgcacgccagatcaactcctacttcacgcagctcaacgagggcctgctgcagaacatcggcccgctggtcgaataccagaacaatgagaagcccctgtccatcgccttccgcgaaatcgacgagggcctgcttgaggagaccttgggcgaggacgacgccaacgagggcaactgatcgattccgacaattcgtttggattgtttggacagttcgtcgccgaatgatggtgtgagagttctctcacaactgattttgagcgacacgcttgcctgagttatcgcaatcggctataactcaacatcgggagcgaataagacgcaaggctcgcgccaccgcgctggttggcacgagcctttatttatgcccgcttccacagtgacaagtaaaaattgacaccgtatcattgtgcctcgcatcccgcggggcgataagtcctgaagaaagggatgatatgacagaagaacatcggcttatttccgccgaatccgtgaccgaaggccaccctgacaaggtctgcgatcaaatctccgacgccattcttgatgatttgctggcccaggattcgtccagccatgtggccgtggagacctccgccgccactggcgtgttcctgatcttcggcgaagtcacgtccaaggggtactgcgacgtgcagtccaaggtccgcgaaaccctgcgcaacatcggctacacctcctccgaagtcggccttgacgccgattcctgcggcgtggtcgtggccatcaccgagcagagcgccgaaatcaaccagggcgttgcccgtctgactggcgatcaggagaccgccgccagccgcgaagagcgttacgaagcacagggtgccggcgatcagggcgtgatgtttggctacgccaccgacgagaccccgacgctgatgccgcttccgatctacttggcacatcgcctcgccttccgtctgaccgaggttcgtaagtccggcgaagtgccgcacctgcgcccggacggcaagacccaggtgaccattgagtatgacgatgacgataagcccgttcgtctggacaccgtgctgatctccactcagcacgatcctgaggttacgcaggattggcttgctgttgagctgaagaagcacgtgattgacccggtgcttgatgaggtgctgggttccaaggtgccgcatgacaactaccgtcagctggtcaacccgactggttcgttcatcctgggcggcccggcggccgacgccggtctgaccggccgcaagatcatcgtcgacacctacggtggcgctgcccaccacggcggtggcgcgttctccggcaaggacccgtccaaggtcgatcgttccgccgcgtacgccacccgttgggttgcgaagaacatcgtggctgccggcctggcccacaaggtcgagatccaaatcgcctacgctattggcgttgccgacccggtatccgtcaacgtggagaccttcggcaccgagcaaggcgtgacgcgcggccagatcgccgccgccgtacgcaaggtcttcgacctgcgccccgccgccatcatcgacgagctcgacctgaagcgcccgatctacttgaagaccgccgcgtacggccacttcggccgcacagacgttgagttcccgtgggagaagaccgacaaggtcgaggagctcaaggccgcgattgctggggagtgaggtgctctaattaggacagagagatcataagaataccataagaatagggtgctttccgctgttgatggcggaaagcaccctatttgtttttcgcagtgtcctacgaatctgttcttatttcaatccacgcaccccagtggggtgcgacgccacgattccaaggatcgtgtcgaccgcttccaatttcaatccacgcaccccagtggggtgcgacatgcgtatcctgctctgccacgcaaagtgcaggtatttcaatccacgcaccccagtggggtgcgacacgagtgtgagcgcatacgcctatgatgcaagttatttcaatccacgcaccccagtggggtgcgacctagataatcgtctaggctgatgtcttgcggcttatttcaatccacgcaccccagtggggtgcgacagcgcggtcatggtttcctccttaaaggatcgttatttcaatccacgcaccccagtggggtgcgacacctgcaactgtctcacttgacgtaccgttttgagatttcaatccacgcaccccagtggggtgcgaccaacacgcgactatcagccttgccatgcttagggcatttcaatccacgcaccccagtggggtgcgaccgttcgtcagatacaccgtatccgcgtacccgttattatttcaatccacgcaccccagtggggtgcgaccgtaacgggtggtgcccccgcagtcctcaacctcatttcaatccacgcaccccagtggggtgcgactcccttctgattatcagtcttcgtacaggtcatcatttcaatccacgcaccccagtggggtgcgacgagattattcacgccgttggcgggttcgatacgatttcaatccacgcaccccagtggggtgcgaccgacggcacggccacgttccggtcggacgcggttatttcaatccacgcaccccagtggggtgcgactacagataaccagttaatcagcgacactatgataggcatttcaatccacgcaccccagtggggtgcgactgacccgaacagtggcacggtacagcaggtggtatttcaatccacgcaccccagtggggtgcgaccatgcccaggaggattcggccgagcgaacggaaatttcaatccacgcaccccagtggggtgcgaccgaaaccgtcctgcaggcgggtcgattgtccgcaatttcaatccacgcaccccagtggggtgcgacttccccaccacgtccgccgtggggcgcgttttcgaatttcaatccacgcaccccagtggggtgcgaccccgcgacgcccgatcggcggactcccacgagaaatttcaatccacgcaccccagtggggtgcgacaaacgaggcacaggagccgcaagggaacgagcccatttcaatccacgcaccccagtggggtgcgacatcttctggttcgcgccgtcgcgtccgccaaatgaatttcaatccacgcaccccagtggggtgcgacacaagcgacacgctctatttttgttacagagatatttcaatccacgcaccccagtggggtgcgacggcgacaccatcatggacgccatcatcccgaccatatttcaatccacgcaccccagtggggtgcgacggcgcgcgtggtttaggtaagacatacggtatacatttcaatccacgcaccccagtggggtgcgaccgggcttcaccgattcaatgaaggccaacgtgttatttcaatccacgcaccccagtggggtgcgactgaccggtcttgccgtttacctgaccgtccaagggatttcaatccacgcaccccagtagggtgcgaccaccaccttggcggtagaccccgcgcccgtccaatttcaatccacgcaccccagtggggtgcgacttaattaccgtgtttggcgtccaaacattgtaatcatttcaatccacgcaccccagtggggtgcgaccgccggttactttttgtaaccgagtgtggtatgatatttcaatccacgcaccccagtggggtgcgaccgcaacgcctctgggaacgagccctaatagcctatttcaatccacgcaccccagtggggtgcgacgtcgtcggctgccacctcgcggttgtccacggggatatttcaatccacgcaccccagtggggtgcgacgcaacatcaccaccatctgggtgccggcgatcaaatttcaatccacgcaccccagtggggtgcgacccaaaaatctcacagcattaggcgtaaccgacaccatttcaatccacgcaccccagtggggtgcgacaaacctatggtcgatcagattacagagatgtatgaatttcaatccacgcaccccagtggggtgcgaccaggaggtcagggctcaaacgctcaagctacttcaatttcaatccacgcaccccagtggggtgcgacccgccttgtgtttccacccgtccggcgcgatggatttcaatccacgcaccccagtggggtgcgacgctgattccacgtgtccggcgtgccgaaaatggcatttcaacccacgcaccccagtggggtgcgacggtgcttgggacttcacgattcccgtgggtgtcttatttcaatccacgcaccccagtggggtgcgacacgatcccgcgtggcgatgccgggactgctggcgtatttcaatccacgcaccccagtggggtgcgactatcggccttcttgctggcggcttccttgtcgagatttcaatccacgcaccccagtggggtgcgactatcggccttcttgctggcggcttccttgtcgagatttcaatccacgcaccccagtggggtgcgacccgggcgattctttcttttttagttgttcaagagatttcaatccacgcaccccagtggggtgcgaccttgcctctccgaccacgcgcgggtcaaacatcgaatttcaatccacgcaccccagtggggtgcgactcaagccgcagcggatagtgcgagcaaggccgggatttcaatccacgcaccccagtggggtgcgacgtctacgttgtccatctgagttaccaactgagccaatttcaatccacgcaccccagtggggtgcgacgttgccgcagtattggcatggttcggtggtgatatttcaatccacgcaccccagtggggtgcgaccggtcttgctcatttgaatactccttcgcagtgatttcaatccacgcaccccagtggggtgcgacgaggccacgtccttggcgaggtccttgccctgggtatttcaatccacgcaccccagtggggtgcgaccgggcggaagctcaggttgttgaacatgcagtccgaatttcaatccacgcaccccagtggggtgcgacgcgctgatgattgggccgatctgctcgcggaagatttcaatccacgcaccccagtggggtgcgacccgcgttgctgatgccccacaattggccgttccaatttcaatccacgcaccccagtggggtgcgacttcacgcgccgtgttcatttgcaagacgatggtatttcaatccacgcaccccagtggggtgcgacttcgggcacgatctggcagtcgcagtcgtcgtgatttcaatccacgcaccccagtggggtgcgacggccatgtcacgccaggcactgcagcgcatgaaatttcaatccacgcaccccagtggggtgcgacccggcagcaaccgacgccttgcctaccttgtccttatttcaatccacgcaccccagtggggtgcgacgatgccctggccgtcgatcttgccgacgacggcatttcaatccacgcaccccagtggggtgcgacttgacgcgggtgatggcacgggtcacgtcctggtcatttcaatccacgcaccccagtggggtgcgacgtcatggctttccaagatcgttgtagccttcatcaatttcaatccacgcaccccagtggggtgcgacacgtagggaaacacgttgtcgtaggtgtcgtgatttcaatccacgcaccccagtggggtgcgaccacgcaagggctgttgatggcgtcgcccgccttatttcaatccacgcaccccagtggggtgcgacaaaccgttctggttcagttctatgaccttcttgttatttcaatccacgcaccccagtggggtgcgaccatcaggcccaaaaccgtggccacgccgccacagatatttcaatccacgcaccccagtggggtgcgacctcaatgtcacggcaccatgtaccgggcagggatttcaatccacgcaccccagtggggtgcgacgatatcaccgccacgctgttcggcgtgtccggcaaatttcaatccacgcaccccagtggggtgcgactctgcggccggttctccacacggttcacggtcgtatttcaatccacgcaccccagtggggtgcgaccgccactcaacccattacagtcttgtgtgccagaatttcaatccacgcaccccagtggggtgcgacctggagttaatgctgagcgtgggtagcatcgtggcatttcaatccacgcaccccagtggggtgcgacgtgcttgggactttacgattcccgtgggtgtcttatttcaatccacgcaccccagtggggtgcgactcacggtgccgtccaggcctctcaatttcagccaatttcaatccacgcaccccagtggggtgcgacgtctggtaggcgctgtaacgggtgttcgtgtcgatttcaatccacgcaccccagtggggtgcgactccagcaacatcaagggatatgtgaccaccgagcaatttcaatccacgcaccccagtggggtgcgacttgttgtccttggcgcgtttctcccattcgcgggaaatttcaatccacgcaccccagtggggtgcgacaaggctggacgtgacgacggacgcgaccttgctatttcaatccacgcaccccagtggggtgcgacaattaccttgagtgaatcggccgcgaactttgaatttcaatccacgcaccccagtggggtgcgacgtcatggctttccaagattgttgtggccttcatcaatttcaatccacgcaccccagtggggtgcgaccactcgtccagcagccgagggcttcgtggcgtatttcaatccacgcaccccagtggggtgcgaccaacacacccttctcaggtgccatcacactatcgatttcaatccacgcaccccagtggggtgcgactggtggggccggtaagtatcacgtcggtattccaatttcaatccacgcaccccagtggggtgcgaccagcaagaaggaagagtaacccatgaccagcaacatttcaatccacgcaccccagtggggtgcgaccggtctggctgccgccctcgctgtgcccgtcaagatttcaatccacgcaccccagtggggtgcgacgaacgcgcgccgccagccggccgggtcgtccgcatttcaatccacgcaccccagtggggtgcgaccgttcgaccgactgtgcaacgcattgcgagtggccatttcaatccacgcaccccagtggggtgcgacgttgatggctatcactatacgcggtccaatactgatttcaatccacgcaccccagtggggtgcgacgacgcctgtacctctcgaccgattggggagtagaatttcaatccacgcaccccagtggggtgcgactcggtggtcttcgacgaggaggtcataccagtagatttcaatccacgcaccccagtggggtgcgaccggtgttggcctgcacggtgctcatctgctggtcatttcaatccacgcaccccagtggggtgcgacgccgcctgagtagggcgcgccgttctggataactatttcaatccacgcaccccagtggggtgcgacttgggcatcccggcgtcgttgatgctcgcgaaggtgatttcaatccacgcaccccagtggggtgcgactggccgccctacgcgaagaacttatcgggcttatcatttcaatccacgcaccccagtggggtgcgaccgtgacatccagtaaacactgccactggatcgcatttcaatccacgcaccccagtggggtgcgacccagcccggttatcacaccgggctggttcatctatttcaatccacgcaccccagtggggtgcgacttgttggctccatcataggtattcccaattggatttcaatccacgcaccccagtggggtgcgactaacccacgtcgcttactggaggctccaagcgagtcatttcaatccacgcaccccagtggggtgcgacgacttcgcggtatcactaccgcaagcggacagggtatttcaatccacgcaccccagtggggtgcgacaccggccttgttcgggttgccgggggtgatctgatttcaatccacgcaccccagtggggtgcgaccatcacgtcggagatggtctgctggtcggcgttatttcaatccacgcaccccagtggggtgcgacgcacaccgccgctcaaccgttcgcactccgccatatttcaatccacgcaccccagtggggtgcgacacaccacatgccccgacctcgcgccgaacgggctatttcaatccacgcaccccagtggggtgcgacgattcttggcggcttactacagcaatcaggtataaatttcaatccacgcaccccagtggggtgcgaccccctcacatacgcttcctgcatctgccaaaacgtatttcaatccacgcaccccagtggggtgcgacaacacctcattagtcacctgcgttttctgttggatatttcaatccacgcaccccagtggggtgcgacgtttgcgctcccccgtcgcggtctgtttcacgtatttcaatccacgcaccccagtggggtgcgactcataagccggtcttcttcgcgcagctcacgcgaatttcaatccacgcaccccagtggggtgcgacagagtatcgagggcgtggacgtgtgttgggtggagatttcaatccacgcaccccagtggggtgcgacgacaggtcaacaacaactgcctcgtgtccggcgtatttcaatccacgcaccccagtggggtgcgactataccacgatgcggcaacagcctactgccggttgatttcaatccacgcaccccagtggggtgcgacgttgcgctggtcaaaacggttcacctcctcgacgcgatttcaatccacgcaccccagtggggtgcgacccagcttctggttccccgtcggcttggcggacgatttcaatccacgcaccccagtggggtgcgacatcgcgtctctcaaggaggcccaaagcatctggatttcaatccacgcaccccagtggggtgcgacttccggggctccggcttcggcgaggtgcgtggaatttcaatccacgcaccccagtggggtgcgacaacttacttaattgagctataattattatgtcaacatttcaatccacgcaccccagtggggtgcgacccggtgtggcttgggtaggcgttccacgccgtggtatttcaatccacgcaccccagtggggtgcgacagcatgtcggtgtgcggctgcatggtcatctgcgtatttcaatccacgcaccccagtggggtgcgacgcgcgccacccggaactcacgacagtcgttactgatttcaatccacgcaccccagtggggtgcgactgacggcgatcagctttgtcttctggctccctggtatttcaatccacgcaccccagtggggtgcgacgattgtctcgttgacggatgtgttgctgacctgagtatttcaatccacgcaccccagtggggtgcgacgcccgcttgacgtgcgctcaattgagcgcaacaatatttcaatccacgcaccccagtggggtgcgacgaggaatcaccgatgcaaccatcaccctcatcccatttcaatccacgcaccccagtggggtgcgacatgaacaaacaccatttttaacaccacaacatatatttcaatccacgcaccccagtggggtgcgactcggcttggtgccccatgcggcttccacggtctatttcaatccacgcaccccagtggggtgcgacatacgtctgtgggtagctctcgtaatcctcagcatttcaatccacgcaccccagtggggtgcgaccgttgacggcaatcgacgcgacaatggacggattatttcaatccacgcaccccagtggggtgcgacacccacggtctttttccgacaccagttcaaggtcatttcaatccacgcaccccagtggggtgcgacagcgtggcataagccacgcgcgtatgatgatacgaatttcaatccacgcaccccagtggggtgcgacggctcatctccgacgaggtggcgcaggccaacgaatttcaatccacgcaccccagtggggtgcgacattcaaagaccttgacgccatcaacgccgccaagatatttcaatccacgcaccccagtggggtgcgacagagcttggccgtgtccacgccgtcgaacacacacatttcaatccacgcaccccagtggggtgcgacactgcggcaagcatgattgacgccgggatgccgaatttcaatccacgcaccccagtggggtgcgacttcaacaggacactgcggatacgactccacaggaatttcaatccacgcaccccagtggggtgcgacctcacgccaccgcgtcatctcggcgggggagggatttcaatccacgcaccccagtggggtgcgaccggttcggcccagacgcggaccttcccggaagcgatttcaatccacgcaccccagtggggtgcgaccgatggcctgtgcggggtctccgccggtctcgttatttcaatccacgcaccccagtggggtgcgacccgccgcaaatgcaaggccagacacatcgcagccatttcaatccacgcaccccagtggggtgcgactcgggcataaaaaaccacccgtgcgggtggttgggatttcaatccacgcaccccagtggggtgcgactcggtgaccggaaccaacctgaacggatcacggaaatttcaatccacgcaccccagtggggtgcgacaacggctatcaatggacttttgacgacatgctaatttcaatccacgcaccccagtggggtgcgaccggcgcgatctgttcacgtcaggttgcagcacgagggaatttcaatccacgcaccccagtggggtgcgactgagggcttatcattatccccgaactgcgagagattatttcaatccacgcaccccagtggggtgcgacattcccttggcttttgcggaacttccaaccgccttatttcaatccacgcaccccagtggggtgcgacattcctgtcgttgatatcgggtatgcgccccgtgatttcaatccacgcaccccagtggggtgcgactctacggtgagcttggtacgctggtcggcagtaatatttcaatccacgcaccccagtggggtgcgacggcatcgaggctagccaaagtaagctgggcgcatgatttcaatccacgcaccccagtggggtgcgacgcgccctcctgtcgcgccgtcaggaaagcgagacgatttcaatccacgcaccccagtggggtgcgactctcgcactgcccgaggggctggacaccggtagtatttcaatccacgcaccccagtggggtgcgaccatgcgctatctcggaggagaggtcacggcgcttatttcaatccacgcaccccagtggggtgcgacccgtggcgcgccgctctcgcatactgggcggcatatttcaatccacgcaccccagtggggtgcgacgtcacatagcagctaccgaatgtgacgtcgtgctgatttcaatccacgcaccccagtggggtgcgacgttggcttcggcgcttacccttggcggtgacgtatttcaatccacgcaccccagtggggtgcgacagggtctcgctaccgtgttccaccgctccgacgcaatttcaatccacgcaccccagtggggtgcgaccatgtactatcatctgctacgtgagcttgcgttatttcaatccacgcaccccagtggggtgcgactacggcggcaaaaaactcatgatagatgactgggtatttcaatccacgcaccccagtggggtgcgacacgccggcaccaacatcaccaatcacattgaaagatttcaatccacgcaccccagtggggtgcgacatgcggccgcgacctacatcggcaaggtgtcgaaatttcaatccacgcaccccagtggggtgcgacaagatggcgacggcacttcatacggcttatacggatttcaatccacgcaccccagtggggtgcgactcgtcgatttaccagttcctggatcaccatagattacatttcaatccacgcaccccagtggggtgcgactagacgtggtgtggaggcaggacaacaccagtcaatttcaatccacgcaccccagtggggtgcgaccgaccgccatcggaatcccaacctacgaataagatttcaatccacgcaccccagtggggtgcgacgttcgccgcattggcggcggcgttgaagccgatatttcaatccacgcaccccagtggggtgcgacccggcggggtccaggccactccggtcggagccacatttcaatccacgcaccccagtggggtgcgacgccatcgcgcgatatgacggccagccggacaggcaatttcaatccacgcaccccagtggggtgcgacccgtatcggactgcaggacatcatcaccgtcacgatttcaatccacgcaccccagtggggtgcgactatccgctcgcccaagaacggcggcgacgaactcatttcaatccacgcaccccagtggggtgcgaccgagcagtggcgcctgtcccaatcggaggccgatatttcaatccacgcaccccagtggggtgcgaccgcaacaatgcgatcagcgacgagtacccggaaggatttcaatccacgcaccccagtggggtgcgaccgcgagaatgggcatagcattccataatacggaagctccgtctgttctcaaaactgattttatcgcgaaaatccatgtacatcgctcaatacacaaattctcgaaccaaaaacatcaacagaccatccacttttgagttatcaaacgacgaggagaacataatcagtctccaagcattcattaatctcagtgcgaaagaacaagtatttcatgagaactcagagttcgcgctggtcacatggctgcagcatcaagcatcgatgctcagccacgattttaatcgtatcgtcctatactgtcctacctcgttttatccaccttggtcttcatcacagtaaggttttgcattgcccagtcatcatggaagaccgtcacacgaaccgacattagagcatcatcacgtcatcgattggcaggtgccgctgtcttccgcgatgctcaatcttcgaagaatacttcgcccctaaattgtagtaacgcaggctatcttgcgattcgtccattatttccgccaaatcatgtttcaaaatcagatagtcagacggtgacaccgaacattcaaagacgctattctgcacgcgttggccgtatttcatgcaggttttagccacgttccgtagtctgcgtttgccttcaggcgactccgtattgacgtcataggccacgacaaccatcattccaacacctcatcccggtttccatctctagttggctcaaactccaatgcccctcggcaagaccaaagtaccctcccaagaagaactacttccacatgaacggcgggtaagcgtccaaatcgccacgaatcgcacggttgagcagcaacgcctgtgcatggggcaccaatccccacggtatcttctcgttgaagaacgggtgggtgattgtctcctgcttgcgtttctgccaagcagcaagcacggttttgcgcccgccctcggaaagaaacacgccgccattctctcggatctcgaactgggaaggcttgaccgctccagtgttgatgagcgtcagcacgaaacggtcggcgataaccggacggaattcttcaaccagatccaaggccagggaagcacgtcccggtcggtcagtgtgcaggaatcccacatagggatcgagcccgactccctgcaaggcagcgatgcaatcgctggtcagaatcgagtacacgaatgacatcaacgcattcgtccgatccaatggcggtctgcggctacgctgctggaagaagaaatcgtccttgttgcgcagaatcaagtcgtcgaaagcgaagaaatagtctttggctgccagcccttccacgccgcgcagctcatcgatggacgtgcagtcgcgcgcgttcagcagagcctgccgcagtttctcgctttgctccgcgatacgctcgctgttgacgcgcagcgcatggtcgcgcttggtccgctcaagaacccaacggcagttgtagatctttcctataatgaacgactgcgcaaaaggcagggccgcgtcttcgtcgtccgcgaaacggaactgctcgcgacgaagtagtacgtttcgattcttctcaccaagtatcgagcagtagtaacggccgtgtggagagaagaacgaaaggccgacgccaaattccgaacacttgcccatcaacgccggcgacgagcccttataagaaaaactcatgatgccttctagggagcgcagtggaatcctcccgagcgtggtatctccttgctggacaatgacattgtcgttcttcaacgataggtaagcgtcatcgctggtgacatacagtgtgttaagtaactgcttcatatgtggtctgacttctccccgatttccacttccccacgcacggcttcctcaatgaactgtctcgccgaacgcgtcctgaccagtttcggtagacagacatcgcgcagggagcacgcccgacaggccttcgacggtctgaccttcggcgtatgacctcgagcgaataagtcgtgcatctcccccgtcatcgtgacgattcgattgcgcaaagattcgtcaaaactgacccgctcccggtgtctggtctgttggtagaacaaagcgccttctggaatcgcacaggccagcatctcctccagacacatggcctccgcgcaaagttgaaggcgatccgcatccgtctgcttgggcgcaccatgtttgtattccacggggtaaggaagccaagtgccggatcgtccatgcaacggtacgccagcctccgattgccggaactcgaccacatcacacgcaccggtaattcccaaccgccgcgaaaacacacgcagatcacgcataatcagcaagctgccgcgcgtttccgattcactgtaatcgtgggccctatcgtgttcaagagaaccagccgtcgtgagatagttatcctcccactgctgctcgatatgaattaaagcccactgccgcctgcaaaacgcgaaatgttggaggccggaaagagccagccaatcgtcctctggataatctgttggctctttcacagttgctcctttatgccgacaatactgacgggattgattcagcgaccttcgagtacttcgtaatggagaccgggaatatgcgtggtatccacggtgatgacaccttcttcatcaaccttggcagtacggtggaccttcgctgacgaatattggcccgctttgctgttgtgcgtaaaccacgccagattcaccacttccatggagcctgcaggtcgtgctgaactttcgtcattctcaaacagagtcagcaaagcttctttgattttctctgcgtctttctcagtgaaaccagtcttttctgccaattgagggctgatactgccatgggtcacatatacagcacgtccggagacacggtgcttcatacccatggtgtcggaggatttcttattcgtgtctgtagtttcgccattcactgacttggtgatttgtacgtcgtcaatagcgatgggttcaagagagaatgcagattgtatggtgaacggaccgcgcactggaatggagacggaagcatcgccttccttttcctttcctttgaacgcaaacacttgtccaaaggagcggacatcaatccactgttcgcaagctctgtaggatagagcttctcggtctttctggtcttccttgcttagggtcttggtaaaagctttccaacgatctgacagagatttttctccatcatcagtacggtctgtggactgtacaaagattcgctcgcctgcgtcttgtaggcgattgcggatcttgcgcttttctgccacatccgacatttcacccaagccttcagcagtggtacgtggacggtttccattcagcggatcgccgttagggttggcgttttcaacagcgaacgtcagtacgaaatcaattttgtgctgcaagctagtcatgattcattctcctttattttcaatgttctgttctttgagttgcttggcggcatcggccctctggataagctgtctgcgtttgtgggaataaccgagcaaaaatagtgatgacaatggcttattgctttcgaagtctccttctttgaatttgctcatgacctcgtcaacttcgttctggaagaacatcccattggtggaggagatgatatatggattcagttgctgccgtaatgtcagccacgtggtcgatggtttggctacgaaattattcatcagttttacggcattagtggtgcggtccggtgtccttccaccgctctgccttaataagactctgtattcgtaattgtcagcgagcgccagcaactggccgaataaataatctcggtccgttcgcttctcgtctaaatccatggtgatgttgttcctttcatctaagggaatttttttatcttgatcgatgtagtactttttccacatactgcaggcgacttcgaaatcgtgctgccagacagataaactgtcataggacaatggccgaataaccttgtggaaagccggctgcaggagcgatgcaggaaggccagcgttgctgaacatgcactctacgagttgtttttttacatatttggcaaagcgtctgtaactatcactgctgtgatcgtcagtgctgtacacacagttgataacatccgcgaatgacggcgcgccgatgtatggaattggcttcggtttatcggaagacttcttggacccgcgcggagcctcgtcatcggtagatgcgctgtttttgttatcaaaacaagtgaggtaccacgcagcatcttcgtgccattgaagaacgctttcaatgtactcgttttggaataattcacggtagaaggtaacgctaagacgccccgaagtggcggcatcgaaaatagccacgactattcgtctgctatgctgctgcatttgttgcagtaccttctcgttgccataaccgcgcaacaatttaccgaattgctttgcataattcgcgtaagtttgaacgtttgcgtctataagtttttcagaatcagtacggtcatcgacctgttcggctacatcgcgggaatttccagtgggatcaagaacattgtccgtcggatggccgtcaattgcccaaatcacaatatcctgactaccggtaagcgtgccattattggttgcaagccagcgcagcgttgtatggattttctgtgaagtcagggtatcaatactcagtgcttcatcgcgattagcgaaacgcccacggaaagtgaaatacgtgttgtcattggcggatatcaatttggcgttaccgtttacattgacaatcttctttgggaagttagtggaaggcttgtacagtgtctcgccgaacagatcagttccaagactggcaccgtgccgcacctgctcctcatgggctatccacaaatcccgtattgcatgatccgcccaaactttcggttcataatcaccatggcgaacatgtaccgcaaagcggactccgattttactatctttcttgggatcgatcccaataccttgtgctcgagcttcttcgattacgctatgttgcgaaagatattggtaaatagcatttaacttcgcattatcacctttccaactggcaagctggctgagatatgattcatgcttgaccgggtcataattggtgtcgatgtattgcaactgatcgaataacgggtgcggaggcagcacctttccggagcgccccatggattgctcagtacaaggggcgataatttcaatgtcggcattatctcgcttgatagtggggtatccgttttcatcaagtgtgacctgtagctgagtcttcaacgtagtgtgataaagaggcaacaaggttttattcacgtcttcattgagaggtgtgattcctgctgaactgttcactgcatcataggtctgcagcagactggaccataaactcatgtctactcctccgccatgctaaaattgcaaccctcaataaaatctttgacatgctgattgcgccggataatgcgttgatctaattgtgtggaatcggggcgttcaaactgaatgatgccatcgtgcattattggacgccagaactgggcgatgaagtcatgttccgggttttcatctggataaataaaactatgaaactcaaagccgaactgccaatcaccataaccgtcgtagaatccttcgccagaaccgaactcgcatggttccacatatccttggcactctctggtgccgaggaaaatgtctcttcggcctccaagattgactgatctcttggcgatattgtggtgtttgttctcgttgcggtctacacgcaagtcttcgcgttgctcattccactcaaaatgagcaagtacttgatacttgactttcttcaaataggtgtaatacgacagatcattcccaccactcatcttgattggccggatacctttgccttcggtctgaatcttgttcatcacgcgtactgcgtcaatgacccacacgattgttggtttccaatagatgctctcagtaatacccttcagggcttgatacgttggaatctgatatgagtttttttctccgcccgtgcgggtggcaacttctgagaacaaggcgtagtcgccatatatcacatattcaatcgagttgcgatgcttttccataatcacctacttcatcagaagcggcatttccgctttcaagaggaatccgaagtcttgactgtagttttcttcgttgagcactaatatgccgaaatctccattcgcttcgctaatcgatttcgacttgtcaagtgccttgaattcgtaatcgaagagagaaaccgtatactcctgcaatgagcccagtatcttaatcttggatgcaaaatccccctcaccattaagttggtcaatcagttccatcgcctgtccataatgtaccacaacatccgtggtacctccgggaatgacatggaagctatctcccacagtttggaaagcctgggcaaatgcgtatgggtattgctctccgacgcggttacagtacaacccgcgacggcgacggttgaacgacaataggtcgtatacggtttcttcgcctccgagaattgagtaatccatggttccaatgttccgtgatttggagtccactaattttggataccggataaggaaagcgcggtaatattcttcgatcataaatgcagagagcaagtcttgttccggataatcatggatgagttggtccgtgatctctttccctaattggatttcaggaagatatctcaatcctgactcatctttaatggaatatacataaacgtttctcggcatctgcgattcgccattgcgattgcagcgacccgctgcttgcaagatactgtcgagtcccgccattgcacgaataacacaagagaacgaaatgtccacgccggcttcaatgagctgagtactgatacaaatcactggttggcccgaatctccagtttttttcggcaggcatttcttcagcacggcaagttggtttttgcgatgtgcaccgcacatcgcagtactcagatgcaccaatgtaaaccggtggtcaacgtctagttccttgacgagttgatatagctgtttggcttcgcctttcagattaaccacagccaaacagttaccgttatccaacgctttgctataaatttctgctgcaaaatcatcgagggtcagaccctgcgatgaagcgacaatattggtccgacgaagttgctcggcataatcattgtcgggatcaattagatcaggcttatctgaaagcaacagatttctgcggtcggtttgttccaaaagtggctgagtggccgaacagagcaaaatcgtggaacccagaatcttggagaggaaactcacgacttcgttgaacacgttaatggtattggtgggcagtgcctgtacttcatcaaagacgataacgctatcagccaagttgtggaacttgcgtagtcttgttgctttcgcagacatcacagtttccaggaactgcaccatcgtagtcacgatgataggcttatcccatcgctctgcagcaagacgtcgttgctgctccttttcgtcatctttatccggaaccacgctcgaataatgctcgagaagaatctcgtcgtctttgtcgagatcgaggacattgcggaatacctgcacggtttgctctgtaattgacaaataaggggtgatgtaaatgatatggtgttttcctgtttcctgggcatgatggagcgcaaaacgtagagaggccaaagtttttccaccgcccgtgggcacacctaaacggtatattcctgtatcgcgtgtgctggctgcaagacaattttcagagatacgcatcctgattttgctgatcttcgacgatgtatcaaaaccactgatcgcattttctagtcgacgagtcagttcttcccaattgggagtctgcgaagtatatggttgatgagccgtgaagtttgccgcatcgactcgatccgcatctacgagccgcgaatagatgtattttgcatacaggcccaagaagaagctgcgagaattccttgtgttgcgcggtgaaataccacaggaatcgactatttctagcagtctattggtctcaacgacactgttggcgaaattggtgtttatatctaggtttaaggaagaaacatggctcagtacttcttgatagtggtactgctcggcttttttgttctcgcctgtcaacttcctaaagtaagcagttcctccacaagcgtctaggcaatccggcagatgaccatgatgattagcgattgccagctcaagtacttctgcggttatcatactggctgctgatgatggaaaatcggcagcacaatcatcaacaatgaacgcgccttgcttggcatgaacgacttcccctcgcttgcggttgccggtcagcagatatcgtttgaagtcatccgtagctttgccggaatcgtgcagcaatcctgcggcaaacgccgtaacagaacttcttttttcaaagcccgctgccagttccgctgtgttgtgcaaatggtcatacagcgtctgcgtattgccatcatcatctttacgcgctaataataaatccttaggcatcaatgcctgtcccattgcgcaccctttctgaataattgaaacatctgcgtgcccccattatcgccgaatcttttatgtgcggtaaatttttaccgaacgcgacgtaattatgcggaaaattagaggtccagtgctgaaaaagccgtggaatatggattgcgtcgtctgtgcctccgctttgaatcggaggcacagacgacgcatttttgagatacctatactatctgcatcattttttcaatccacaccttgctgagatgacacgggcagccgatggtgcgccctgcaggatatcaggtgaatggtgtcgcaactggcataacatcattcatctgctaccctctaatagcgaagaaagactcatactcctggatcgggaggatgagaatgacaatgatggcgattagttccatcttcatcacctgcacctttcccgtgaaacaaaggccagtatttctggtctctaggtgagtacgacttgtccggcctgctcgcctagaaggaatcatatcttcaatgatgtagatagtaaaagccatgttcgatcggcgtgtcgatgtgcattgttcgacaaagtcaagattggcgtctttccgggcatcctaaataacacagctggcatcacggagtgcatacgaaaaaacggctcttcgggtgtttgtgtgggtgtgggtccctggtctggcttacgggttattggcgtccggggagttggaggttgaggccgccgcatctgagcatgaccagggcgatgaggttgccgaggttcctgtagccgtagccgatcttgatggtggtcttgatcttgttgttgacggcctccagacgagcgttggatagtccggaccggatggtgcgcaggatgtcgaagcggcggcggtcgatcttctcgccgagcctcgagaactcctcgatgcccgagagggacgcgtctgcagaatcgggcccacgctcttccagttgacgcgcatcagcgccgacacggcgctcctgggcgcgtgcacgctcagccatgcgacctgccgctcgaagtcacgcgtgtacgcgctcttgcgtctcgccacggcaccatcgcgacggccaccccgtgctccgcgcaatcgaccctccggggcgcgtgctccagaaggagcctggcgcagccgatgtcgagatgccgccagcggcgcacgcccagccggtcgtacggccggccacgctccccacatctggcgcaccggtccatgtctccctcgcgtacgggcgcaccgggacgatgacgacgtcccctccgcgcgggtccttctcgacgcgcggcacgccggccacgacgttcgcgggcaggcccggcatgcgcttgagcgcgccggctaatatggtgggcacaggcgttcctctgttcctcggttctatttcttggcggaaacaaatctaacaggagaacgcccctcccatacccgcacacgaaaaagccccggcaatggacgccggggctttcccaccacacaaactggcgaagacacaaaaaacttgtcgttgtggctggaatccacacaatcccaaccacaacgacaagctcatatcaattggcgtatcgagtttactgggctgtccacaacgttcaatattgacaactcagcaaactcaattcagcgatctcacgccttggcgacctccacgcccagctcggcgccctccttcacctcgaaggaggaggccagcgtctcatgggcgatcagatcgcggaactgctcgaccttggccacgtcgtcagcaggcacggtcagcgccagcgagatgcggtccgcgatgtccagatcggcagccttacgtgcgtcctgcacagaacgaatcacgtcgcgggcgtagccttcggccagcaaatcggcatccagcgcggtgtcgaggatcacgaagccaccggtcggcagagcggcggagaccgaagcggcggcctcggtggcgttctcctcctccacgcggttgatcagctcgtactcgccttcgaccagcgcaaggtcgccggacggcgtggagaccaccggcgcaccggacgcagcatcgacatgccagtcgccggacttggaggccttgatggcgaactgcacctgcttgccgaggcgcggacccgccgcacgggcattcacacgcagctcgtgaacaatcttcagaccgtgggcggaggcgtcctccagagtcgagaactcaatattcttgatattaagttcggccttcagcagctcgtcgtaggctttgacggcgtccacgttctcgaccaccacggtgagcttggaaagcggctggcgcacgcggatcttggcggccttgcgcagggacagggtgccggagacgacctcacgcaccttctccatcgcatccaccaaggccggatcgtcgaccagcacacggccgagttcggtgtcttcaccggtcttctcgtccaccacgaacggccaatcggccaggtgcacggactcgccaccggtcagaccacgccacacggactcggcttccatcggggccagcggcgcaagcacgcgcatgaacgcctcaagcacggtgtacagcgtgttgaacgcggacgcatcctcgttccagaagcggtcacgggtgttgcggatgtaccagttggtgagcacgtcgatgaagtcggagaccgcatcgcaggcgtcggaaatcgcgaactcgttcagcgacttctcggcggccagcaccaggcggcgggtacgggccagcaggtagcggtccatctccggcagaccggcgacctcgtccgcgcgcagctggcgggcgtcgaatccggccccgccgttggccgcgttggcgtacaaggtgaagaagtagtaggagctccacaccggcaacatgacctggcgcacggtgtcgcggatgccatcggcggtgacgatcaggttgccgccgcgcagaatcggcgaagacataaggaaccagcgcatggcgtcggaaccgtacttgtcaaacacgccgttcacgtccgggtagttgcgcaagtgcttagacatcttctggccgtcggagccgagcacgatgccgtggcagatcacgttcttgaacgccgggcggtcgaacagggcggtcgccatgacgtgcagcaggtagaaccagccgcgggtctggccgatgtattccacgatgtagtcggccgggaagtgctgctcgaacttctccttgttctcgaacgggtagtggaactgcgcgaacgacatggaaccggactcgaaccagcagtcgagcacatcggaaatacggtgcatgtgcgacttgccggtcgggtcgtccgggttgacgcggaccaggttgtcgatccacggacggtgcatgttgatgttgccgtccttgtcgcgcgggtagtcaccgaagtcggccttgagctcttcgagagaaccgtaaacgtccacacgcgggtacttcggatcgtcactcacccacaccggaatcggggaaccccagaagcggttgcgggagatggaccagtcgcgcgcgttggcgagccacttgccgaactggccgtccttgacattgcccgggatccagttgatctgctggttcaattccagcagacgcggcttgatcttggtcacggacacgaaccaggaggagaccggcttgtagatcagcggggtggcgcagcgccagcagtgcgggtaggagtgcacgtagctcttctcctgaaagaggatcgcgcggcgctcttccgggatggaagcgagcgggccgtcgccggcgcgcaggttgcgcaggatcggcaggttggcgtcgaacacgaaatcgccctcgtagtcggggcactgcgcggtgaagcggcagccatcgtcgagcacgtcggtgctcttgatgcccttggcattcagcgtgttcatatcgtcttcaccgtagggggcctggtgaaccagaccggtaccttcgacggtgtcgacgtagtcggcagtgaagatcgtgtagccgttcgggccgggcacatggccttcggattcggccgtctcgcccgcgaagtacgggaagaccgggtagtagcggcggccttccagctcggagcccttgagttcgcgcacgacctcgtagttctcgccgagttccttctcgtagtgcggcagcaggtccttgccgaggtagaacttcttgccagcgaacttgccttcggtcgggcggacctcgacgtagtcgatgtcggcgccgaccacgatggcgaagttggtgggcacggtccacggggtggtggtccagaagacggcgtaggcgtcgtcttcatcgcgcatcttcacggccacggacacggtggtgtcctggcggtcctggtacacgtcggcgtccatgcgcagctcgtgcgcgctcagcggcgtgcggtccttcgggcagtacggcagcacgcggtagccctggtaggccaggcccttgtcgtagagctgcttgaaggcccacatcacggattccatgtacgggatgttcagggtcttgtagccgtgctcgaagtccacccaacgggcctgacgatgcacgtagttctgccattcgttggtgtacttcagcacggaagcgcggcaggcgtcgttgaacttgtcgatgcccatcttctcgatctggtcgaccgagtcgatgccgagttccttctgcgcctcaagctcggcgggcaggccgtgggtgtcccagccgaacacgcggttgaccttgcggcccttcatggtctggtagcgcgggatcacgtccttggcgtagccggtcagcaggtggccgtagtgcggcagaccgttcgcaaaaggcgggccatcgaagaacacgaattcgttctggctatggtcgccggaagggttgcgttcaacggacttctggaaggtgtcgtccttgtcccagtagtcgagaacggtctcctccatgtcggggaagctggggttcggcgcgacgtgcgcggtctcgccgccctcgttcgccttgggatatacgttttcgctcaccgtaaatctcctgttagtactgtgcactggtcctacaggagcgtcattgatggcgattgccgggcgccgacgtgtgccggctgggttcacgaatgtcacgtaccgaaccgtggggccgatcgcgtcaatcgcctcgcagccggaactgactgtgttccgcccggaacagccctgtctgccgttcctgcctacgaggacgatgacgggcgctggtatgcgctccgcaccgcggtaccacctcgcttatcgcaccggttgcgccgctccgaactgttgcactcggagccgcgagcctgcgcgaccgcttgtgttcggctgtctcgggccgatcccgtcggttctactgggcgattgccgccgttcttccgaagactccccgctgataacggatcactgcctcacaacggtgcatatcgtaacacgccacgcggtcaaatcgatgggaatgttcatcaggaatgttcattctttctcatttttgtattcatcgcgtgcaccattgtcagcaaacacgctaggctcctttaccggcgatattgcacatctggctcaggggcggctcccgtatgggccggagaaaggattattgaggaatgacgtacgatttcacgtcgattatggacaggcatggcaaggatgcgattgcggtcgatgggttgggaaccgacctaggtttcgctcccgacccaccgagggacggatttgacgtgattccgatgtgggtggcggacatgaatttcccgaccgtgcccacggttccgcaggccattatcgaacgcgcgcaacaccccgtctacgggtacttctcccccaccgacgactattacaactccattatcgactggcaatccacgcgcaatggggttaccggattgaccagcgaggcgatcggctatgagaacggggtcttgggcggcgtgatcagtacgctgaccgcgttcgccgctcctggcgacagcgtgctcctgcacagcccgacctacatcgggttcaccatgtgcatcgagaacaacggctatcgcatcgtccacagcccgctcaagttggacgagcacggcgtatggcgcatggattacgaggatatggataagaagctcaaggagcatcacatccatgtggccgtgttctgcagccctcacaatccttgcgggcgcgtgtgggagcgttgggaaatcgagaaggccatggaagtgtacaaggccaacgattgcgtggtcatttccgacgagatttggtccgatttgactctggggaatcaccagcacatccccacccagtcggtcagcgaggacgcacgcaatagaaccgcggcgttctacgcgcccagcaagaccttcaacctcgccgggctcgtgggcagctaccacattatctataaccccatgctgcgcgaccggatcgtggccaagggctcgaagtcccactataacgagatgaacgtgctttccatgcatgcgcttatcggtgcctacaagcctgaggggcatgagtggctcgacgaactcaaagaggtgctcaccggcaatgtcgactacgcctatgactacatcaccaagcatttccaaggggtgagtttggccaagccggagggcacctacatgctgctgctcgactgcgagcagtggtgtaaggctcatggtttgactttggcggaattggagaagcgcggctgggatgtgggcgtcgattggcaggacggcagcatgttccaggctccctacagcatccgtgtcaaccttgcgttgcccttaagccgcatcaaggaggccatgcgccgccttgaccaatacgtattcaacgcgtaaacggcatgcatccgcgattgcggtgtcctggaaagacgaatgccgccaacgaggtttgtgcccgttggcggcattcgtcatagagaagccgagccaatctaccttcacaactaatcgtcgaggctgtccacaccgagcttctcttccagctcgatgacaatgcgctcgtgcatcttttcgtcgatcttcaccgtgaacatgaagacgagaagactcagcacgatgaaggcaagcgggatgtagaacgcgaaggtctcgaaggtgcgcacgttggcggcggtcatgtcggcggcggtggcggagccgaccataccggcggccacggccacgaagccgacgatgccgttggacagcgcgcccgcgatcttgtcgagcatcggacgcacggagagggttacggcctcgttgcgcttgccggtcttgagctggccgtattcgatggaatcggtcagggagaggatcgcggtcatctggatgaacgtgccaggcaggtagaacagaatcaacgccacgatcaccacgggcaggctggccgaatcgagaatgaacagcacatagccgattgccataagtaccatgccgccgcagaacaggtatcggcgcggtatgcggcggttcagggccgggtagagcggcgccatgaccaagcccgcgatcacggggatcacgccggtgatggcgaaggcatccggcaggttaagcacgaacttgaacagatagaacatcacgccgttggtggccacattcgccactgcatacagcaggtagctcaacgccacccacagcagctggtcattttttacgatagcggcgaacgcctgcagcgggttgccgctctgatctgccctggaacgtaggacgctttcgttttccttggtgccgaacgccacggtccatgcggtcaggatgccgagcaatgcggtgatgatgccaaatgccgtccagcccgactgactttcggcgcgagaaccagtgaacatgaaactgaaagtggtcacgatcggtaccacgacaatggtgctgccgttatagccaatcgaaccggtgaacgtaccgagcgcagtatatacgctgcgttcgtgcgagtcggaggagatggcgggaatcatgccccagtaggagatgtcacgcatcgaatagaacacgtcgaggacgatgaacaccacgacgaacagcacgatgaaccaagtctggttcacgttgaccagcccgaacagaccggtgtagaccatgacgagcagcacggcggagaccaagccgccgatgaactgccacgggcggaaccggccgaagcgggtgttggtgttgtccaccaagttacccagtaacgggtcaaggaagatctctgcgatacggattatcacgataaggcttgtgatcagtgcgatgagtttggtggccaaggctttctcgacattgacgaacagcacgctggtcacgtaaacgacgaaataggtgctcagcgcgttatagaacgccgactggcctagattaccgaaagcataggcggcacggcgcctcagagtctctgctttggtaggacgatttatctggccggattcatctccggccggattcggtgattgggattcgctctccggtgactgcgaaacggacattgacattttctccttagagtcattctcggtgaggtcttctccgacctcgttggagagtgtacatcattaccaaaatttaataaatcttttcactaattattgtcaatagaaccaatctcaaaaccaacgtcgcagcactcgcaaaaatcgcagaattccaacgaatacacacctctatcaccatatgaattatcgacagcgcgacacaccgccacagaaaatacctccagcaacttgcgatctgcaccatcaggttttaccataatcagtaaagagttttaccctctgaatcaacaatgtggttatcaactcaaggaaagcggttatgcagcatcccatccccaccaccatcgcatcatctgattggctcaccgatccgaccgtattcgccgtcaaccgcgaaccagcccattccgaccatcgcttctacgatcacgtaccgcagccgaacgaaacgatgagcctcaagcaaaaccttgacggcttgtggaatgtcgccgtgacgaccgccccggttttcggcttccccatgaacgattccggcaacgctgaatctccggatttcaccgcaaccgattatgacgacaccggtttcagccgcatcgccgttccctcaacactggaaaccaagggcttgctgaaccataagtacgtcaacgtgcagtacccctgggatggccacagcgaccccaaggctcccaacatccccactgatggtcacgtagccatttaccgccgcactttcgagacaagcacccccgtctccgccgccatcgaaaacaagcgccgcatcacgctgaccttccacggcgcctccaccgccatctacgtctggctcaacggttccttcgtcggctacgccgaggactcctacacacccagcgaattcgacgtcaccgaggcactgatttccggaaccaatacactggccgtggcctgctatgaatacgccaccgcaagttggctggaagatcaggacttttggcgcatgcacggtctgttccgctccgttgaactcaccgcgcaacccactgtgcacatcgaagacctgcacatcaccgccgatttcgaggcgaccacccatgccggcaccatcgacgcccatgccgtgatccgcaacatcgccgacgccaagcaactcagcgccgcactcatggatgccaacggcacgccggtctggcaggattcctatgccatgtccgacatcgtcgacacctccggcgtaccctgctgcggcaccgcagacgccgcgatcgacagcaccgccgtgcaattccgcgcgaatctggccaacattcgtccatggagcgccgaaaagccctacctgtacacgctggctctcaccgtgcgcgcagcagacaacagcatcatcgaagtggtgccgcaacgtctcggcttccgccatttcgaaatcgttgacggcattatgcgactcaacggcaagcgcatcatcttccgcggcgccaaccgccacgagttcgacgcgcgtttgggccgtgccatcaccgagcaggagatgctcaccgacatcatcacctgcaagcgcaacaatatcaacgctattcgcacctcccactacccgaatcagacgcgattctacgaactgtgcgatgaatacggcctgtacctgatcgacgagacgaaccttgagacccacggcagctggaccattcccggtgatgtggagacccctgaaaccgccattccgggcagcaatcccatctgggaaggcccttgcgtggaccgtatcgccagcatgatcgggcgcgaccgcaatcatccgagcgtactgatctggtctctgggtaacgaatcgtacgcaggcgaggtgttccgcgcgatgtaccgcttcgctcacgcggccgactccacgcgacccgtgcattacgaaggcgtggtgcatgaccgcccctttgacgacgtgaccgacatcgagacccgcatgtatgccaagcccgcggaaatcgaggaatatctgaccaatgatccgaagaagccctatatctcctgcgaatatatgcacgccatgggcaattcggtcggcggcatgcatctgtacaccgagctggagcgttatccgcattatcagggcggctttatctgggacttcatcgatcaggccctgtggcagcagctggacgacggcaccgaacgcctgacctacggtggcgactgggacgatcgtccctgcgactatgagttcgccggcgacggcctagtcttcgccgaccactctccctcaccgaagctgcaagaggtcaagcgtctgtacgctcccgtggtactgaccgtaagcgaccacgatgtgaccatcgaaaaccgcaatctgttcgtctccaccattgatttcgcgttcacggcgaaactgctggcggacggcaatgccatctggcaggccgactaccgctttgatgtgcccgccggcgagacccgcaccttcccgattgacttcccgtcggtggacgccgctggcgaaatcacctatgaggtcgatcagtcgctggcaacggcaacaccgtgggcaccagccggctatgaactggcgttcggccaacacaccgttcagtcagtcgtgccggcttccgccggaaccgattcgaccgcgtgcggcgcggttccctccgcggctgattccgatacttccgataccggtacagtaacggttggccgctggaacatcggcgtggtcagcggtgacggacgtaccgaagcgttgctttcacgcacgcagggcggcatggtgtcattcaagcgtgacggtcgcgaaatggtgttgcgccgtccggcgatcacctgcttccgcccgctgaccgacaatgatcgcggcaatggcagcggcttcgaccgcgtgcgctggttcggtgccggccgttatgcacgtatagcgaatcagcagttctcgcaaaccgagactggtgtcatcgccgaatacacatatacgttggccgagccgggcgaaacccaagttgccgtgcgctatgaggtggatgccgccagcggacgtgtacatctggccgcccgatatgccggtgccaccgatgcgccgacgctgccggcattcggattggaatggacacttcccaagcagtacgagaacctgcgcttctacggccttggccccgaggagacctatcgcgaccgtctgcacggtggcaagctcggcattttcgagcgcaccgcggccgaagacaatgcaccgtatctggtgccgcaggagaccggcaaccatgaagacgtgcgttgggccgaagtgcttgacgcccaaggacacggcatgcgtatcagtcaggccggcagcgaacatttcgcggcgagcctgttgccgtacagctcgctcatgctggaagaggcgacccaccagaacgagttgccgccggtccgtcacacgttcctgcgcctgttggccgcgcaaatgggcgtgggcggcgacgattcatggggcgcgcccgtccatgagcagtaccagctgcccgccgatcgcgcctacacgctcgacgtgaatctggaactgttctaacagcgataaagaagctccctccacagagggagcttctttatcgcacagagggagcttctttatcgtgctggtacgaaactgtcacgcactactagggtggtggagatgaaggtgtggtggtgcagcgtgcgccgactggagatggcctcggcaagcatcgtaatcgcagtatcggccatctcattctggtcgatatcgtaactggtcaatgtcggcgaagtgtactgggcgatggcctggttattgatactgatcacactggtatcgcgaggcaccagcactcccgcagcggtaaacgcctgcagtacgccgactgcaatcgtgtccgcagccacgatgaacgcatccggcatgtcatctcgatgatcgttagccgctttctcccctagagtgcgcccggtgtccacagtgaacgcgccttgcgcgtaaatcaggccttccgcatccagccccaaacgctcggtccaattgcggaatgcggttaatcggctgtcttccgggtattcgtgcaaacccatcgtgaagccagtaccgccgatatagccgatgcgtcgtttgcccgaggacaccaacacatccaatgcgtccaaaatggtttggcttaaatccggttgcaccgaatcgaacaggccgggcgcaggattgatgtcgatgaatacgccataaggcaataccagatggagtttcaacagttcatccgaagaaggtacggacggtccgatggaaatgaagccgtcgaaatcaccggcgttggcaatcagatcgtcgatatgggaaaacgacgtgagttccatgtgctgggctctggcattgtcgccgagcacggaccgtagttcatcgaaataggcgtccgccagttcttcctcgcgggtggcgttgtcgagtacggccacacggcgtggcaatacgatacggcgtgatccggtagcgtagccaagctgctcgctgacctcgatgatgcgacgtcgcgtctcctctttgacagacaatgtcgggtccccattgagcagccgggataccgtggcctgcgagaaacctgattcctgcgcgatttccttcatcgtgaccatgacatcatcccctcaatgcaaacattacgtagtacttcagtaaattactttactacttagcgtaacacgcaaagcccgcaaccggaatacaccggtcacgggctttgcgatatcaatgtcacatcagcagacgatatgacctgatgtcagctctcgtcttcggcgacgcgggagcggctgtagatcatcttcatcgagcagatgaagataaccatcgcacccaggacgatgatgccgccgaccatgaagacgttggcataggtcgaggccggaccggattcggtgccgaacagtgagccgccgctcatcgcgccattggccatgagctggccgaagatcgcgacaccgaccgaaccggtgatggcctgcatcagatcgttgaagcccaatgcacgtccggattcctcggcctccacggtcagcgttgcggtatccacaatcggctggtagaagaacgaggtgccgaagtagtagatgcacggcgccacggcaagagcccagatctggcccatcggaatcaggaacgcaacggcgatcaggccaccgcccatgcaggcgagcgccagaatgatggaggccttgcggccgatcttctggatgatcgggccagcggcgaagcccatgatggcggcgaggatgatcgaccacaccagcaggttggagacctgggaggagtcgatgccgtacacgttcaggccgatggcgttgcagccggcgttcagggtgtagctgaagaagtagccgacaaagatgacgatcatggtcatcgcgaaggccgggttggtgagcatctccggggtgatgaacggatccgcggccttgttgatgtagaccacgaaggccacgccggtgaccagcaccgcgataccccagaagatggtcatgtcggtgaagaacatggtcaccgagccggcgaacaggccaatgagcgtgaagccgatcacgtcgacgcgcgcgcccttggcatgctcgtcaggcaggttcttggccaggatcgggatgaagaacaccgcgatgatgccgataccgaagaggatgcgccaatcgacaagggtcatgtagccggcaaggaagacgcccagagccgcggcgatacggaacacggcgacgaacacgccgtaccagatgactcgcttcttcttctcgatgtacttggagacgagcaccaggaagatggagccggagacctgccagcctgcggactgcacggtacgggcggcgatgacgatccagatgctcaggtcgccgaagcagccgaggaccgaaccgagcacgaacacgatcgtgccgagaatcatcatcttcttcagggacacgaagtcaccgagagaaccgtagatcacgcacacgatgccgagcacgatgcccggaatcgaggtgatcaacggggcgaggttggcctggccgagctggtcgccgatgttcacatagatcatgccgaaagcctgctgctgcagcacgcccatggtgaagatgatcagtacgatcggaatggcgatctttgccatcttgttcatacgggcaaactcttcggtgccctcctcaggcaccgggataccgttcgccttctccttgacagcggtttctgccatggtgattcctttctattggtttgagtttggtggaatgccttatgcgcgagcgcaaggagtaaaaacagctacctcctctcgcatgggaatcgacggcgccgcgcctcttctggataccgcgagggccgaggccttcgcggcgaaatcaagtgcatgggcgatgggttcgccggacatcaggtcggcaaggagataaccagtgaaggtgtcgccggccgccgtggtgtcgaccgtgtcgacgagataagcggactgcgtgacgacgtggtccccacgcaaatacatcgaaccgcactcgccgagggtgagggctatatccgcctgggagaaacgcgcacgcatcgcacggatcagtgtctccccatcttcttcggcccctgtgagcatcgccgcctcgccctcattgagtacaaaacagccgatggcatcaagatcgacttcgtcgagccgcgagtcagccggcgagggattgagcacgatgaacatgccgcgggccttggcgcgggacacgatatagggcagttcgctgatttcgttctgcagcagcagccaatcgcccttcccatacccgtcaagcacctgatcgacgaaatcacggtcgatggcacggttcgcgccggggtacagcacaatgcagttgtcgccgctggcatcgttttggatgatggcgttgccgctgcgcacatcatcgcgcactaccaccgaggtcacgcccaccgcgcaggattcgagcaggtcgcgcaggaacatgccgtcccgtcctacctggccggcatggtgcacatcggcgccggcacgagccaatgcgatcgattgattcagtcccttgcctccggggaacacgtcgagcgcatgcgaggtgatggtctggcctttggccgcaaaatgatccaccccgtacacatagtcgatgttcagcgagccgaaattcagtatgcgcatcaggactcctttcccatgacgggaccggtgacagccagttcgtagatgcgacggcaatcgtcgcgatcaaggcgggcaatggacccgatggtggcgtccggcccgtagaaatcgatgttgtccaacatgcgttcgatgccgtcgcccggcagatcgaagtccttgaaggaaacaggcatgcctagcgagcggaagaacgattccgttgcggcgatgccacgccgggccagttcggtttcgttcatcgagccgggcctgatgccgaatacctcagtggcgtatcgcgcgaaacggaacggggccttctcgctggccacgcgcatccaagatcccatgatgattgacagggtggccccgtgaggggtgtcgtatagcgcgctcagctcgttggcaatcaggtgggtggaccagtcctgttcacgacccacgccgagggtgttgttctgcgcgatggtggagatccacatgatttgcgctcgcaagtcgtaatcggcaaggtcggccaacgatttcgggccgacatcgaccaaggtgcgcaatgcgccttcggccatacggtcgattacgccgatctcgttgtcggcgctgaaataccgttcgcagatgtgggagaacatgtccacaatgccgcaggcagtggggaacgccggcaccgtgacgctgagttcggggttcatgaacgcgaatgccggccggagtactggttcgctcagcgtgagcttggaatgctcatgctcattgttgatgacggcgacctggctggattcgctgcccgatgccgggcacgtcagtaccaccgcgacgggaagggtgcgatctaccggcactttgccggtgaaataatcccatacgtcacgctctccggcggctcccagcgcgattgccttggccgaatcgatgacgctgcctccgccgatggccacaacggcgtcgacattgcgggctttggcgatggcgatgccttcacgcaccagcgtcagtcggggattcggcttcacgccgccaagctccgtataggaaatgccggcccgtccaaggctgcggcgcacggcatctagcaagccgctggtttccagatatgctccgccatcatgatggatgagcacgcgggaaacgccctttgcgcccagttcgtctcccactttggtttcggcgtcgcgcccgaaaacgaaggtggttccgatgcatatggtgaaatccctcatatcatgctccttgcgtgtatgacggtgtccgtcatgatgtcgttgagttccgcgatgtcgtgcgccacatatgcggggtttctgctgagcaacgcgatttcgtcgccatccccgtatgtgaccgctatgcaggagatgccgttggtccgtgcagcttcgatgtcgctgaaggtgtctcccacatagaggcattgtctcggcgcgatgccatgccgtcgaacgatttcggctatcatttcgaccttcgtcgcctcacggccgggtatggaatcggggcagatccaatcgtcgaacaggttcgcccagcctttgctgccgagtatgcgcctcaatgcgccctccggcttgttggtgacgatgatattgcgtacgctatgtcccttcagctcattcagcatgctctgaatgcccggatagagtctggtgcgcgaaaaatcattgagcgtgcggtagtgtacgcgtacatcctcatcaaatgtctccagatacgcctccccgggataggggatcacgtgccgcatgatctcatccatcggatcggccagattggcgtcatcgcgcatgtacaggtcatcgatcgccccgcccgcacgacgcgcggcgtacgtcagggaattccacacgtcgctgccagtgtcggcaagggtgccatcgaaatcccataacaggcatcggtactccattggattgctcctttcgttcattcgcatggcggtggtcgatgattggaagcgagataccgccggccggccagaaggggttggagtcgccggccggcggtggagggggttgttcaggggcaagactcagtcgtagttttcgagggtgctgttcagtaggtcgacgaatccggggaagtcgagttccagcgcggcttccgcattcggctcttcgccgcgatagcccatcgtcggcgtgcgttcaagatccacggcaggcacggtaccgcgcagatgacggtagtcgcacacggtcataccgcgggtaagtgcgccgtgcagctcgatatcgatatgcatcgggaccgcagtgatcagcgacgggtcgataacccatgccaccgcgcatgcgtcgtgcatggtggcgcccgtcagctcggactcctcctcgcatgcgccgatgaagaaatcggtcagatcggcggccaggttcgcggccttggtgccgatctcacggaacttggctgcgtgcttggcggtcagctcgcattgacgggtcaggttgatgccagtcatcttgacgtgcataccggagttgaacacgcgcgatgccgcctcggggtcgacgaagatgttgaattcggcggcaggggtccagttgccgtaggtgacggacccgcccatgatgcacagctccttgacccgttccacgatgcgcggctcacggttgatggcggaggcgatgttggtcagcggaccggtggcgatcagcgtcacgtcatccgtgctcattacggtgtcgacgatgaagtcgaccgcatgcttgttctgtgcggcgtgcgtcggctccggcagcacgggaccgtccagaccagtctcgccgtggaactgcggtgcggtgaccagcggtgcgaccatcgggcagctgtgccccggatatacgccgatgcggtccgccacgccaaggacctcaagcaccttgatggcattgcgggtcacgttctccagtgtgcagttgccgccaatggtcgtgatacccagcacgtcgaggtgctgcacggcgagcatgatgccgaacgcgtcatcgtgtccgggatcgcagtcaaggatgaccttcttcttgttttccatagggatacctccgttggttgtgttctttggattggtcgatattcgggcatggcgttcagccggtttgcccggcgaggaactcgtgcagctgtgcagcgtccggcgaggaacgtgccccgcgacgggccactttgtatgcggagacggcattgccctctcgcaatgattcggcgagggaggctccggcgagtctggcagcgatgaaaccggcgttatagacgtcccccgctccgatggtgtcttcgacgttcacccggaacgccgggctttccgtcaggccgtcttgcgtaagaccgatcgatcctcgggcgccgtcccggacgatgacggtccggccgtccaccgcataggccgtggcgttgcccatcatgtcgtcgtcgcctaaataggcgaactcgtccggccctgatcccagcagataatcgacattcggaataatgcgttcgagtgcagccgcgaaatcggggtcgagcacgccgtcgtccacacgcaggttcaggtcgaaagatgtagggactccggcatcgtgggcctgttcgaagatgcggatgatcgtctccctagcgctggtgtcgtaggtcaggcacatgcccgaggagtggacccaatccgcctcacgaatcatgtgcatcggcacaaggttttcgtcgagcaccttgaacgattgccgttcgcgaggccatccccacaggtacctctctccgcggtcgtccacgaaagcgaatacgccgaccgtgctcagggtcgaatccgcaaccagcccggtcacgtccacgcccgcatccttgaagtcctgcataacgaaacgcccgtactgatcatctcccacggtgcccacgaacgatacatccaggccgagcttcgccaacgccacggccgtgttcgccgaggttcctcctccctcgatgccgatctgcggatattcgacctgcgtgcgctcctcgttgagaaaacgcggatagggcacgatgatatccacattggcatcgccgacgacaacgaccttaggcatctttggccgccttgataaaagcctcgaccttggccgggtccttgcaccgatccgtatcggcgcgatcatcgtcgtaattggtcagggagaacgagtcgacgccatacgggtgcgtggcataaatcgcctcggccacattggaggcgtccagaccgccggcgatgatgcacggcacgtcggtggcctcgatgatggcccggtcgatggcccggtcatgggtcaggccggtcgctccgatgtctccggcagcaggtgctttggtgtcgatgaggaagaagtcggaaaccggctcatagtccttcacatactgcatgaccttctgttcgtcgagaggcactccggctagcaccgggatggcctgcatgatcttcagttcggggaaccggctcttaagttccgccacttcggccggactgatgccttcgatgtcgccggacaggtgcaacacgtcgggcatggcttcgcgcaggttctcgctgatttcgtcgatgtcttcggcgacggtcaggcctatgcgcacggcttgtggttgcacgccttcgaagatttccctggcccgttcgcaatcgagctgaccgggcgtccgcttgattttgccgtaggagacgccgatatgttcgccgcccatgtcgattaccatgcgagcgtcctcgacattccttattccatagatttgagcaatgacatcagccacgatggttcctttcctgagcaatggcgttgatgaacgcggggacggagaataccgtctccttgaggcctgcaccctgagccactcgggtgacgggcggcggcgtcacgaaggaacgccgaagtgtgtcggtctgggcaaacacctcgcgggcctggccatcgagcagcacgcggccgtggtacatcacgatgacacgggagaagttcgcggtgacgaatttcatgtcgtgcgaaatcgtgatgcagagtctgccttgtgctttcagacgttcgatgatgcgtgcaaggcgggcgttgcccgacgcatcctgaccgcacgttggctcgtcgaaaatcaccacggatgggtccatcatgatgacggcaccgattgtgcagaatttcttctcggtgggcgtcaggtcgaatgggtgcacgtcgagctttttggtgaggcctaccagctcggcgatgctgtccacgcgatgcgcgatgccctgatcgctcatgccgatctggcgcggaccgaattcgaattccttgcggacgctttccagaaacagctgatcgtcgggattctgaaagacatagcccacgctgcgagaccattcggcggtgctgcgctcattgacgtcaatgccatcaatcagcactttgcctccggtggggcgcagaatgccgttgaaatgcttgaccagcgtggtcttccctgcaccgttctgccctatgatcgccaccggctcgttgccgtcaagtgtcaagtccactccgtcaagggccttgtcccctccgggataggcgcgctccagtgcctgcaactcgattttcatgagagcgcctccttggccatgcggatggccggctcctcggtaatggcaatcgggccaccgagcgcacgggtgatcttcacgtaatcgggcacttccacgccatgctcttcgatcgccggatcggagaacacctccatcggagagccaagggccacgacttcgcctcgctcgagcaccatgacggtatccgcgtatcgtgccactcgctccatgtcatggtcgaccatgatgacggtgacgccgtccgcattgagctgtttgacgatgtcgaaaatctcctcgctgcccatcgggtcgagctgcgtggtgcactcgtcaagcaccagaatgcgcggttccatgatgaaagtggatccgaaagccacacgctgcacctgtccacccgacagttccagcgggttcttgtctagaatgtggtcgatgcgcatcaatttcgccacagcttcgacgcggtcgatcatctgcgctctgggcacaccgtggttgcctaatccgtaggccagctcttcggcgacggtcccggcggtgtaggacagctggttgaacgggttctgaaacaccaggccgatggtcttcgacagttcggcgatggtcgaatcggcgacatcggtcccgtcaattaggatgtgtccagcccccgcccccacgaaatagtgcgggatcaggccgacgagcgcattgcataacgtggatttgcctgccccattcgcgccgatgatggtgaagaagctgccttcctcgacctggaagtccacgtgtttgacggcccgacgcttggtgtcgcggtacttgaaggagaaatccttgacctctactatcggactcattcacttgcctccccacgagaccggcaacggaatcacaccgatgcggatgcatacggaaacggcgaccacggcgatcagaaacaggacgaagatccaattgagtaccttgtcggcggcattccagctgaccttgacataactggtctgcttcactccagtaatgccgaagccgcgagtctccagggtcataccccgctcctgggcgtcggtcagcgatgacatgacaaccggaccaagcaacgggatatacgccttgatgcgggcgatgaccccacccgatgcatcgagtccgcgagcggattgcgcctcctgaatcaccgccatacgtcgttgcatctgcggcacgacattcaggctggcgagcaccaggtatccgaccttggcgctgagccccaccgaagtgagcgcggataccatagcaccgacataggtggttttgttcatgatgtagaagctgccaagaaacaccagcaggctcaccaccactttggccgcatacagcacgccttcgagccccagttgcgcgaagccaaaatccagtaatgcggtacggttcttgggactgtacagcccttggatgaacatgagcatcacagtgacggggatgccgaaaccgaacattatcttggcgaaatcacgctgtatatgagccaagaacgagaccacaagcagcaacaccacgagtatcagaccaagcgtgaagtcaggccatgccaatgcggacagacccaaggcgaacacggccgctatcttggtgatcggattcagcttcccaattacggtgtcattgatgaccggcatatgcgacgacatgtcttactcgtcttcttcttcgtcatcatcactcagcgcatcattgtccgagccgcccatggagtcggccgcatactggctgagaaagcgacggggaatcttctgcacgatcacccacgcgatggcgacagtgatgcccttgtcgaggaggttctcgatcagcgacgaggagatcaccgaggcgagaatgtctttcatggccacgaccagcgttgccgtcagcaccgatgtaccgttgacgccggtggcaccgccgtatacgaatgtggtgatcagcgatgcggagatcgcattgacgaacgtgcacaccagccagatgaccacgacgccccacttcttgtggaacagtccggccttgaccatatagccgacgaccaaaccgcacaataccgacaccgccgcatagggaagatagaccgggttggctaccagtgccaggaaaagattggtcagcaggccggtcagggccgcgacccatggtccagacaggcatgcgacgacgatggtgccgatcatgtcgaggaacagcggcagcttgagtgcggagcacagagttccgccaatgagattgattccaaccgcgatcggaatcagcaccaggcactttgtggagaattgtgccttgatcccttcccagaacgacagcttccttgccatgctggccctcctttattttccaaccctcggttttccgcagtgtgcaatctacattgtttgtcttgcggaatcttaggaaatcattttcctaaaatgttttcttgagataagattataggacgccaacgtcagtgtcaacacggcgggtcgagggtcaagcaacccggaccgaacggcccacaatggcgacgtagcaaggaacagaacgctacgcccttgtacactgatacagaggaaaacaggcaggaggggagacatgaacatcagggacatcgcacgcatcgcgggcgtctccacctcgacggtctccaaaatcgtcaacggcaaggattccagcatcagcgaggaaacccgcaagaaggtcctgacgatcgtcaaggaatatcattacaagccatatgcctccgcctcacagcgcacgcgtagctacaccatcggagtgctgctgcgctcccccatctccttcgatagcacgctggacggcatcatccaggccgcccagaacgccggatacgcaaccgatgcctacaacagctattccgatccggaacgcgagctcaaaaacatcgcagcgatatgcggccgcaacgtcgacggcgtcatctgggaaccggccactccggacagcctcgcctatgcctcgcaattccccgaaagcaccccactgctgaccataggacccaacggcggcgaccagtcactgctactgccttataaagaagcggcctacaaactgaccagcgagctcatcgaacgggggcaccaacacatcgcctgcctaatgaccaagggacgccgcacgcaggattttctcgaaggctttcgctcctgcctgttcgatcatcagctgccttatagcgacgatctggtctactacgacctcaacgactcgctgcccggcaaaatcggaagccgggacatcaccggatttgtctcctcgcattaccggcgagcactcgagttcacgcagatgatcagccccctgcattaccggcttccagaggatgcttcacttgtctccatcaaaaacgacaccgccgaagcgctggcctatcccggcaacacggaaatatctacctacaccatccgcaactccgacttcggcgcctacctctgcgagaagctcattgcgcagatagagcacgacaaagagcagcatccctcgttcgtacaggattttcatctcgacaacaccagcaccatcgcagccccgcccacttccgccatcaaacatgtgttggtcgtcggcagcatcaatattgaccactatctgtcagtgccgcggctacctcatatcgggggtacggtatccaccaaatcggcggcgcgataccccgggggcaaaggggtcaatcaggcgatcggcgcagccaagctcgggcaccgcgttacccttatcggcaatgtcggcgtcgacaatgggtccgattacatcttcaaggcgatggaacagcatggggtcaatacggccggtgtgcgacgctgcgccggagaggacaccggctcatcgttcatattcctcgcccccaacggcgaatcggtcatcgcgattctctccggagccaacgcgtcgctcaccccggatgacatcacctccaacgaacgcctgttcgacaatgccggatactgcctgatacagaccgaaataccgttggaatcagccaaagtcaccgcgatcaccgcccgacggcaccatgccaaaaccattatcaagccctcgtcatgcgactatctgcccgactccatcgtcgccaatgccgacattctcgtgccgaacgagcacgaactggcgatcatcgaaactgagggaaaaacaatggaggataaggccgcgcatcttctcgaacgcggcgcgggctgcgtcatcgtcacccaaggagaacacggctgctacctgcgcggccagaatgtcgagtgccactatccggccgctgacttcacccccgtagacagcaccggagccggcgacgcgttcatcagcgcgctcgcctcgtatctgatgtacggatacaccgtgcggcaggcggtcgaaatcgccacctatgccgccgggtactcaatcacccgcaaaggcgtcataccctcgcttatcgaccggctctcgctggacgcctacgtccatcacagcgaacagtagcggcacgggtatctgtcttaaggcagtttccaccgcagacaattaaggggaaccgcatctagtctgcggctcccctcagtcagcttcgctgacagctcccctctctgaggggagccaaaaagcactactccagctccaccgcgccggtgtacagctggtagtactcgcccttttgcgcgatcagctcgtcatgcgaaccacgctcgatgatgttgccgtggtcgagcaccatgatcacatcggaattgcgcacggtggacaggcggtgggcgatgacgaagaccgtacggcccttcatcaggttatccataccagcttgcacaacctcttcagtacgcgtatcaatcgaggacgtggcctcgtcaaggatcagcgcaggcggatcggccaccgccgcgcgagcgatggagatcagctggcgctggccctgggacaggccggaaccgtcgccttcgagcaccgtgttgtatcccccgggcagcatgcggatgaagctgtccgcattgaccagacgcgcggcctcgatgcattcctcatcggtggcgttcaggcggccgtaacggatgttgtccatcacggtgccggtgaacaggttcacgtcctgcagcacgatgcccaaagacctgcgcaggtcaggcttcttgatgccggccacggagataccatcatacagaatctggccttcctgaatgtcgtagaaccggttgatgaggttggtcacggtggtcttgccggcaccggtggcgccgacgagcgcgatcttctggccgggcttggcgaaccaggtgatgccgtgcagcaccggcttgtccgggttgtagccgaaggtcacgttggtgaagcgcacgtcgccgcgcagcagggtcagtcggccgtcgggcgaggtgatcgcctgctccttggccttcatcgccacctcgcgggccgagcccttgagcttttctgcggccttcagagacctcgtaccgtcgtcgccgacctcgcgcttccatgcccagtggccggtctcgtggtcgacttcggtcatggtgcggccatcctcgccaagttccacgttcacgagcgtcacggtgcccttgtcttcctcgatgggctcatccatcagcttgaagatacgggaggcaccggcgagcgccatcatcaccatggtcagctgctgagagacctgaccgatcgggttgatgaacgagcgggacagggtcagcagggagacgagcgtgccgagggtgagcggcttgacgccggtcagaccgatgtcgttgacgccggccagcgagacggcggcgccgacgatggcaagcaggatgtagagcaggtagcccatgttgccgacgaccggcatggtgacgttgccccaggtgttcgcttcggcggacgcctcgaagagttcctcgttcttctcgtcgaaggtattctgggtggcgtcttcatggttgaagaccttgatgaccttctggccgttgacggattcctccacgaaggcgttcacgtcgccgatccactgctgctgcttgacaaagtagcggccggagcggctcacgatcttgcgcacgatgaagtagagcagaacggtgaacacgattacgaacgcggtgaacggaatggacagccacagcatggacagcagcgccgcgaccgcggagataatcgaggagaacatctgcgggaacgactgcgagatggcctggcgcagcgtatcggtgtcgttcgtgtagtggctcatgatgtcgccgtgctcgtggctgtcgaagtagcggatcggcagcttctgctggtgggcgaacatgtcgtcacgaatcttcttgagcgtgccctgctcgacggtgacgatcagccactgccacagccaggacgccacgatgccggccacatacaggcccgccatcaggctgatggcccgcagcagcggggcccagtcggggttcgactcccccaccatcggcagaatatacgtatcaatcaacgactggaggaacagcgcggaaccggcctgcgcggcggcaccgaccaagatgcacaccacgatggcgatgacgcgccacttgtactggaagatgtagctgaagatgcgcttgatggtgccaggctcggctttgcccatggcgggcttgcggttcttgaaactctggtcgttgctcatcgtgcttctccttccttggtatcggctgcattggcatcagctgcgctggtatcggccgtgggcatggtcactgtcaccgtcacggtttcggacggctcagcggtagatgactcagcagcctgttcggcagcggccagttcttcgggctgggcctggttcttggtctgggattcgtagatggaacggtattcatcgcaggtggcgagcagttcgtcgtgtgtgccggacgccatgatgcggccggaatccatcaccagaatcatgtcggattcctgcacggaggccacgcgctgggcgatgatgatcttcgtggtgtccggaatctcgttgtggaacgcggaacggatcagcttgtccgtcttggtatcgacggcgctggtcgaatcgtcgagaatcagaatcttcggcttcttcagcagcgcacgggcgatgcacaggcgctggcgctgtccgccggacacattggtaccgccctgctcgatgtacgtgtcgtacttatcggggaattcctgaacgaatccatcggcctgcgcgagctgcgcagcatggcgaatctcttcatcggtggcgttcgggttgccccacctgaggttttcggcaatagtgccggagaacagcacgttcttctgcaacaccatggccacctgatcgcgcagcgcctcgagatcgtagtcgcgtacatccacgccgccgaccttcagcgaaccggagctcacgtcgtacagtcgcggcacgagctgtaccagagacgactttgccgaaccagtaccgccgacaatgccgacggtcatgccggagcggatcttcaggttgatgtcgtcaagcacgggcttttcggaactgtcggagtagcggaaggtgacatggtcgaattcgatggagccgtcggccatgtcagtcaccggctgtgccgggttctgcaccgtgctttcctcctgcagcacctggcagatacgctcggcagaagcctgagaaataatcaccatgacgaagatcatggacagcatcatcatggccataaggatctgcatggcgtaggtgaccagtgcggtcaggtcgccggtggtcaggcccacggcggggttgttgccggaggcgacgatctgctgcgcgcccatccatgcgatgaggatcatcgaaccgtagatgcagatcatcatcagcgggctgttgaagctcatgatgcgctcagccttggtgaagtccttgaagatgcgctgggagatgcggccgaacttggagacctcgaaggattcgcggttataggacttgaccacgcggatgccctgcaggttctcgtcgaccacgttgttcaacgcatcgtaggtgtgaaacacgcgctcgaacaccggatgcacgagcacggccagaccgcacaggccgatggccagaatcgggatgcaggccaggaacaccatggaaatcgacggggagatacggaacgagaacagccaggatacgaccaccataatcggggcacgcacgcccagacgaatgatcatcatgtaggcgttctgcaggttcgtcacgtcggtggtcagtcgggtcacgatcgaaccggtggagaaccggtcaatattggtgaagctgaagccctgcaccttctcgaactggtccttgcgcaggttcttggcgaagcccgcgccggccacggccgcgtactttccggacaggaagccggcacccagcgaaaccatcgagcacaccagcagaatcacgccgaacttgacggtggccggcatgctgccaccggtgataccctcatcgatcagcgaagccatgatggtcgggatcaggatctccaggatgccttcgaccgtcacgaacaccggagccaggatgctggctttcttgtattcacgaatcgactggcccaacgtgcgcagtacatgtttgggcttgtccggttcgacggctttgcgcgcctgcgcgattgcctctgcggtatcgctcattcgttctcctccttcgtgttagcaacctctgctccgtcttgatcgggagccatcaccacaggtgactgagggagtgtttgatgttcaaattcgcgttgtgcgcgctcgatgttcgcacgcatgcgtgcgacgtagtcgcgcagagcggccttctctccatcggagaagccgccgaccagcaaccgttcgacccgatcgccgttcgccttgagatcggcgacgatcgcgtccgccttgtcggtcaggacgatgcgcttgcagcgcgcgtcatgctccaccgattcacgggcgatcaggcccttcttctccatcagggccagcacacgcgaggcggtggaccgggtgatgcagaatttctgttcgatggtgtgctggtatatctcacggccgcggttacgcgccaagaacatgatgatatgcgcgttgccgccggtggtttccctggcggtttgcggcatgctctcgcccaaatagcggtcgacggctttggttaccgcgcgcatttcgatgctgagaatatgctgatccattgtcctccgtaccatgcgggggccgtgtgcgtttgtaccttcaccccacattgttgtatacgcaacaattcatgataaagagacctatatacaacagttgcacatacaacaatcggcgtgttgtagtatctccaaacaactgttgagcctaaacaaagctggctcccctcaggagagggaagccagctgtattacgccgtgcgattgcctcgcttcagcccttacttcgcgagcttggcgtactcgtcaaccatgaactgggcgatcttcttgccgccttcgcccagcagggtgggcagcgagttgatcggcatggggttgaggaacatgcgcatcatggcgttgtcgggcagcttcgtcagctcgccggcctcgccggcggcggccacggcggccacgatcttggcgccgaacggatcggcctcccactcgccgtaggtggaccattcggtgagcggctgggtcttgccgtcgccatcgagggccacggcaacggtgtcggcaatgtcgcgggagctcacgcccacttcgatggcatattcgccggcctccacgtgccagtcgttgtatttttcggaccagtaggcgaacgcgcgctcgtcgaggtcgatggtcacggtcttggattcgccggccttgaggaacaccttggtgaagcccttgagctcgtgcttcgggcgggccacgtcggccttgcccggagccacgtacacctgcacggtttcggcggcatccacatcggaggtgttggtcacggtggcggtcacggtggcggtgttcgcgccggtcttggcggcggcgacgtcatcgatctcgaatgtggcgtagctcaggccgtagccgaacgggtagtccacaaccttgccgtaggtgtcgtagtagcgatagccgacgaacacgccctcgccgtagtcgacgtggccttcctcgcccggccagttcagcgtgctcgggtcatcgctgatgtccagcggaatcgactgggcgagcttgccggacgggctgacctggccgaagatcacatcggcgagcgcagggccgccggcctggccgagcagacaggattcgagaatgcccttggcgttcttggcccacggggccacggagacgacggagccgttggacagcacgaccacgacgttctggttcgcggcggcgacctgttcgagcagggcgatctgcttggcgggcatgtcgagggtttcgcgatcgaagccctcgattcaaagcatccggcgcacgactatttcgcggaccgcgagcgccgcagcgtgacgaacgcgctcaacatcaactggtcagtacccgacggcgcgaacgtggagcacgtgcttcaggcgggcctgtcgatgatggacggcattcagctgcgctggctgcgctctcccggtcgcgatctcaacgccatgtgggtcgactgcgaggatgtgctgttcccctcccccttatgggacggataccgctgacccttccgtaaatcgcgcgtctcgcacatcacctccgccaccgcgtcatcaatcaccgtcatcccgaaccatcaccccatccatcccgcatgccagacatgccgcagatcccaagggtcgaggcgcgtgtcgtccatcacggcggcgtccccgtcacccataccgggcgcgggaggcgcgagacggtcaaactcgccgcgaccgccgcgcagtcgatagctccagtagacctgaccggcggagacgttccacgcgtcgagctgcatggcggcgacgcggaggtagacggcgcggcggcgcgcggcgggcgacgggacgccgtccccggcgtcgcccgcgcgcgaaccgacgtcaccggatgcgccgtctccaacatccgcaccgccgtcaccgaacgcaccatatccgtcgaacgcaccaccagacgcatcaacggacgcgacctcaccttgcgccccgcactcccccatgcgcgccgcaagcccgttcgccacgcaccactcccccaccatgaccggcgtaaagcgcgcggcacggcggatgcggcgcgcgccccacgccgcgaacagccggtaccagcgcataagccatgcgtccggcagtatgcggaacagcacctcgggccgttccgacatgacgagatacgcgtgcgtgtcgatgatgacgccgcgcatgccctcacgtacgaaccagccgcgccagcggttcaggcggaatccgtcatggaacacgatgaccggcccgtcgcccagcaccgggcgcagccatcggtatgccgcccgatagaaccgtttgaggaagcgcatcggaacgtggccgctcccccgcgcctcccccggatccttcgcccgggagctcgacggcgacatgagataagtgagacggtcgaccggctcgttgagcacttcgatgccgtacaacgcagggcggtcgcggtaacgtcgcgcgagacgctcgagcacgtccagtgcgaacgcaacctgccgcggcgtcgtatgccagcggaccacgccggtcaggccgccattgtcgaacccgttctgcgacccgggcacggtgtgcaggtcgatgagcaccttaagcccggccctctccgcccagtcgaacgcacggtcgaggtattcgacgcatccgggatgcccgggcacgtcaccgaagatgaaaaacggcacggggatgcgcacaaggttcagcccgtgcgcggagatggcgcggaagtcgtcctcggtgatgtacgtgtcgcggtgacggcgcagcaggcgctccagttcggccgggtccgtggaccggtgcagccagatctcgtcctcctcgccgctcgcacggaacaggccgggcgtcatccaccgttccaataccagccagccgccgaggttcactccgttgattcgcccatcgtcttccggcatggccctctcatcagtattccgcatcattgctccgttccgcacaaacgacaccgcccgctccagcatacgaccggagcgggcggaaacatatgaggcccacacgaaaccgattcacacgggaccggctcacgcgagagcatctcacgcagagcagattcacgcgacggtgaaggtggtgcgcttgaggtcgtcgcggcgcgacgagtggccgatgagcagctcgaactcgccgggttcgacgatgcggttcgcatcggcgtcggcgatggtgcagtcgcagaccggaatgtcgaacacgacggtcgcggtctcgcccggttcgagcgtgacgcggcggaacgccttgagttcgcggtcggcccagctgtatgaggtgacgacgtcgcccacgtacgcctgcacgacctcggtgcccgcgcggcgccccgtgttggtgagggcgatctcggcgtgcacggtgtcggtctgcgcgaacgtgccgtccgcgttcgaggccccgccgacgatcgtcggctcaccgtacgcgaacgtcgtgtagccttcgccctcgccgaacgcgaacgccgggtcctgcgtaaggtcggcgtagcggttgccgtgctggccgcggatctggttgtagtagaccggcagctggcccgcgtggcacgggaaggtgatcgggagcctgccggacgggttcacctcgccgaggatgatctcggcgatggcctgtccgccctccatgcccgggttcggcgcccacaggatggatccggcgccggacttcggatcgttgcaacggccggcgagcacgccggaatcgcccacgatggaacgcggcagcacctgtggcttggagctcaccagcacggtgaccatcggcttgccggtctcgcgggagacgtcggcgagtgcgtcgagcagcgcgttctggccgccgagcagttcaagcgtggcggtggaacaggtctcgccgaccagctgcaccacatcgcccacgacggcgacgatgaggtcggcctcgcgcgcggcggcgacggcctcgtcgagcagggcccggtcaacgggcgcgctcactccgatcttcgggcgcggctggccgtccgggtagaactcaccctccgggtcgggcacgaggtcgatgacgttggcaccgcgggcgtaggtaacctcgcatccgtcgccggcgagcgcacggaagccgtcgagcacggtggtgatcatgccgcgcggatgaccgtcgggcatccagccgacttggccggagctgccggcccagtcgccgagctggttctgggcgtcgtcggcgagcgggccgaccacggcgatgcgcttgcgcgcgggcgcgtcaccggagccggggatcgcttcggccggcgccgcgtcgaacggcagtccgccgtcgttgcgcagcagggcaacggcctcgcgagcgagctcgaggttcacgcggcggtgatcctcggagccgatgacggccttgatgcgcttctcgtccggcagacgcgggtcctcgaacaggccgaggcggaacttgagcgcaaggatgcgcgcgacagcctcgtcgatgagcgactcgtcgagcagaccggtgtgcacggcctcgatggcgccgtcgtagaaccccggcgtggtcatgaccagatcgttgccggccttgaccgcgtcggcggcggcgtgcacgtagtcgggcttgaccttctgctcccatacggaacggcccacgttgtcccagtcggtgatgagggtgccgttgtacttccatgcgccgcgcagcttgtcggtgagcagccacttgttgaacgtgaccggtacgccttcgatggactcgtagccgagcatgaacgtgccgcagccctccttggcgatgcgttcgaacggcggcaggaaccaggattcaagcttgcggtggctcaggtccgcttcggaggcgtcacggccgccctgggtctcggagtatccggcgaagtgcttggcgcaggcgaggatcgcgtccttcggcagcgtctcgccggcctgggcaccgccctgatagcccttgaccatggcggaggccatctcaccgatgagcatggggtcctcgccgaaggtctcgtccacgcgaccccagcgggtgtcgcgcgcgatgcacagcaccggggagaacgtccagtgcacgccggtcgaggagacttcttcggcggtggcacggccggccgcttcgacggccttcgggtcccagctcaacgccatgccgagctgggaggggaagatcgtggcgccgggccagaaggagtagccgtggatgcagtcgtcgccgatgacgagtgggatgccgagacgggtcttggtgttcacggtttcgacggcgcgcggcaggtcctcggggctggtgtgcaggatggagccgacgtgcttgttcacgatgagctcgtcgaggtcgccaccgcgggcgtcgagctgcatcatctggccgaccttctcttcgagggtcatgcgggagagcaggtcggcgatgcgctcggaggcgggcaggtcggggttcttgtagggcagcgtttcgactgtggtttccggtgtggtcgcggtcatggttgtgttcgcctttctgggttccgtgcggtcactcgatgacgaaggtgttgaaggagcgcggggcgagcgtggccttgaagccacgggaggcgtcggccgggtcggcgaactcgaacgggcgttcgtcctccagcgcgttctgggtcacgaccacgatggtgccgtccgggttgcggaaggcgatggccatggagttgaagtggctggtggtgccgagcaccttcgcgccggggcgcacgtacttggagaagtggcgcatcacgtagtattcggggttgtggcgcacctcgtgcgtgtcggcggtgatggtgaacagggagttctggcgcgaccccggccagccgaccaccgaccggggttttcgtaatcctagaccaaacacacccggcacctggcaggccgcggccggtacgacaagggccagaacgcccgccaggacgctccggcccgaatcacggccggcatggaacccggtcagcgctggaacacgtcggggtgcttcggatctccgggaatatcgtcgagcaggccctcgaggccgaggaactcacgccagaagtcgagcggctggccatacgggttggattcgcggccgtgcgcctggatgttcgccttggcttcgaacacgtcttcctcggtgagcccgtcgaagtagctttcgagacggatgcggttggacggcacgtagtacagggacgcgatgatctcggtgagccgttcgacgcgttcgatcggcagcgaatcccagtggcggaactcgatgaagttcttgagacgcacgtcgttgaaatgcgtggagatgatgtggttgatttcgtacgcgttgagctcgcggtccgggtagacctcgccagcgttctcacggaaggcggcgcgatgcagctccttgcggctcagccccgattccaccgcttcgggcgtgtgcgtcaggtcggcgaacatcagcggcgtggacagcacgtcacgcgcgtagtcctcccagccgaaacgctggtcgaacaggccgggggtcacgttggtgcgctggaagtcgaggtagtcccacatgcgctggcgcagcagcggatacgggttgagacggccctcgaagtagggggtgttgcggaagaaccatgcgagaatcggcccgatggcggtgccgacgcgcatcttatcgatcgaatccttctcgtcgacatagtcgatgctcacctgggtggaggcggagcagcgcatcatgcacggaccgaactggccgacgcggccaaggaagtcggtcatcgcgtcatagcggcctttcggattgaccggcacgtcgacgaaactcgacttcggctggtatccgtagttgacgaaacggaagcccagctcctcgaggatcgggtccgcctcacaccggaagtcggcgtacaggccgttgaggtcgcccggctcatgaagcacgccgatggaagcctccacctggccgcccggttcgagcgacaccgcaacgccttcgcgcgcgagtccgaccagatggccgttctcccagtattccttgctttcgtcataatacggagcgagccgtttgaggaacgcttcgatgccgttcggctcgtagtagcttacggccgtgtcgtcggcgtcatgcaccggcagatgctcaatctcgacacctaaaccaccggtgccgcgcttggagcgccccgcctcgaagaacttcagaaggctctcgacatgcttcgggttcggctcggcgagcaggtgcgcatagctgattctgggagtgaccatgaacggtatcgtaggcgagtcgcgcgacgcgcgtcgccgcgcgcccgcgaatcggctatatctttttccgataaccggcacgtcgccggacatccgccatatcacgccgcaacgccgcaccgcgccgtcgcaccacaccgcgccgccacgcccccatcaccgcacgccacgcctccgcaacgccgcgccacaccgtacggctttgccgttatgcgcgatgtcggatacactcattgatttgtaaaccttgtttacaaaaacgtccggcagagaggccggaccacaccatcaacccaccatcaacccacggcgaacagccggaataaaagaaaaacaacagaaaacaacagaacacggaaaacagcaacaacccatacaaaacaccggcaaccataagcacgtcggaagcacaccggaacgcacaccgaagcgcaccggcgaccgctccggttccacaccgaaaccacgccgaaggccataccggaaacggaccgaggacatatcggacacgcccggcaccccaccggcacgccggtgcgccacaatcgaaaggaaggaaagcggcatgacatcccgtcagggcagacaagccatagccgcgacggccgcaatgggcgtggccgtcgcgctggcgttgccgaccgctgcgttcgcgcagtcagcaacgcaaggaaaggagaccgctacgaccacgtcatcaggcaccacctactacgtgtcgtcggcacacggcgacgacgccaacgcgggcaccagcgaaaacgcgccctggaagtccctgaccaaggtcaacgacatcgcctcggacctcggtccgggcgattcggtgctgctggaatacggctccgaattcaacgaccagtacctgcacatcaaggacaccgccggcaacgccgacgcgccgatcacgatctccgcctacggcgacgccgacgaaggcaagccggtcatcgcgtcgaacggcgtcaaaggcagccagtgggagcaggactaccgtgccaacgtcggcaaccacaagaacaagggcaccgtctcaaccacgctgctactcaaggacgtgtcgtacatcaccgtctccaacctggagatcaccaacgacgacgcggacgtctacgatccgatcgacacgtggaagtggaccgacacccctgattccgacggcacaaaactcgaccgcagcgcctcgcgcatggaccgcaccggcgtggccggcatcgccgagaacggcgcgacgatgagcaacgtgacgctcgacaacctttacatccacgacgtggacggcaacatctacaacaagcacatggccaacggcggcatctacttcatggcccactaccccatggagaacacgagcgccgaaaccgacgtctggctcagggagcacgtctcacgcttcgaccacgtcaccatcagaaacagcaccgtcaaggacgtggatcgttggggcatcgccgtcggctacaccgcctacctcaactacatcgacgcgaactacggcgacggctccatcgacgacgccctcatcgcgaagtacggttccaccaacgtgcgcatcgagaacaactacgtcaagggcgccggcggcgacgccatcaccctgatgtactgcgaccgcccggtcatcgaacacaatgtgggcgacagcgtctcgaagcacatcaacacgcaggactacacgcagcccggctcctacggcggacgcgtggcggccggcatctggccgtggcgttgcaaggatccagtgttccagtacaacgagatgtacaacaacctcaacgccgagcacggcaacggcgacggccaggcgtgggacgccgactacggcgacggcacgctgtaccagtacaactactcgtacggcaacagcttcgcctcgctgatgatctgcaactggtacgcggttaacaccacgttccgatacaatatctcgcagaacgaccgtcagggcgtgttcgacctgccgtcgaacggccccggcaaccacatctacaacaacaccgtctacgtggacgccgacagccaggtgctgactaagcgttccaactcgcagtccctgttcgagaacaacatcttcatcaacgcgaccaacacgaagaagacggagacctggaaccgcggcagccagaacggcggccagacgtacgacaacaacatgtacgtcaactacgcgaacaagcccacctccgacgccaacgccatcgaggccgacgacgtgtccgcagtgcttgcgggcgccggttcggctccgacatccgccctcaagagcggcgccgagcatgcgcgcaccggcgagaaagccgcgttcgacggctaccgtccggtcgcgggctcgaaggcgatcaacgccggcaaggtcgtctccgacctcaacgactacgcggtggagaacgacttcctcggcaacgcagtcaagggcaggcccgatctgggcgccgtggaaagcgacgtggtgtccgtcacgatggcctcctccaagtacgagaccggaaccgaaaccgattccgggaccggtgacaagaccaaggtcatccacgtgaccttcaccgacaagaacccggtgaccgtcaaggaactgctctccaacgtgtccgccgacaagggcgtggacaaggccgtgtaccgagtcgccgacgccaagtccggcaagtccgccgacgccaggtccgccgagtccgaaccgaacatgctcgaccgcctgctctccctgctcccaggctccgaccggaacgccaaggacgacgagacgaagctcgccgactccgaaccggtccgcgatggcgacatcctgcgcttctccgccgaaggcacggacgagaccgacgagtacacgatccgccagcgcatcacgtgggattgggtcgcggactacgagcaaggcgtcgccgacttcgactggaaggcgcagcgccgcacgtccgccggcggcgagtggaccaccatctccgcatacgacggctcgtggccgaacaccgtgtacgaccagtactacggtgtcggcgtcaacggcaccctcgccgaactctccggcgaccgcaagcagacgcacggcctgctgatcgacaagcccggcgacggcctgcccacggccatggcgtggaaggcgccggagtccggcaccgtcatgctgtcgctcaagacgttcgccgacaagatcgctgaaccgtacctgcgtcagaacgcggacaacgccggcaagaaggtcacattgtcgctgatgcgcaacgacgagacgctctgttcggccgacgacctgtccgtctatcagaagtcctccgaacagttcgcgcagtgcctcgccgagcacggttcgatcgacgtgcaggaaggcgactggatccgcatcgtcgccgacgccgagaccggagtcaaggcgccgtcgctgcacatcagcccggtcatcacatatgaggacaaggcgcccgccgcgccgaagcagaacgtgcgctacgacgtctcgtacgccgcgacggacgccgtcgtcggcacgcagtcggccgtcgccgccgcgttcaccgcggacggcggcgaggccgacgcgccggacggcgtcgcgttcgccttcaaggacggcggcgatgagggcgaggcctcgcccgtcatcgacgcgtccaccggcgccgtcaccttcacgcccgccgccggacagtacggcgcgaccgtcacccgcaccgtcgtcgtcacgtacgcggacggttcgagcgacgagacgaccgtcacgttccgtgtcgcgcaatcgcacgcgcagcgtctcaacgtgctgtacccgaccgtgcgcggcgacgccggcacggacctgaagcgcacgccgaagttcacgctgaaggcggacggcgcggccgcgtctgtgccggaaggcacgacgttcgcgctcggcgcgaacgcgccggccggcgcgagtgtcgacatggcgaacggcacggtcacgctgaacagcagggtcggcggcaccgtcaccgtgcccgtcacggtgacgttcgccgacgacggcgccagcgtctcctccaccgcccgcttcgaggtgaccgcgcccgccgcgctcggctcgtccgagttggagaccgcgactgtcgacggtgtgaacgtcgtctacgcgccgttctccgccgacagtccgatgaccgtcgcgcagctgctcgccaaggtgacggccgaaccgtccggcgccgataagggcgtgtaccgtgacggcgtgcggttggaggccggcgcagaactcgccgagaacgacgtgctccgcttctccgcgaaaggttccaccgtgtccgacgactacgtggtgaagtcgaagaccacgtgggattgggtgaacgacttccaggtgcgcgtgcagggtccgatctggtacgggcagcgtcagaccgaggccgacggcgtgtggtcggatatcgccgacttcgacgcgacgtatccgaactggatgtacgagacctactacggtccgggcgtggactacgcgaaccacagcctgcccaccgaccgctccgccatccatggcctgatcagcgattcgcccgcgtccgctggtggctccgccatggcgtggaaggcgccgaaggccggcacggtgaaggtgtccatccgcgaggacgagccgtacctgcgccaggacggcagcaacggcaaggcgttgacgcttcgtctcatgcacgacgacaaggtggtgtgcttcgccgacctgaccgtctccaagcagcgttccgaggagttcgccaactgcgtcgccgacaagggcgagatcgcggtcgaggcgggcgattggatccgcgtcaccgcgacgtccgcgtccggcatgaacaagccgtccgcgcacatctccccggtcatcgcctacatggccgcctccacgccgggccccgaacccgttccggtggacaagtccacgctgaaggccacggtcgaggaggctctgggattggccgagtcggactacacggatgagtcgtgggccgcgctcgtcgccgcgcgcgacgccgcgcagaccgtgctggacgacgatgccgccaccgccgaacaggtcgagaccgcgcagaacgcactgcgtgacgccatcgacggattggagaagaagccggtcgatccggacccgaacccgaaaccggatccgaaccccgatcccgatccgacgcccgacccggaccccgaccccggccccgacaccaagccgggtgacggttccggcaacggttccggcacgggcaacggttccggcacgggcaacggttccggttccggcaacggttccaccggttccggcagcgacggcgcgaccaccggcggcaagctgaccgccaccggcgccgacgtggccggcgcggccgcgatggtcgcgctgaccgcggccgccggcatcggactggccgccgcggcccgtcgccgcaggtgaccgatgccacgtaggcaccggttcgccgccgccatcgccgcagtcgcggtggcggcggtcctgctcgtcacattgaccgtcgccgtcgtcacgcacggcgacggcgccttcgcgcccgcaggcacgcctgcgggcgcgggcgcatccgccggcatcggctccgataccggctccaatgcaagcgaggattccgacatgttccccaccatcgtcttcggcgacaccgtcatcgaacgcaaggagtacgtcgcggcgctcaaggcgcaacacggcgcggcgcggctgtactttcggcagacgtacggcgtcgacccggccgaggacggctgggataaggcgcacgacggcgaggtcccgtgccgttggctcgcgagccgtgccatcgacgaactgcgacgtcggcacgccgcgtacctcatcggcgtggatctcgggcaggtggccgacgactcctatgcgagcatcgtcgcgcgcatggaggccgtgaacagcggcaacgcggaactgaaatcggacggcggcatcgtctacggccgtaccggcttcgacatcgacagctacctgagctacgaactgtccgcgttgaagaacgcctatacgggcgacgagtcgaaccccggcatgagcctgtccgacgacgaggtgcgacgctactacgacgagcacgactggacaaaggacggcgtcgacgggaaggctccgctggacgaggtgcgcggcaacgtgaaggcgcagatgcggtcggaacgttacgacgagctcgtgagccagcgcgccgaagcgatcgacgtgaccgacctgccatgggacgcgctgtaccggttcacggcaggcaggctcgggtaggacgggtgtgaccggtgccggccgaaaagcaccagaacgaataaggcgggtgtcccgttccatacggaatgggacacccgccttgtcgtaggccgcagaccggtttgcccggtctgcgccggtctggtgccgaccgggcgtcggttggacgtcggtttgaggtcagtcggcggcagtgaagccctgcggctcgtcgccgtcggcgaacttcgccttgtgcgccttcttcgcggccgcgatcatcagcttgatgcggttgagctggttcgcctcggaggcgcccggatcgtagtcgatggacacgatgttggcctccgggtgcaggcggcggatcttgccgaacatgccgcggccggtcacatggttcggcaggcaggcgaacggctgcgcgcagatcacgttcgggcatccctgttcgataagctcgaggatctcggcggtgagcagccagccttcgccggcctgcacgccgatcgacgtgacctcggcagccttctcgacgagttcgggcatcggatcgtcttgcttgaacttgccgtgagaggtggcgatggccgccttgatcggcgcgttgtagcggtcgaggctccaacgcatgagcgcgtacaacgtcttgttgccgccggtgccgagatacttctcgttccagtcggtgatgtacgggcgcgtggtcatgaactccatgatgccgggcaccacggcctcgcaatcctgcgattcgatgacgtcgacgacatggttgttcgcatccggctggtatttgacgaggatctcgccgaccacgccgacgcgcaccttgcgcggcacgtccttcaacggcagagcgtcgaagctcttcacgatctctcgggcgagcacggggtacggcaggtagcggcgcttgagccacggggtcttcgcggccgtcttcgagaagccgtggtgttcgagcgcctcgcgcacgatcacgtcccactgctcgtacaggcggttcgccgcgcccttctccacctcgtacgggcgcacgcggtacaggcacttcatgagcaggtcgccgaggatcagcgccttgacggtgcggtgcagcagcgcgggcgtcaccttgaagcccggattgtcctccaggccctgcgtggagatcgcgatgaccgggatctgcgggtaacccgcgtcgatcagggccttgcggatcaggccgaagtagttggtggctcggcacatgccgccggtctgcgtaatcgcgagacacaccttgtctggatcgtatttgccttcgagaatcgcgtcgatgagctgtccgatgaccatgatggccggatagcaggcgtcgttgttcacgtatttgaggccagtctccacgtcttcgcgcgaggcgtgcttgaggatgtcgaacttgtagccgccggagcggatcaccgattcgacgagggagaagtggatcgggctcatctgcggggcgacgatcgtgtagtccttcttcatgtccttgacgaacttctcacggtgcgcgtaacgggacatgatcgcgttgttgtggccggacttcgacttcgcggacttcgacttggcgttcgcggcatcgttcgtggtgccgtcgccgagcgcggcgagacgcacatcggcgatgtcgcgcttcgcggcgcgcttggacgcgtcgcgcatcgccttggtgagcttcgggttcgcggccatcgtcgcgtcgagcaggacctgacggcccggcgtgggcgccttggagccggtcttgcggaatccggtggacttcggcgcgttcgcgggggcggcggcgtcgctgccggcatcggccgcgtccacgggcctgtcggcggccttaaccttcgcttcggcggcggcgacggcggcctgcgcttcggcgagcgcggcctgcgcggtggcgagatcggattcggcctgctcctgcgccttgcgggcggcggcctgcgcggcggcgtgagccgcgttgcgcggggcgtcggactcggcggaaccggactcgtcggacgtggcgagcgcggccttggccatgcgcgccttgttcgcctcgcgttcctcgacggcggccttgagcgagcgcaggcggatcttcgccgcgccgaggttggagacctcgtcgatcttgagcagcgtgtacacgtcggccttgtcggcgaggatctcggccacctggtcggtggtgatggcgtcgaggccgcagccgaacgagttgagctgcacgagttcgaggcccggataggaggcgacgaagtgcgcggccgcgtagaggcgcgaatggtaggcccactggttggtgacgcgcaacggcatgcggttgacggtgaccttgcggtcgtcgacgtggcggaatccgttcgcgttcttcttgcgcgggtcctcttcgccttcggacaggaagtcggtcaggtcgagcttctcccccggctgcagttcgcagatcgaatcctcggagaggacgaccatgccgagcgcgcagatggtttcggggatgccgtggttgatttccgggtcgatgtggtaggggcgtccggcaagcacgatgccgcggcagtcgtgctccttcatgtaggcgagggctttgaggccttcctgctggacgtcgtgtttgaagaccttgtcttcggcgtaggcggccttgacagcagtttcggcctcttcgcggctgacgctcgcccatgcgaactcctcgacgatacggtcgaccatgagctcgtggttggcgaggttgaagtacgggtgcatgtagcgcacgtcggggtcacgcagttcgggcatgttcgcgccgacgacgagcggatagttggcgacgaccgggcagttgtagtggttgtccgtgttgggcacgaggttgtcctcgtaactgacgcacgggtagaagatcgtcttcatgcccttgttgagaagccatttgatgtggccgtgcacgagcttggccgggtagcagatgttctcggaggcgatcgattcgatgccggtttcgaacagttcgtggctggaacggccggagatcatcaccttgaagcccagcgaggtgagcagcgtgaaccagaacgggtagttctcgtacatgttgagggcgcgcgggatgccgatttcgcctcgggtggcgttcttgtcggtgaggcggcggtaggcgaagcaacgcttgtacttgtagtcgtacaggttcggacggtcggagcgtttcttcttggcgtcgccgccgcgttcgcagcggttgccggtcacgaagcgcgagccgtcggagaacgtggtgatggtgagcttgcagtggttctggcacagcttgcacacgtcgcgttcggtggtcatcgacatttcgttgagggcttcgccggtgaggattgacgagacggtgtggcgcacgccgtcgacgacgatttcgccggcgtgcgcggcggcgttcggctcgtcgccggcggcggactcctcagccgccgccgcgtcgacggaacgcccgtccgcgccgacgtgcgcgttgtcgtcgtccgcgatgtcctcgtagtgcatgcgggcggtgagggccgcgccgaacgcgcccatgaggccggcgatgttcggtcgggtgacttcgcgttcggtgagcagttcgaacgcgcgcagcacggcgtcgttgaggaacgtaccgccctggaccaccacagtgtcgccgagttcgccggaatcgcgcagcttgatgaccttgtacagggcgttgcgcaccacggagtagcacaggccggcagcgatgtcctcgatggaggcgccttccttctgcgcctgcttgaccgaggagttcatgaacacggtgcaacgcgaaccgaggtccaccggatgggtggaagccagagccttttgcgtgaattcctgaatcgtcaggcccatggacatggcgaaggtctgcaggaacgaaccacagccggacgagcaggcctcgttgacggcgattgaatcgataacgccatcggtgatggccaagtacttcatatcctggccgccgatgtcgatgacggcggtgacgccggggctgaccatttcggcgccacgatagtgggccatggtctccaccacgccctcgtccaagtgcaggccggtggtgatgaggccttcgccgtatccggtggcgcaggagcgtgcgatccacgcgccttcgggcagctcagactgaatcttcttgacgatgttgatggcggcggtcagcgggctgccttcgttgttggcgtagctggaccagacgatttcacggtcgtcgttgacgagcgtggccttgatggtggtggaaccggcgtcgatgcccaggaagtgcgggccatgcgcgccttcgagggtgccgatgtggatgtgttccttgtggtggcgcttgttgaagtcctcgcggtcggcctcggtggggaacagcggcggcatggtgggcgtgttggagggcaggttcttcagctcgtccaaacgcttcaggatttcgtcgcaggtgtaggcctcgaaatggtggccctgatcgtcggaatccgtgtcggcctgcaatgccgaaccgtaggccacatacaggtgggcgtcggtcggcacgatgaactcgtcgaccttgccctcaagcgcgcgctggaatgcggcgcgcagctcggacatgaagaacaacgggccgccgaggaagatgacggtgccgtgaatcgggcgtccggaagccaggccggcgatggtctgcgtggccactgcggtgaagatggaggcggccaaatcgggcttggcggcaccatcattgatgagcggctgcaaatcggttttggcgaacacaccacaacgcgaggcgattggatacaggttctcgtagctcttggccatctcgttgaggccggcggcgtcgatgtcgagcagcgtggacatctggtcaatgaacgcgccggtaccacctgcgcacgaaccgttcatgcgttgttcgggcgtgggtttcaggtaggtgattttggcgtcctcgccgccgagctcgatgatgacatcggcctgcgggtattccttgtcgattgcctcggtttcggcgatgacctcctgaatgaaaggcacatgcagattgtcagcaagcgccagaccgccggaaccggtgatagacaggcgaatcggttcgtcgccgcgtccgaggtccacaagcttcttgtggatgtcgaccaacaggccggccacggtggcacgcacgttggcgtggtggcgtcggtaatcggagaagagggtgtctcccagggaatcggactgatcaagcaccacggccttgacggtggtggaaccgatgtccaatcccacacgcaggggcttcgggtgtgaagcgggctttacgctcgcgtcagtggcgatgtcaaccatgtgttcctcttaattccgacttccgggagtgcacgctttgaggcatcatgaaccgtttcgggacggctggcagataccctgcggacggcttcgcccggctacttcttatggaatattagtccgaccacctgcccaacatggcacgaggcgaggcgatttcgctcacgggaaggccttttcccaacagttccaacgatattgctgagtgcggcattccagaactgctactacgaggcctgttggccttcgccggcttcgcggtctttcaaatagatttcggggatatctcgttcttgatcgtggagcttggcccagatgaccggttcgccggcttccagagacttgggcacatcgaggatgcgctggtttctggagccgcggaattgcagcagcgagtccttctggtctctgaggtagcggccgtcgacgagaatgtcgatgagatgtagcaattcaagcttgtctggggtttctccggggcgcatgagttcttcccatgtgtagccggtccacgaccagatatctttggtatgaccgaattcctggcggatacgttgtgcgagcggcaccagcacgggagtgttgaggaatggctcgccgccaaggaacgtaatgccttgcacccatggggctttcagatcttcgatgattttgtcttcaagtttttgcgtgtattcgtggccggcttggaaatcccagatggaggcgttgaagcagtcgacgcagtggaaggggcaaccggagacgtaaagggagttgcgcacgccttctccgtcggtgacaatgaaggttttgtagtcggcgatcatccgcttggacatgcgccggccatcccattgaccggctttcggatcgttggcaagaccgttggagggtacggaggggccacgcccggtctcgccggccgcaaagtcatggcgcttgggttcgggcttggtcgtatgcagctccggcatgattccctccttacggaaagcattagctcccgctggcgggagctgtccgtcatcagacggactgagggtggtcaacaccataaaggatgaccgccctcagtctcgcttacgctctacagctcccgtcagcgggagcaagtataaaccctacttggtctcttcgaaccactcgcgagtggttccgtcatccagcgtcacacgaccggtttcgccgctcatgtgcttgactcggtgggcaatttcctcgtgacggccgtgcaccatcgggcgctggaccgggctgccgagatagccgcaggtgcgcttggtgacgttgcacttgtccgggttggagttaccgcactccgggcacttgaagccttcctcggtcggctcgaagtcgccctggaagccgcacacgaagcagtggtcgatcggggtgttggtacccaggtagccgatgccgatgttgtaggcgtaatcccacacggcttcgagcgccttcgggttgtcctgcaggcacgggtactcgcagtagttgatgaagccgccggaagcgtagtacgggaagtccttctcgtagctgagcttctccatcggagtgggctgcaaccacaccgggtagtggaaggagttggtgtagaagtcgtgatcagtcacgccttcgatacggccgaacttttcacggtccatgcggttgaagcggtcggtcagggattcagccggagtggagtacacggaatagtggtaaccctccgctttgctccactgcttgcacagctcgttcatgcgcttgacgatggacagcgcgaactccttgccttccggatcccagccgtggtcgcgaatccagttcttgccatagaagaccgcagtggtctcggcaaggccgatgtagccgagcgacacggtggcacgctcgttcttgaacagctggtccacgttgtcgttggcaccaagacgaccaaacgcaccaaagcggaacagggtcggggcgttgaccggggtggcttccttgcagcgcatgatgcggaactggagggcctgatgggcgacttccatacgctcgtcgaacagcttccagaagcgagccttgtcaccgtgggattcgatggcgatacgcggcacgttgacggtgaccacgccgaggttcatacggccgtcttcttcatccttgccggtctccgggttgatccaaccctgcaggaaggagcggcaacccatcggagccttgaaggagcctgtgatcttgacgatgttctcgtagaacaccacatccgggtacatgcgcttggtggcggactcgagggcaagctgcttcagatcgtagttcgggtcacccgggtcggcgttcacgccgtgcttcacagtaaagacgagcttcgggaagatggcggtgtggtgttccttgccgaggccgcgaatacggttcagcaggattgcgcgctgcacttcacgagagaaccagtcggtgccgagaccaaagccgacagtcacgaacggggtctggccgttggacacacggttggagttgatctggtattccatggtctgcatggcatcatagatggccttgcgggtacgaatcttggcgaggatttcacgctcttgctcaagttcgtcaacgtcggtgtggaacggggtgtccatcggcagcggttcacgggaaccgaaatgcagcttggcgggctcgttcttcttggcgctctcgacctgacgacgggcgaattcaaccggcatgccgtcggggatggtctcacgagcttcctcaaggaacttctcgtaatccttcttggcatactgggcaagatgctcgtcggcacggttggcggtctggccaccatactggctggaggccacgtccttcatgatctgggtaatctgggtggccgcaatggcgatggacttcggggaagccatcggagcgttgccaagagtgaagccattggccaacatgtcccagaagttcggcaaggagcagttggactgggcagtgaacggcgaatagtcggcatcgtggaagtgaatgtcgcccttcatgtgggcgttggacaccgccggcggcagcatgttgaacgcggcggccttggacacggcaccggccagcagatcacgctgggtggagtagacgttggaatccttgttcgcgttctcgtgaatcagggtcgggtcatgattaatgaagcgagcaacggcctcgttgacatcagtggccttggcacgctgaatgtctttgtcgagacggtaattggtgtaggcgcgagccacatcgtacaggtgggcgtcaatgagggcgtgctccacgagattctggatgtcctcgattttggcggggccggtgtaacgccccttgatttcgccttcgacttggttggcgaaaccacggatcatggcatcttcttcggggccgacttccttgttcaggtcgccgaaagcagacttgaccgcagagatgatgttgatggggtcgaagtcgaccacacgaccatcacgcttctcaacgagcacggtggaggccttggcggccaccttggtctcgttatcggtgacggtttcctccagcacctgtgcgcccatcgggcacccctttcctataaggcgaacactctcctgagttccgcattttggccgcactcgacgtgggccacacgaaattacattgatatcgttttcttgaacctctagaagaatacggcatccccacccctatatctagtgctcaacagtggtgtgtcgaactatttatagggtttttcggctatttttcgccaaaactacaagtgtgtgattagcgtaactgttttctgctcgcgtgtcgcacagcgagctcactgacgactctcaatcgtcagtgcaacgcatatctcactcctcttcatagcacccgtttcttcgccataatgactcctttcttctgatgcaccagaccatctccatcatcggctgatacatcgcttcgtacggttcttgcattcatcatcacaccgttttcaggcgacggtaaatttttaccgtcatcaaccaacgcacttatagtggagtgcatgactactgcaatgggctactcatctaccggccgtccaccgaccgccgcttcactggcctcgtctggctttgagccgggtcaaggcactttcgcgcccgatcggggcgccatcaatctgccgaatgagcctcgccctatcgatcagctgcctgcacgcgccgctgaaaccaccgcgcaaaatccgtggccggtaagcgtgctgagccagaagttctacggtgccgtggaacgatggccgtccgcgtgggtcaccggccagatcacgcagatcaatacccgtcgcgccggctcggcctacatcacgctgcgcgacgacttcgaggatatcgccatggaagtcaatggcttcggcaggttcgcggccgcagccagccagttcgttcagggcgaccgcgtggtgattcacggcaaaccgaacctgtggatgaagcgcacttcgctgtcgttgcgcggggacacgattctcaaggtcggagccggtggcagcctcaaggccatgatcgacgaattgcgcaagcagcttaagggcgagggcctgttcgatgccgatcacaaactgcctctcccggagtttccgaagactattggcctgatttgcgcacctcaggcacgtgcggaaggcgatgtgatcaccaatgtgaaccttcgttggccttccgtaaccttcaaggtggtccatgtgcatgttcagggcgagcaatgcccggccgaggtggttcaggccattgcacaactcgatgccgacccgagcgtggatgtgatcatcgtggcccgtggcggcggctcgtttgaggatctcatcggtttctcggatgagcgtgtggttcgtgcggcgtatgcctgcactacaccattaatctcctccatcgggcatgaggatgactggacattgctggatctggtcgccgatctgcgcgcctccacccctaccgatgcggccaagcgcgtggtgccggatgtgcgtgagcagtcgcagctcatcgaaggtgccatcgaccgtatgcgactgcgggtccgttcgcgcgtggagaacgagattcgacttatcgagggatatgcgaaccgcccgagcctgacacagccgcacaccatgcttgagcctcatcagcgcttaattgacgactcgttgcaacggctcgatatcgggctgcgacgcatcgtggacgatgcccagctcaccgtcgagcgagctcacgcctcactgaccgcactcagcccgcaatccacgttgaaccgaggctatgcggtggtgcagtccgccgatggccacgtactagacgatgcttcgcaggtaagccctggggatggcatcaccgtcaccttgaagaagggtgtcattaccgcaaccaccacatccgcaaccgcgtgacacgccatacgcagccacgcatatataccgtatatataaggagaacatcatgaccgaaaacgccacatccaccgacatgaacacccccgccacgtccctgacggacaaggaacgcgagctcatcgcccagatgccatatgaggaggcgcgcgacaagctgattcaggctgtccaggcactggaaaccggcggcctcaatcttgaccagtcgatgcgtcaatgggagatcggcgaggccttggctaagcgcgcccagggtctgctcaacgacgtccgtgccaagctcgaccaagcacaagccgagcaagccgccaacgaagccaccgcaggcacgcagtccaacctcgactgagttgcctcccggcgcggcatcccgcggctcgcacctgagtccggactggactgagttctgcttcccggcatacgatagtggtgattaggccacattggcagcagtttatagaagggaaatcccatgtcaacgttgattcttgtattccatccgcatcttaaggacggctcgcgcgtgaacgcccgcctgctcgccgaactcaccgcacagggcgaggacgacatcatcgtgcgcgacgaatacgccgaatacccgaacttctccgtcaacgccgacacagagcacgagctgctggaggctgccgaccgcgtaatccttcagttcccgttctactggtactcctcccccgcgctactcaaggaatgggaagacgaggtcatcaccgccggctgggcctacgccggagcccatgcgttgaagggcaaggagctcaaactggtggtcaccactggttccgacgccgccaagtaccgcaaggacggcgagtacagccacaccatggaggagctgctaagcccgtttgaggtcgtggcgtacaaggtcggcatgaactatgctgagccgttcctggtgcagggcaccgccaccatcggcgatgcggagctggatcaggccgccgccgattatgtttcgtcgattttggactgaataagctgaggccgggtgcaagtcgcacccggccttgttgtttcgcgggctagccgcggtctctcccagtcagcctgcggctgacagttccctcgtcagagagagcttattttttggatcagagggagttgatagctacttcttcaacggcacgtagatcacgtcgtcaatgagctcgcgatagtgctcaacgatttgcgcgcgacgggtcttcaggctcggggtcagcatgccgttggcctcggtgaattcgtctggcagaatctcgaacttacgaatcgactcggcgcgggaaacgccctcgttggcggcgttcaccgcacgctccacctcagcgtgaacgatggcgttcttggccagcgaggccagatcgggttccggtttggcgccctgggattccagccaattgttggcatccgccagatccagcgtgaccagagcggccacgaacggcttcttatcaccaataaccaagcactggttgaccacaggcgaggtcatcacggaagcctcaagcagacccggcgacacattcttgccaccagcggtgatgatgaggtctttcttacggccggtgatggagatgaagccatcttcggagatatcgcccagatcgccggtgtgcagccagccatcagtgatctgctgggcagtgaccccagggttgttgtggtagcccttgcacaccagcggtcctttgaccaccagctcgccgtcctcggcaatgccggcggtgataccgcacatcggcatgccgatggtgccgatgcggttgtcctctggcaagctcacacacaccgggccgcaggtttcggtcatgccgtagccttccagcaccggcatgccgatgccgttgaagaagtgggaaagctcggagtccatcggagcgccgccggtgatggcgaagtcggcgttcggaccgaaaatcgtgcgaatcttcttgtacaccacctgctcgtagaaggcgtgggcgatgcgtccggtaatcggcagctgctcacccttctgctcggccttggaccattcgcgcgcgttctcggcggcgcgcatgaacatcttgccagcgaatccggtgccggcgcgctgggaggcggcattgtagaccttctcgtacacacgcggcacggcaagcagcagcgtggggccgaaggtctcgaagtccttgaccatcgtcttcatattggagctcaaggccagcgaaatcgtgccgccaaaactgaagaattccaggaatcgggcgaacacatggctcaacggcaggaacagcagcagacggcggttgggccatgcgccggcacgaggcatgtactgcaatgcggagagtaccaggaaagcgaagttgcggtgggtcagttccacgcccttcggggtgccagtggagccggacgtgtagacgatggtggcgcggtcgtcgccgtgggaggcttccttgtattcccagaattcggcatcggtgacgctttcgccataggtcttgatggcgttcaggccgccggcctcgattacgaacacgttgcgcagggtgggtacctcgctgcgcacggattcgatcttgtcgcgctgtccgtcatcttcggcgatggcgagcgtgactttggaatcgttgaaaatccagctgacctggctggcggagttggtctcatacaccggcacagtgagcgcgccgatggacataatcgccatatccagcgcggtccattcccagcgggtgtgcgagacgatggcgactgaatcgcccttattgacgccaagtccgatcaggcccttggccagatcgatgaccatgtcacggaatacttgggcactgtacgggtgccaagtgccatcatcgcccttgtattcgatcatggcaccttcgggatcgcgcttggcgcggttatcgagcagatcgaacaggttgatgtcgctgtcaatcggctccttgacgggattggtgaactgcttgacgatacgagtatcgtttatggccttatcagcgatgttttcagtcatactccccatgtaactccacggatgctacaaaacacgccgcgaaacaatggattgtccagaccaaatggccccggcaatccgttatttcgggcaaaccaggtaaatctgtcgcaccgtacattcagcagattactcggcggagtcattggcctttttcagctcgtcgcgaatctcctgcaacgtggcgagagtctgctcttcaacgctaggcccctgttcttcagcgtcagcctcatcctggatagcagtaaagatcacgaagcttattaatcggcagaatcacgcagaaatacaccgccacgccaacaagcaggaagttaatcagcgcgttaagaatcgcaccaaatgaaacagtcgagttgttgaacgtgatggtcagcagtccggaaagatccggtacgccgccaatcatgccgattaatggactgatgagattgtcgacgatggaattgaccacagcggtaacggcagagcccatcaccacacctaccgccatatcaatcatcgatccgcgcgacaggaatttcttaaagccattcaacggacctttatcggtcaaagcaacaactttgcgagcggttcctcccgtggccttggcaaagtcggtggcaatattcatgggattgtggttactcataacggcactccttacgaaattcagacacttcacttgtatccgactggttttcccacgaccccattatgccgcttgttggaatatccctataccactgcggcgttcccgtacatgactatgtacgagaacgccgccaaccctgcttgcagagaacctgttagagctgtttagaactggatgtaatcgacttccgtatgctcgccggtttccaagtatttcgccacatcatcaggaccgacgaacaccagttcgaccgcttgcgcaatcatcagattgacacgatccattggcgtaaggttttcgaaatagccgtacaccgggattcccagcgcatgcgcatatccgatttcgaacatcgtgcccgggtcctcgtccataagattggcgaccacggctttagcagcattaatgccatggatatcgtccgcaaagcatccttcagggcctacttcttcgatctggctgacaaaccgcggcttgaacagtaccttgccatggtcttccaatatcttttccaaacgttccatacttgccgtttgttcaggatcaaagaacggaccggccacatagaagtcatactgtttgtcttcactcatggtctctagtcatagcgcagcaacgtcgaacgtcagccgttattttcactgtatggacaaggggtcgtattgtgaacattgctacgggataaccgtcaacgactacgtacgttgcccccgatcagcacactccgccactttcgccccctcccgtatcgtcgagcacgcgaaccaagccgaccaaatagccgccatcccatgcgctgattaccgtatccgaatgctgcaatgccttgaacaaccgttcgggccactgcgccgattcccaaccaaccgacttgaacagcgcctcaacctgttcgacagtaaaccgcttctcttccgtgtattcgatagccatggaccctcacgatgaccgtgaagccccacatgtctttgcatagtttcacatgacgggatgatggatagtggaacctatacgtttacacatgcctaatgcccatggctcatcaccgatgaatagaggctgagataccgtcatgtttccgaagccaagtgcccgagatcggattcgaaccgacgacacccgctttaggagagcggtgctctatccactgagctactcgggcaacgacgtttcattgtacacggccacacgcccagtcgcatcatgttcgcgtggcagcttgcgcaagccatccggcaacctgagcaagccacatggaggaacccgacatcaggtcatggcccggtctttcgtgccagtttggtgcgaactgctcttgcgcacggcgaaaagacactgaaagacaagccgtacacggtacagtggcaaatcgcacgaaaagcaaagtaacagtaaacaagccggaggaaagggcagcatggcaaaggcacggagtactaccacaggcgcaagcgtacgagctcgcgccgctgccaagccacgctctgccagagccacggcacgcccagtatccaagtctgccgtgaagccacacaaacggcatcgtctgcttggttttctcgccacgatgttcgcgcttcttgcccttgccggcgctgccgcccgcgcgctgcctgccgatttacaggaactgccatttgcgccgattgtggtatcggcaacgccatggttcacgttgcttggcttgattgccctgctgttggccatcgtgtcgcggcgtatccttgccgcactaatcgccatcgccgcaatcgcatgcaatggctattggcaatatccgttcttctactcgaccgatccactcccccaagccgcgcagaacgccgtggccgcagcctcccccaacaccagcgatgcctacgcgcgcgtcatgaccttcaatgtgtataaggggcaggccgacccgcaagccatcgtcgagctggttcgcgatcagcgcgtcgaagtgcttgctttgcaggagaccaccgaggatttcgtcaaaaaactcaatgaggctggtattgagcattatctgccgtatgcgcaggtctcatcgtctgacggcgtattcggtaacggcctctggtcggccacgccacttgccgatccgaccgacgatgacgtgaattccagcgcctcattcatgcccggcggcacggtggatatgggtggccagcagattcgattcgtatccgtgcacaccaccgctcccgtacccggctactggcggcagtggaagcgatcgctggatgagttgggtctgatgcgcgagcatacggatacacggtatattttcatgggcgatttcaacgccacttacgatcacacgccattccgtgattttcttggcgaccggttcgtggatgccgcacgtgaatccggacatgggtttacgttctcatggcccacgaaccgtgcggctgtgccaatgttcgccggtattgaccacgtggtgcttgatcagggcatgaaggccggacaatgcaaggtggtcaaagtcgagggctctgatcatgcggcattgttggctaccgtggcggttgggtgattcccctcaataggactagaaaccgaggcgggtgcggccgaattggtcgagccagcgcaaaatcgcgccttcacgcagcgcccacgggcagatctcgacttcctgaatattcagggccttcatgatctcgtcggccaccacgccgccgcccacaatctgcatcgtgcgttcaggcgtgatgccgggcaaagccacgcgctgctcaggcgcgatcgccgccaaacgaggaatccagtcttccaactgctcacgagtcataatccatgaatcttcgcggcccggcgcacgcatcaccgcaccgcacaggcgagccagcgagcggaaggtcttggaggtgccaactgcatgattcgggtgcttggattgcgggaaaaccttgaccatcggctccagaatcttgcgcacgttcttacgcacgtcttccaactcgtcgggcgtggccatgccggaaggcagaaattcagtggtgacgcggcccgcgccagccggggcggaaagcgctacggtcggctcttcgtcggagcccatcgccacttcgagcgaaccgccgccgatgtccagcaccagcagtcggccggcatcccaaccataccaacggcgggcggccaggaaggtcaggcgagcctcatccgtgccagacagcacagtgacgccctgaccaatcagttcctcgatcttgtgaatcactttgttgccgttcggcgcctcgcgcagggcggaggtggccataaccagcagctgggtgatttcgtattcctcggccagccgcatgcactgggacacggcttccagaatcgcctcgatgccggacttcttgattgagccgtcgtcctttaaatacttcatcaggcgcactgtggatttggtgctggcctcggggtcagggcgagcgccgggggcggcgtcgacgataagcatgtggatagtgttcgaaccgatatcaagcacaccaagtcgcgtggtatgcgaacgcagattgaccatgattcctattcctgaccttacctaacccgtgatggccgaacaacgggccgaccatcgcaatcagccagccgtgcgccaccatggcgagtcgttcggccggcaaccaacaccgtgaggccagccgaacatcacacaaactcgactactgtacaacaatcacaccggctgccgcgccgttcacagcgattcgacgaacgttccgagacgttccagcccctcggtcagggcctcacgtgaggcggcatagctcaggcgcacatgcgtatccgccgtggccgcgccgaagtcgcggccaggagtcagagccacatgggcttcatccagcgcgcgttcgcagaacgtccaggcatccagaccagtgcgggagatgtcgaagtaggcgtagaacgcgccattcggctccacctcaaccggcaaaccgatgcgcttgagcccgtcaatcacaatgcggcgacgggccagcaattcctgacgacgagcttcgcattccgccaagctttccggcgtgaagcaggcgagcgccgcatgttgcgtgggcgtgtgggcgcacaggtagtagttggtggccagatcgtcaaccgcttccagcacagtgggctcgtccggcagaatcgcccagccgaggcgccagccggtcatgccgaagaacttggagaagctgttgcatacgatggcatcggggtcgcaggccagtacggacttgacttcggtaccgtccggctcccggtcagccaaatcaaggtaggtttcgtccacgatgcgccatgcgccgcggctggcggccaacttgcacacctcgtccaatacgttgaagtcgatggtggtgccggtggggttggacggcgacgtgatcattacggccttggtcttgctcgtccagtactggctgcacaggtcggcggtcaggtggaagcgggtggcggccgaggtcggcacatcgatgacccggccttcaaacgaccgcacaagttcgcggttgcatgggtaggaggggtcggccacaatcacatcgtcaccggggtccacggtcagcgcggtggccaacagcagagcggccgaaccgccggcggtcacgcagatacgcttggggtcgatgtcaaggtcatgacgctcgcggtagaagtcggcgatggcctgacgcagttcaggtaggcccatggcggcggtgtacggcagggcccggccgtcgtactgttcgcgcatggcgtcgcgtacggcgggcggcgcgccgaaatcgggctcgccaaggcttaatttgatgacgctggtaccttgggcgatcatcttgtctgcttgttcgccgaataccatggcacggaagggattggcctcacgcgctcggcgggacatgactggagacgcggccggagattggggctgctgcgctgcttcgttttccatatttcggttctatccgcctcacgggacaaggtttcttcttctataatcactgtaggtcgattgagtgcaccaacccgcattcaaggaggaataatgagtcgattcaatggcaagcgcgccgagttcgaggccagcggcgaaaaaatcaacgtcgcgattctgggtgcgggccgcatagctcacaccatggccggcaccctgacccagatggctgaagattcactgtattcctcatggattcacccgtatgcggtagcggcccgtgatattacgcgcgcgcaggcttttgccgaccaatggcattttgacaaggcttatggatcgtatgaggagttggtggcggacccggatgtggatctggtgtatatcgccaccccgcacagtctgcacgccgaacaggcgatcctgtgtatgaaagccggcaagaacgtgctggtggagaagtcgttcaccgcgaacgccgggcaggcacgtgaggcgctggccgtggccgaggaaaccggcatgctgtgcacggaggccatctggacgcgctacatgcccagccgcaagctcatcaacgaagttatcgagtccggcgagatcggcgaggtgaaagcggcgagcgccaacctgtgctatccggtgtccggcaaggcacgtatgaccgatccggcctgtgccggtggcgcgctgctcgatgtgggcgtgtatccgctgaacttcctggatatggcggtcggcgccgaccatggccgtacacttgatcatttcgatacgtcgatggtgcccgccgaaaccggtgtggatgcgcagaattccaccacgttgtattacagcgacggcacgatggccgtgtccaccagttcgatgctggtttcctccgaccgcggcggctatgtgtggggcaccgagggttatctggtggtcaccaatatcaacaatcccgagtccatcgacatctatgacaatgcccacaagcccgtgcgcagcattgcggtgccgccgcagttgaccggttatgagtatgaggtggccgatgcggccaacgcgctgctggacggcaagatcgaatgcgaggcgatgccgcacgccgacaccatccgcatcatggagctgatggatgcgattcgtgaccgttggggcctgaagttcccgtttgaatcctgatttcagctcccctccagaggggagctgaaattattccgctgaatctgcatctccttcaacaatctgctcatacagccgtacgaggcgttcgtcgcgcacggctttcgttaattcgcactcccatacggtaattacacgccagccagcggcctccagttcggctcgctgcgcgatgtctcgattgtgattgcgcagtagtttcgcctgccagaattccacgttcgatttcggcatcgaatgtttggaacatccttcatgcatgtgccagaaacagccgttgacaaacacgatggcgtggtatttcggcagtactacatccgggtgtccggggtaacgcttgtcgttcttgcggaatcgcaaccccttgcgaaacaggtagctgcgtaccagtacctcaattttggtgtctttgccacgaatatgcgacatcgtgtacgaacgggtaccccgctcatacttctccactggctgtttcttgcgattcacgcactccagactaccgtgacgttgcggcgagaatgagagcctgaacgaacgatcacccatcttgcccgtccgtgtctcttatcgcgggcaacaatcatctgccggtcgagactgcccgattagactgagttcaatggatgacatgacgattcgtagggccacggcggccgatattccccagatcgacgaactgctgcggcaggtgctcgaagtgcatcatgccggccgaccggatctgttcaaaggcggtgtcaagaaatacacggacgaggaattgaaggcgattctggccaacgatcagacccctgtgttcgtggcggttgcgccatctgccaatgacggcaatgacgccgaacataacgccgactcccccgccaccgaccaagtgcttggctacgcattctgcgtgttccagcagcacctcaacagcaatatcctgaccgatatcaaaaccctgtacatcgatgatctatgcgttgacgagcggtcccgcggccaccatgtaggctccaccttgtatcgctacgtgctcgacttcgcccgtcaatccggctgccacaacgtaacgctcaacgtctgggcctgcaaccccaaagcccaagccttctacgaacgcatgggactcactccatattacatcggcatggagcaggtgctgtagcgccgccgtttcagcagcacgatgatggcgatgatcgcagcgaggctgcatagggccacgccatatacaaagcccggagttccgaaattcatgaggcagattgtgatgttaccggtagtggttaccgaaaacacgacgataagcgcgacgatacgaatcatatccagcagtccagctgcttgagccaacagacgctccggtaccaccaatttggccgccgtgcacagcaaagtcgcctgaacggcgagcagaatcgcccattcccagaacatggacggttctttaagcaacgtggtctccggaaacatagacaccacctcattgataaaccacggcgccacaacaatctccacatatgcgagcccaatacaacacacgacaagcaccacggcaatggcatagcgccaagcgacgtctgttttgcgagatttacgagaaatgaatgcgataccagcgttcatggctatgcttcttaatccaatatcaatggatgaacctgcactgcaccgtatgccaccatcataatatatcgaatatcgatataaaaatatcgaaaaacactttcaccattcacctacacatccgcaaacccatgaatacacatgttcttaatcgggatggggagtgcacaaagaagctctgtcaccccagcagattgaggagatcgtccttggtgagggtggcgatggaggcgggggcttcggtgagggcgctggcgccggtgccggcttcgtcggcaagcaaggaagcgtcggtgaactggcgggcgagctcgctcttagtatgctgaagctccaagatacgttcttcgatggtgtccttggccaccacctgatacacgttgacgtcttcggtctggccgatacgatgtgctcggtcggtggcctgatcctgtgcggcggcgttccaccatgggtcggcgtggatgaccacgctggcaccggtcaggttcagtccggtgttgccggccttcagggaaatcaggaaggcaggcgtatcgtccgcattgaactggtcgacgagttcgagacgcttcttcttgggcgtggagccggtgatggtgtagtagcgcaggccttgcgcgtcgaaacgttcggcgatcagatcaaggaagctggtgaactgggagaagatcagcgccttcttgccttcgttcacacaggtttccaccagttcggtgatggcggcaagcttggccgattgatccttggcatcggcgtacagcagcctcggatcgcagcagatctggcgcaacttggtcaactcggcgaggatgcgaatcttcgacgtgttgaaatcggcttcttcgctgtgttcgagctgcattctgagccgctgctcgtgagccgcatacagtttgcgctgttcgccggcaagccgcacggtcagcgtggtctctagcttgtccggcaaatcggtcaacacctgggacttcagcctgcgcttgatgaacacgcccaccaacgactgcaattggcgagatacccgagcggcctcaggattgacttgtgcggcggcccgaccttcagccgtgctgccatccgcggcccgggcattggagatgggcaactcataacgctcatggaatcgcttatatgagccgagcagccccggcatcaggaagtcgaaaatgctccatagttcggagagtcggttttcgatcggcgtgccagtcaaggcgaaacgatggtcggcggccacggccttgaccgctttggctattttcgtggtgtgattcttgatgtactgggcttcatccaatgccatgacattgaaacgttgctcattggcggtgtaatcatcgacatctcggcgcagcaggtcgtatgaggtgatgagcacggtgggttcatccgcccggaacgcacggccgatggcggtacggcgctcggctttggtaccggccaccaccacggcattgaagctcggggcgaacttggtgaattcggcaccccagttgtacaccaaggacgccgggcacacgatcagcgatgggccaaggctgccgtcgcccatctcgccggtattccgctgatatcgagacaggagcaacgcgataagctgcacggatttacccaagcccatctcatcggccagaatgccgccaaaacccttgtcgcacaacgtgttcagccattgaaagccttcgacctgataagggcgcagaatatgcttgagactatccggcacttcatacgacttagggtcgatgatcttgagatcgtcgatgtattcggtgaacgaagcgtccttgactacatcggagccgtcatccggcagctcaccatccagtaggaatgctcgaccgcccggcaactcgatcagtccggagttgagctgctgctcgctcagatcgaggtcgctggccaatcggtccaacgtgctgagattcgcgccgctgagtttgacaagcgtgccgtccttcaactgatggaatcgttgacgccgacggtacgaagatagcaaggcacccacttcgtccggcggcacttcatcagcgaggggtgatatctccaccaagttgcctttgatggacaatccgactttgacgcttggtggcttgggcgcgatcagccggtcaaaagccggtgtggtgaagacctcccccacttcctttagtgccggcaatccctcgtcaaagagacgaacgatctgcgtggtgtcatcgcgatcgatagtggccgcatcagacacgaattttttggtggcctttcgcgcggccggcgttcggaacccattcaccgtctgatgagtggcggccgcaacgcgcttgcgctggtcaggcatggtaaagaattcacgcactacatcaatcgcaagatgctcagcgtcgaaatcacgcccaatcacgccccgagacaaggggatggaacgctcgccctcagcatgcaccgtcgggccatcgggtagcaacgggacaatggcatcgccgtagcgtgccttgacctcgcattgcacaccatgctcatcacgatccagataaaactggaggctgcattccgtaggacttaattcagccagctcgcgaggaatctcactggcctccaacagtccggcaccaaccagctgaggcaatagcgtgcgtgcgaatagggcgatgtcatcgccggcaatgacctgtccctcgccatcgggttcaaacaggtctcccaatagtcctcgcaacggaatcaatcgtttcgggcaacggacgaatcggcatcctgctgcgcttttacgctgagagcccgccaccatggcggataccgcgccggccggattagtggaggcgagcaacagccatacattcttgccgccgtcaatcacggtttccaccgctggcactccggtaagcaggtatccggcatccggaccatacgtattgaaatcacgccgcgcaatgcgcatgagaaaatctggctcgccaccatcaactggcaccgatgcaggctgcccggagaaccatgtgttcagcacgagctgtacgcctctgccctcacgtacggacagcaaccgggccacttccggtgctgaaagcgtcagatgacggtcgatggcgatatgcccgtaatacctgtcctgctgctcggccgcacgacgcacggccatcgcatcatcaaggacgtccagcagggggcgcgaatcatcatcgagcatatccggcgtatgaataaaggcaagcttctgcccataatccgcatagtcgccgttcgccatggcaagcacaaattgcggaatcgatttcagcacatagctggacccattggaagccgagccgatcttgaactccacgctccacacgccgtcgatgaaactcaatatcgggacaagctgcacctgccccaagcccacagtctcgctgtcaccctgatacccgccgcctcgggtgccggcacgagagccgtatccgctttttgtacgccgagcatttgcaccgtttttcccttgcgtggcatcaaaccgacgcataaccgcattgcgacgacgaattttggcttgagcgtcttgcctatcggcgtgctccatatagtcaatcagcgtccgagacggtcgtgcggccccggcacggtagccttcaaaacgctgcggatcatcgcagaatatgaaggcgagcgcaatcatgtgcttgcacatgccatagccacggccgtaagccgggcatgagcacttgccaccgacggcttctcccgtatcgaggtcgaattgcacgctggtacgatacctactcgatgggctggtggtgccacgtagaataccgtcaagctcggcatacccggttcgatgattttcgctgtataccggattgataaccatggtggccgctttgcgcgcaatgctacgggcacgagcgagcacggcattcgacgatgacgattccacatcgttgcgtaacgcaaggatagggacggcatgggcttcggcacgcttcgcagacccggcgaaatggccttcgtcctcatcgtcgaaccatacggaacgtccttgcctgaaacgatagggcatcaccgcatcggcggcggacaaactgtccgttccaccaaacgttacgtctctgctgccggccgcgcctgagctaccaagtattccacccgtctcaccagaaatgccgcctactccgccgcttttaccggcatagatgcccctgcccccattagtgtcatcagtgtcatctatgtcataccgaccgtcgtcgtaatcggcatcttcgtcgtctcctcttttccaaggattgcgacgacgcaacgcatggccccaggaaacgccggaatcatcatcctcataaggcaggaggccatcgtcatccgcattatcgggaacatggccaaacacaccataccctttgctcatgggcgagcctcctttccagcgaatgtatttcaacccaacgtttccatcctagacgaagcgcgcggtagccttaatgtatggatgcagacaagccggcgcaacgcaaatcctatgcagggaacaccaccctcgaaatcttcgaggtgctgtggcgtcacagttactttgggcatggcctgaccgtgcggcaaatactcgatgagcttgcccgtaaacaccagctggaagatccaagcgagctgccgaccgagaagaccatacgaaaccagctcaaaaagctgacctccacggaatttctcggcagacatatcgggcatctcaccgaaagcgaccttgccggcatcgaatgcaagaatccacaacccggctggtatcttgatgcattcctgtccactgccgaaatgcgactgctactagacagtcttaccctatctcgcatcagcctcgacaccatggacgacctcatcggtaaaatccgcgagctcgcaggcgccgccgggcaggcagtaggctacctggaccatgtggccacctacacgcatatcaacggtgagttcctatccactatcgaccagctgaatcaagccatcgaagaaggccacggcgtaaccttccaataccgtgattacggaccggatggcaccttgataccgcataaaagccgtacgggtgcaggccgaattacctacaccgccgacccttaccagatggtgtacaagaacggacgctattacctcatctgccacctgcatggcgaagacaacctccgcattttcgtggtcaaccgaatcgccaacgtcagcgccaaaggcaggaacggcacagtgccactggaaaaaccagcaccagctgattttgacgcagtgaacttcatgcgccaccgtccataccccgtagccgatgccccgattcgcatccgcatggccgtacgagacgaatccatgctcaacaacgtgttcgaatggttcgacgaccctcaaatcaaacattcaccggacggcacacagttcgaagtcatcgtcgatgctcccgaacgcgctgtgttctggtgggcattgcagtattcctgggatggccgcgtagtgattcttgagcccgattcgctcaagcgcaaactctatgatgccgggcgtcgcatggccacagcctatgctcccgaatgatgcaacatcacatcgcacacctccttgtcgagttgttcaccagcgaatttcaccggagaacctatcatcccatcgccaatcacactcggtaattttttaccgggaaatacgatttcaagccatttcgcgggcatcgtccctcacctaggcgcacataaggctaaggtgggaatcattaatcgcatcgcgcgtccacaagcgtgcactagcgcgtacaacaataaggagcaactatgagcgaagagcgtaccgcatggggctggggtctggccagcgtagacgccgccggcaccaccctggacgtctggtaccccgaactgaatctcggtgaggcaccggccgagtccgatcgcccgaaccacaatttcggtactttggctcacgatgaggccgacgcccgtggcattcgccgcgtgccggtattcgtcgtcagccagttggacgagccgatcagtaatgccgcggacgcttacctgaagctccatttgatgagcatgcgcatggccaagccgaacacgctgaacctcgacggcatcttcgcccagctcgccaatgtggtgtggaccaactacggccccttcgccgttgaagacttcacgctgcgcaaggccgacgtcgaacgcgcctccaccgaagccgctctcgctttcgcctcccaggccggactgcctgccgcagctcctgccgccactgtcaacgtgttcggtgtggataagttcccgcgcatgatcgattacgtagtgcccaccggcgtgcgcctcggcgacgccgaccgcgtgcgcctcggcgcttacttgtcttccggcaccaccgtgatgcacgccggattcgtgaacttcaatgccggcacgctcggcgtctccatggtcgaaggccgtgtttcgcaaggcgtggtcgtgggtgacggttccgacatcggcggcggtgcctccatcatgggcaccttgtccggtggcggcaagctgcgcaattccatcggcgagcactcgctgctcggcgccaacgccggtatcggcatctctctgggcgataactgcaccgtcgaagccggtctgtacatcaccgccggcactaagatcaccatctgggacaaggccaaggccgccgctggcgaaccgctggaagtggtcaagggtgctgagctctccggcaaagacaacattctgtttatccgcaactcggtgaacggccgcatcgaagcccgctaccgcaaggtgggaattgagctcaacgccaagctgcacaagaactgaaattgaaataatggagcgttatcttcgttgcccctcggtcgacgtaccttcgtacgccttccctcggtgcgcctcgataccgcacacattatttcaatttcagaactagccctgctagttcttatgcagccgtcgcagcatagctggtttgcgctgtacatatagaaagcgcctcactggaatctccagcgaagcgctttctcaaaccaacaatcaccgctcgtccatcggcacgaaatcgcgctcgaccggaccggtgtagacctggcgtgggcggccgatcttggtattcgggtcggccaacatctcacggtactgcgcaatccaaccgggaatgcggcccagcgcgaacagcgtggtgaacatggccggatcgaagccgatcgcccgataaatcaagcccgtgtagaagtcgacgttcggatacaggttgcgcgatacgaaatattcgtcattcagcgcaatatcttcaagctcggtggccacggcgaacagcgcgcgctcgtcagacggcagcttctgcgtatcttcgcgctccatgatcttttccagatacttcctggcaatcgccgcgcgcggatcatacgacttgtatacacggtggccaaggccggaaatcttctggccattctccttggcatcacgcacgaactcggccacagacttgccggaatcacgaatcgccttcaattggcgcagtacggcctcattcgcaccaccatgcaacggaccggacagcgcattgacgccagcggccaccgccgaatacaggttggcgtgggcggaaccggcgatacgcaccaccgaggtcgagcagttctgctcatggtcggcatgaataatcaacaaacgacccaaagcatgcacatacagcgggtcggattcaaacggctcgtacggcacagcgaagcacatgcgcaggaagtcgtccacatagccgcgcgcgtaatcggggtacagcatcggctcatcgcgacgacggcggaagatgtacgacacaatcgtacgggccttggccatgatgatcttggcggcctcatcaagctggtcgttgtcagaaatatcggtggtgtccgggtagaacgtggccagcgcattgatggcggaggcaagcacgctcatcgggtgagcggagcgcgggaacgaacccatgaaggtacggaagtcttcgccaaccatcgtcttgtgattgatgtccgcacagaactgctcatactcagccctgctcggcagctcgccgtggcgcagcagccacgccacctccagaaaatcggagttctcgcacagttgctcgatggggtaaccgcagtagcgcaaaatcgaatgcttgccgtcgatgtaggtgattttcgattcgcactgcgcggtggtgaggaatccgggatcaagcgttacccagccatcgttgcgcagtttggaaacgacgatgccatccggccctgcactagccttaaccacgggcaggttgaacttgttcgaatcgacatcaagttgtgccgttgccattcgcgcaccttcctcttcatgaaccacttaccccaaacattaacgttcacgcgttcgcgaacactagtgttcggtactctatgtcttctgtgttaccgctggcgaatgccggtcgatacacgaaagccgaagtgcgctcatgctatcaaagcaaacgcacttcggcttgttacgtctcgaattcgcgggaaaaccgcgaacagacggacggctaatgagacgctgatcgcccatcacaggccaatcaggcacctaccatacgccaaacgccgatcagaggttggtgcgatcggtgaagacgatcgggccgttctcggtgatggcgatggtgtgctcggagtgggcgccgcgcgagccgtcggaggcacgcagggtccagccgtccttcggatcctggaagatctcgtcggtggtcttgaggaaccacggttcgatggcgatgaccaggccttcgcgcagcttgtagccgtggtgggcgcggccgtcgttcggcacgtgcgggtcgccgtgcatgatgtggcccacgccgtgaccgccgaactcgaggttgatcgggtagccgtattcgcgcgcgacgtcgccgatggtgttggagatgtcgccgagacggttgccgggcttggccacgtcgatggcggcggcgagcgcttcctcagtgcacttgatgatgcgcaggtcttcggggtccgggtctttgccgaccacgaagctgacggcggaatcggccacccagccgtccacagagatggcgagatcgagggagacgaggtcgccgtccttcaggctgtagtcgtacggcacgccgtgcagcacggcgtcgttgacggaggtgcagatgtagtgggcgaacgggccggtgccgaagtcaggagcgtagtcaacatagcaggattcggcgcccttgcggtccacgatcttcttgtggacgaactcgtcgatttcgagcaggttggtaccaactttggtggtctcctgcagttccttcagaatgccgccgacaaaacgaccagccggcttcatttcctcgatttcacgaggggttttcagttcgatcatgagattctttctaccttgttgagacttgttctcaactctagaccagcccgaggtcaaccgccagaagcctacctgaaatccactcgcagcccattaatagccaaggccgagaaaaagcgcccggcagcacatagcctgcacgggcgctttggattgattgtctggggactggttgcatgaagcgtgagattacttgcgacgcttgccgaaagtgaacgcgcgaatcactgaagtaatccccatcaccaccatggcgcatccgccgaagataatcatgaatacggcggagctcagcgggctcatcagcaccacgaagccggcgataatcgagatgatggcataggcgatggcccagccggaatgcgggatacgccacgattcaaccagcgacagcacgccttccataatccatccgaaaccgaccatcaaagtaatgagtaatgccagcgtctgaccggtcatgccgtagttgcgcacaaccaccacgccgccaaaggtcagcagaatgccgacgaacacgtccagcacacgccagccgcccggcagacccggctccacgagagcgctgacgatgcgcaccacgccggaaatcacgaaatacacgccgagcaacaatgcggccaaagccagcgtcttgttcggcaccagcaacagcgcagcgcccaaggcgatggcggccacgcccaccacgccgtaaatgatgcgaatcttggtcttggctttttccggcagccattcctcgatcaggcggaatggactgaaattgccgacataccagttggtctgctgccagccgggttgactttgatcgccccatggaccattcggctgcccgtccgcttggctattcgattggccgtccgcctgataccgccgaccgtccggcccccatgccggctggccgttcgggccatagttcggattgtaggcgtacgggccgtagtacgggttctggttcggttcgccttgtggctggccgttctgcgcatgctgattctgagtgtcttgcgctcccggcgcaccttgcggaggatattggccgccatgattgctgtcatacgcaccatactgcggttggcccggttgacccgccggattcggctggttcggctggctctggttgggctggcccgtctggccattccactggtcctcgttcggattgctcatcgtaactccttagctcaaggtccatgttcagattccacatactatgatagacaagttgtctaatttgaaccatcaccacaattaggcaatctgtctagttcactgacagcgcaatgcccataacgcaatatctgcaccatcaacgcttctcccccgccgcgattaggcttagggccatgaccaacgaaaccgaaacgctgacgtcgggcatcgacccggcatcgttctcctccgtcatcaagccgaccaacgacctgttccgctacgtgaatggcccatggatcgacacctaccgattgcccgacgatcgttcgcgctacggctccttcgacaagcttgccgaagacgccgaaaaccaagtacgcgacatcctcgacgccgacgactgcccggctgtcaagtctgaggccctgtaccgctcattcctcaacaccgacgccatagaggccgccgggcttgacccaatccgcgacgagcttgacctcatcgattccgccatcgacaaggccgcactcacgcgcgtgctcggcacgatcaacccagccggcggccccgatctgttcggcttggccgtttacggcgacccgggcgacccggaccgcaacatcgcccaccttgagcaggccggcctttgtctgccggatgaagcctactatcgcgaggatcactacgctcccgtgcgcgaagcatacgtggcgatggtcgccacccagctggtgaacgccggatacgcgcccgccgccgagtccaacggtggcgatgagctgccgtccaacaccggcgatgacgagagtaacgctcccgccacggttcccagcgaagccgcgctcggcatggcccgccacttccttgccgtggaaaccaagatcgccgccaaccattgggacaatgtggccacgcgcgactcggtgaagacctacaaccccaccgattacgccgatctggccgccacgctgaaaaacttcgatctcggttcttggatcgacgcttggcagaccgcttatgacgccaccgaagccgccaaggctcagccgattgatttcaagtctgtgttcgcgcgcgtcattgtgcacgagccgagcttcctcactggtcttgatgcgttctgggccgaggccgatctggccgaccttaagctgtgggcccgtgttcacatgattctgggcttcgcctcctccctgtctcgcgacttcgacaccaccaactttgacttctacggcaaggtgctctccggtgccaagaagcagcgcgatcgttggaagcgcgcggtgagcctggtcaacggcatttgtggtgaagatgtgggccgcgaatacgtgcgcctgcacttccccgaaagctcgaagcgccgcatggaagagctggtcgccaatctgattgacgcctaccgcgtgtccatcaccaattccgattggctgggcgaggacaccaaggccaaggctctggagaagatctccaagttcacgccgaagatcggctacaccaaccactggcgcgattattcggcgctgagtgtttccgcggatgcgctgcccgccgagaacgccaaggccgcgaacctgtacgagaccggctatcagctggccaaggtcggcaagtcggtcgacaaggacgaatggctgatgaatccgcagacggtgaacgcctactacgagccgagcatgaacgtcatcgtgttcccggccgcgattctgcagcccccgttcttcgacccgaaggccgaggatgcggcgaattatggcggcatcggcgcagtgatcggccacgagatcggccatggcttcgacgatcagggttcgcagtatgacggcgacggcaagctcaacaactggtggaccgacgaggatcgcaagaacttcgaggcccgcaccggcgcattgatcgcccagtacaacagctttgtgccgctgcagctggcagagaagtacgctgacgagtctgataaggcgccgcacgtgaacggcgcgctgaccatcggcgagaacatcggcgatttgggcggcgtgaacatcgcgctcaaggcgtatgcattcgcgctcggcaaggcggcaggtaagcccgacgccgaagaagacggctcccccgccgccatcaaggcactgctcgataccgcccccgaaatggacggattcaccggcctgcagcgcttcttcctgagctacgcctccatctggcgcaccaagaaccgcgacgagctggccgaacagtacctgcagatcgacccgcattctccagccgaattccgcaccaacggcatcgccagcaacgtggacctcttctacgatgcctttggcgtgaccgaaggcgacgccatgtggctcgcgcccaaggaccgtgtgagcatttggtaatccccgttatgtaagagaaaaccgctgtgcttgcctcgattacaggcgaacacagcggtttttcatgatgtatggttggcactcagaattcggattcgctgggatcggaagattcggcgaaaccgtcgacgtaggtttgttgggctgcggactgtggctgattagcgccagcgtccggttgcgacatgacggcatcggccacggccgcggactcggttgatggcgacggcgattggccggaatcggaggtgaccccaaattcgacggggccagattccgacgaggtcgcatacgggtcaatacccacaccggatgcggcaccgcccgcgccatattgcgttggcctaacgtacggcgacgatgctcgttgcccgtttccgccatccataccttcgacggcaccgttggcattgccgttaccgttgccaccattgcctccgttcccattaccggcacgctgtggcttgatcagcgacgtggtgccgaaggtcaggtcatgcccaatgttggtggcttcgagaacggttctactgcgcggttcgccttgctcattggtccactgctcggtgatgagtgagccgaccacaatgatgcggtcaccgcggcgaaccgaactggcggcgttcacggccaaagcacggaacgctttgacgcccacccatgcggttccgtaatcctcccattgtctggtagtcgggttgagtcgactgcgcgtgctgcccatacggaatgtcagcacgcggaagctctcggttccgcctagtgtcggatcaccggccacaaagccggtgacggtcactgctgcttgttgatttgccatgatcggtcctttcctcagcctgctggcctgttgtttggatgtggaccgccggagcctgtctccggcttcattgccggcttgcacgccccagcggtacctccactgtgaggcatgacgtttgaagtgcacaagggcaactggcaaatgtggatactgtgacgcagttgaatttttaagaatgtggataagtttcggttatccacagcaaagcgccattctgcgactgggcagaatggcgcttgatgcgattaacgccgaggctgagtaagtgggactcaactgagggcggcgaagcgctcggcgagcgcgtcggcggcttcggcggcgggcacggcgaccttgttttcgccgttgcggtcgcgcagttcgatggtgccgtcgttgacgtaatcgcggccgaccacggcgaccagcggcacgccgatcagctcggcatccttgaacttgacgcccggagacaccttcttgcggtcatcgtaaataacctcaaggcccttggcttcaagctcggcgaccagcttctcggcaccttcaaacgccacggcgtccttgccggtggccaccacgtgcacggcagccggggcaatcacggacggccaagccaagccggcttcgtcgtggtgtgtttcggcgatgcaggccagcacgcgggaaacaccgatgccatagcagcccatccacaccggcacggccttgccgttctggtcgagcaccttcaggtccagtgccttggagtacttgagacccagctggaacacctgaccgatttccacaccacgctcgaagctcaacggaccggaaccatccgggctcatgtcgccgtggcgaacctcaacggcttccaccacgccgtcgaccttgaagtcacggccgtacaccaggttgtagtagtcgacctcgttctcatcggcaccagtgaaccaagcggaacccttgaccacgtgcgcgtcgatcaggtagcgaaccgggttcttcacgccagcagcctcggcctgcgggccaagcaccatcggtccgatgtaaccgggcaccagttcggggtgctgcttcaggtcttcctcagtggcttcctcaagttcggcgggcgcgaactgggcttccagtcgcttcatatccaccgtacggtcgccgggcacgccgacgacaatcacttcacgccacggctcgtcatgctcttcatcctcagggtgcttgacggtgatcaccacgttcttgaggatgtcggaagcctgccattcacggccatcagtacgcgggtggtcggcgttggcacgctcgatcatgttatcgatggtcttggcatccggggtggcttccttggaagcggcgggagtggtggaagcatcgatttccggtagttccggagtgctcagggcctccacattccatgccttgccggaaggtgccagcgcgaaggtatcttcgccgatcggcatcggagccaggaactcctcggatgcggagccgcccatcgggccggacatggcgaacacaggtacgtacttcaggtcaagacgctggaagatacgctcgtaagcgccgcgctcgtcatagtaggccttgcgcatgccttcttcatcgatggtgaaggagtaggcgtccttcatgacgaattcacgaccacggatcaggccggcgcgcggacggaactcgtcgcggtacttggtctggatctggtacagggtgacgggcaggtccttgtaagaggagtacatgtccttgaccagaagggtgaacatctcctcgtgggtgggggccagcaggtaatcggcctcgtggcgatccttcaaacggaagatgttatcgccgtactcctcccagcgatgggtggcctcgtagggttcgcgcggcagcagggccgggaagtgcacttcctgggcgccgatgccgttgatctcctcgcggatgatggcctcgatcttgttcagcacgcgcagaccgagcggcagccaggtccagataccgggtgcggccttgcggatatagccggcgcgctgcagcagcttggctgaatcgacatcggcatcagcggggtcctcgcgcagggtgcgcaggaacatggttgacatacgaagggtattggaagtcatgtgttccacgatattcgcgtgaaccgacaagcccgcctgctattcgcactattccgaccttcatcttggcattcggactcactcgtgcaacaatgacggctagaagggtagaagggcacgatgacgcaaccgaccgagcaacaggggaatcagccggaatcctcggagcagccggtgtatcaaccggccccagcatgggccccgcaattttctgctgcagcccccgcaattcccaacggcagttccacaacaagcggtatcgcaacagccaatggccatgccaccgtttgcgcaatcgcctatgtcggtcccggaacaagcggcctgcccgtatcaaccgtaacagccgggccgggcctatgcttctccctgcccctacccgaatccggcaatggcccagccgaaccaaccatcagtcgcgcaagagcgattcgggcgttcgtcgggacggctgaccgcatcacaggttattgagacatgcgccaccattcttgccggcgtaatactcctcggtcttgcatggaccaacccgcaaccgtatgccccggtggatcttatcgccggcctgtccggagcggccgcgctgattgtgggtgtgcgtttgccgcaagtacgcccgatgctgcgtagctggccggcattgtggcttgctttgggcggcatcattctgattgtggcagccgcgcgctatgaggcgagcctcaaatcgatgaggacgattgccgcgcgtattggcgatctgcggtgaatcgcgcgggcgacctgaggcagattaccaacgtccggcgatagcagtcctgcatacggggcagtgcccattgccaccgtatccggcagataaacgattggcaatgattcgataccaatcgcgttccacgagcttggcccggcattcagggtttgggcaatacgtggtatcgccttcacgatcatgcacgttgcctgtgtacacataattgagtccctcttcgagggcgatgtctcgggcgcgggtcagagtctcgtgcggggtgggcggtacgtccatcatgcggtaactggggtggaatgcggagaagtgcagcggcacgtccggacccaagtgctcgcgtatccatgtacattcagcatgcagctgggcgtcgtcatcgttgaatccagggatgagtagcgtggtgagctccacccacacgtgttcgccttctggtgtgcgtgcctcgttgaccgcatagtcgatggtctcgagcacatcggccagatgagtgccggtcactttccaatagaactcttcggtgaagcctttgaggtcgatgttggcggcgtccatggccgcgtagaagtcgggccgggcttcggcgctcatgtatccggcagtcacggcgatgggatggatgccgagcgctcggcaggcttcggccgtgtcgatggcatattcggcgaacacgatcggatcgttataggtgaacgccaccgaatcgatgccccggtcggccgcgacctgcgcgattttctccggactggcttccatgccgagccggtcgaagctgcgggctttggcaatatcccagttttggcagaatcggcaaccggaattgcagccagccgtgccgaaactcagcacactggaaccggggtggaagtggttgagcggcttcttttccactgggtccacggcgaagccggagctgcggccgtaggtgtcggagacgatgagtccgtcgtggtttgagcggacgaagcaaaagccgcgttggccgggcttgaggacgcagcggcgcgggcatagttcgcagcgagcgcggttggtaccgtcgtggaattgcgtttgccagcgggctatggcggggttacgaacatctgtgactgacgccgtatgaccgcacgattcccgatgaccaccctccggcgcttcgcgccacctcttgccagcgggaggagatatggttgctgcgttaatgctcggcataggcggtcacctcgtagcgttgacagtcgatttcgctatcggtccagtcgtaggaagggcggataccggctttggcgagcaggtgagcgacgaaatcgtgcggatcgggcagctcatcccacacttgtggcaggaatgtggcgctgcggccacgacggtcggcgagaatcagaccgtctttgccggggcgtaatacttcctcaagttcagtgcgcgaacgtaccgggcgttcgacgttgctgccgtcccgtttgacggcgtcggtctgaggtccggattgcagcgatgccagagtcgcggtcttcgagccggtaccgcgcgaatcggcgtcacaggagttcactgtaatcggctcgggctcacccaagacggatacctccacgttgagcagcgggtattccgcggcggtgaccggggtgaaacgtgggtcgtgggtggcggcatccactgcgtgctcggccacgtccttgccgagcgagcggtgggcgaccagcgaaccaatgcacccgcgtagccggccaccctcggtcagggtgacgaaacaggcaccgggctcgttcagccatgggtttgcggcaagaatggacgcggtcgaatcagcggcggtcggatgctcgatatgcagccgttcccggatagcggcacgggcaagtttcagcagcacctcaccgtgggatggcgtacccgatgtgcctaagtcatctgcaccggctagagcatctgcttccggcttggattcccacgcggcaaacgagacatatcccactaccggctcgtcggcgtctcgcattgcggggcgaggttggccggcgagcgccaccacgccgtcgtcgccggaagtggaacagccgagctcgaagagcctcatgtccttgcggccttttaacacatccagaaggccgttgatcgggtatgcgccacaggcccggcgagggtgaatcggcagatgcaaagccgcaatgtccgcaatggtctggtcatccaacgcgcgggcgacttcgtgcggatgatagtgcgagagatccgaactaatcacgatgacggtttccgggccaccccacaaagcacgcaacacatcacccacctcttgtggcgtggcatcgcccgcgttcaacggcacgatagtgaggtctgggccgagcacggtctgcaggaacggaatctgcacttctaccgcatgttcttgtgcgtgggttggggcattgacgatcattgcgggagccggcgcgcccggacgggcatgtgtaccggagcgcaatggctcattgacagacaggcccagagccttacgctcggctgcaatgtctaccggcacagtgcccagcggcgtttcaaacgccgctgccgtggaacaggcgacgcctcgcacggccacgcggtgagtcggccctacgattaccgcgcgagtcacgctcccccgcccacgctccaagagcgcgtaagcgagcgcagctgccgtgccggaatatatgtatccggcgtgcggcactattaccgccctcggcacccccgctggaagtgtgggctccaactgttgcagaagctttcggccgtaatcgagctgctggttgattagctgtttgagcgcggtgcggtcagccggataaaacgaaccggccaccgctgacggacgtattgcgccagtgattttgccgctgccgtctgccgcgcttgctgcatctgacgcactagccacactgaccgtatcgatttgcacaccggctcgggcggcctcgcgaacctcattgtttccacgaaatatctcggatagcaccataactaccacctcttattccatggtagctgctacggagcgcttctaaagatcagaacaacgcgtcctgggcgaagtcatcgtcgggattggcaccgaattcgtccggctcggcgggtttgaacgcgtttgcaccttcatcggccaactggtcggaggccgcggccgaggcttcgcgcaggtcgccgtcgagcaccacggcatcgggcgagacgaggaacatgcgttcgttgacgccggccaaatagaggccgcccagcgattcgactcgggacagcgccacatatcccatgcctggcgcgaaggtgcgcttcaggtccatgaccgcacggtcaagcgtcatgccttgcgacttgtggatggtgatgccccacgcgcagcgcaacggcacctggaagacggaggcgagcacggtgtcgccgtccatcatctcccatgtggcctgtttcatggtgacgatgttgccgttctcgaattccacgatcggccagccgcccttgttctcctgtgcgaagccacgcacggtgccgagcgagccgttgacgtactggcgatcggtgtcgttgcgcagggccatgacagccgcgccttccttgagtatcaatcgctcgggggccaacatgttctttttgagtcggtcgaccaggttggcagggcctgctgtctcggcgtggaactcgtgtggatcaagcatgatctggttcaggcgcatgtcgttgagattgtcggcctgccggttcaccgggaacaggtggacggcgacctggccgggctcgggcagtttgcccagacgagtgacgagcacgtcacggtcggactgggtcacgtcgccttcgcgaatgtcggtgagcacggtcagcagttcgccggtatcctgacggtgctgttcggtcagatagcagatcaccgggttgagttcgggccataccagcgattcggtgatgaagccttcggggttcaagccggcacgggcataccgttcgcgactggcgatgaattcgggcgtgggggcgatgaggtcgcggttgcgcccggacaccgaaaccggcggcagctggaagaagtcgccggacaagacaacctggatgccaccgaacgggcgtggatcacggcgtacttcgcggcagacttggtcgaccatgtcgaacagccaagcatgcagcatggaaacctcgtcaatgacgaggatgtccgtggcctgaatcttgcgtttgcgccgggatttgatgagtttgagcaggctggcgctcagggcggtggccacgccgacgccgctccacgaatgaatggtttggccgttgatatgcgtggaggcgatgcctgtggacgcggtgactgctacactggcgccgtcggcccgagcctggcggatgaactcgttcaagacataggtcttaccggcaccgggcgcaccggtcaggaacacgttcgcgccggcgttcagaatggccagggcttcggtttggcgcatatcaacctctctagactcccctcagggaggggagccaagtacggcggactacttattgaggatgctggtggctacgatgtcggcggcgatggccttggatgcggcatcgtccgggccgggggcgggagccataaacgccttacggtagtagcgcagctcgtccaaggactcgatgatgtctgcgagagcacgatggccaccgttctttggcgggcggttctcgtacacggccgggtaccagcggcgggcgagctccttgaatgtgctcacatccacgctgcggtaatgcaggtggctcatgaggttcggcatgtaatggtcgaggaacttcttatcggagccgatggtgttgccggccagcagcgggcgcacgccttccggcgtgaagcgcagcacgtattcggtgaccttctgctcggcctcggccaggctcaggccattctcccactcgttgatcaggccggaacgggtgtgcatctggcgcacgaaatcgttcatatggttcacggccttctcggacggcttgatgacgtaatccacgccctcgtccagcacattcaggtcaaagtcagtgggcactacggacacctcgacgagttcgtcgccgccgaagatatccaagcccgtcatttcgcagtcaatccaaatcaggcgcgaatcctttgcgctgtaagtttctgcatcatggctgtcgaccatggtaagcctcttttcgtcatgtcacccgttattacaagaacagttcagactataccccagcgcatacaagctatctcgagccacatacgcgaaaagggcctgcataagcagacccttttcacaaggaatcaacccctaactagcgcaagctagcgggcatcaaccgatcagttgttgtggaagccggagtagttcggggcttcggtggtcatcacgatatcgtgcgggtgcgattcgcgcagaccggcgtcggtgatgcggatgaacttgccacgctccggcatctcggcgatgttgtgggcgccgatgtagaacatggactggtgcaggccaccgagcatctggtagagcacggcgttcagcggtccgcggtacggcacttcgccttccacgccttccggcacgaccttgtcgctggaggtcacgtcggcctggaagtagcggtccttggagtaggacttcttgccgcgcggggccatggcaccgagggagcccatgccacggtacagcttgtactgcttgccgtgcaggagcaccttctcgcccggggcttcctcacagccagcgagcgtgccgccgagcatcacggaggaagcgccagccacgagggccttggcgatgtcaccggagtagtggatgccaccgtcggcgatgcagggcacgccagcggcacggcaggcctgggcagcctcgtacacggcggtgagctgcgggacaccgacaccggcaacgatacgggtggtgcagatagagccggggccaataccgaccttgacggcgtccgcgccagcctcaatcatggcctgagcaccggagcgggtgccgacgttgccgccgatgatctgcacgccgtcgaaggcggagtcgtgcttcaggcgggaaatcatgtcgagtgccagacgggcctcaccgttggcggtgtcgaccacgagcacgtccacgccagcctccatcagagcggaggcacgctgccaggcgtcgccgaggaagccgacgccggcggccacgcgcagacgaccctgctcatccttggtggcgtccgggtactgctcggtcttgacgaagtccttgacggtgatcaggccggtcaggtggccttcctcgtcaacgagcggcagcttctcaaccttgtgctgggcgagcagacggtgagcgtcgtccttggaaatgttggacgggccagtgaccaggttctccttggtcatgacatccttaaccttcagggtgtcgtaatcctcggaggcgatgaagcgcatatcacggttggtgatgatgccgacgagcttgttttccttgtccacaaccggcagaccggagatgtggaacttgccgcacagcttgtcgaggtcggccagagtgacctcggggttgacggtcagcgggtcggtgatcataccggactcggaacgcttgaccacatcgacctgagcggcctggtcgtcgatggacagattgcggtgcagcacaccgataccaccgttacgagccatggcgatggccatctcggactcggtcacggtatccatggcagcggagaggaccggggccttcatcacgatcttgcgagtcagatgagtgctggtgtccacttcggagggaatgacatccgtctcgttcggcagcagcaacacatcatcataagcaaggccgagcttggcgaaaatcggaggaaggggagcatacgccgattgggcgttcaattcatcgaggtttgtagccatacaaacactatatgaacacgcgctgaccttcacgacacacgcttgtgagcgctcacttatccgctgccgggtcctgcacctcacccgcctgcgagtcccgcgaatccgcaggcgaatcagtcatcgaatccgctgcctgagagccaatcgaatcccggctctcccctactgcagactgcgacttaaccgtagcatgctgcgcgttcttgcgtgcggattcgagcgtcaggttctcggcttggatctcgggaatacgatgccgcagataggggtacatcgtggctatggtcagcaccaccacggcgatgggcatgcccacggccacatgctgcgctttgaagaacagaatcgtcagcgaaccgaatgcgatcagcgcggcccatccccacaggatcagcacggcgccacgcaccgaatgcccgatcttcagcatgcgatggtgcaggtgcatacggtccggatgcatgggcgactggcctttggccaaacgccgcacaatcgccagacacatgtcgagcacaggcaggaacaacaccagaatcggcagcagaattggcatgaacaccggcagatagatgctggcatgaatcgaggccgggtcaagacgtccggtcatcacaatcgaagcgcaggtgatgagatagccaagcagcatcgaaccggaatcacccataaacagtttggcgggatgccaattatgcagcaggaagcccacgcagatacccaccatcatcacgtcgatcagcgtggccaacgaagcataactcggggaagaccgggcgatgatatacgaataggcggcgaacgctatgccaccaatcgccacgataccggccgccaggccatcgaggccatcaacgaaattgaccgcgttaatcgaggcgacaatcaggaatgcggtgatcgccatggacagactcggcgaggcggtaatcagcgaaccgcccaaaggcagtgagatgatctgcaatccgccccaagccacgaatacggaaatcagcagctgaccggcaagtttcagcatccaatcgagatcccacaggtcatcggccatgcccagcagactgatcatgatgccgccggcaagaatcacccacatctggtaattgccgttgaacaatcccgagagaaaaggcagccgactggcgaatacggtagccacggcaaaaccgatcagcatgccaaggccacccatgcgcggcgtgggaatggtgtgcacgtctcgggcacgcacctcgccaaccgcaccgatttcgatggcgacgtggcgaatcagcggagtcaccagccaggtgacgccaccggcgatggcggcaatcagtaggtagattctcatgcgccgagtccaccgccgttgaggtggagggccttgcgaatcacgttttgggcgatgacgccttcacgcaggatctcgatgccgtcgcgcgcgtacggatcggctttgacgacggtgctggagacatggccttgggtgggaccgccgtccagatacaggtcgacttcgctgccgaacgcgtcaaccgcctcctggacggtctgcgcgctttcgtcgccggaacggttggcgctggacgcggccagcgggccagtcgccttgagaatcgcgaggcacagcgccgaattggggatgcggatgccttgcgtgccggggcgaccatcggcggtgtcggccaaagtctccaacgtgcagtcgggccgggctacggcaatcggcgagaacgcgccaggcagaaacgccgccgacaaacgattcagcggggacggcaggtcgagaccgagctcatcaagctggtcggtggatgcgagcagtacctgcaacgccttatagcgcgggcgacgcttgagccggtagatacggtcgatagcggccttattacgcggatcgcacgccactccatataccgtatccgttggaatgacgaccaatccaccatcccggatgacacgcgccgcctgtgccagcgattcatccgtgactttcagcgttgttccgccttccacgctcacgccacctccgttcgcttgtgtattcacaatctaccattgcaccattgcgccccgacttgcatagttcatcatcgctcgtttgccgtactgccgttttccgattcgccccacacgcacagaccgtagatacaatgagtccatccatgctctttcgcgaaattacaggagtgttcaatgagcgaaatcaatgctgaatccaccaccatgcctcccgtcgaactgcgtatgccgcgcgccagcgagcgcgaggagatgctcgccggcaaactgtacaattcggtagaccctgaattgaatgccctgcgcgagaaggccggcgacctgtgcgcgcgcttcaacgccgcgtcgcgtaccgatcatgccgcccgtgccgcgattctcgatgagctgctgcccggccacggtgccggccttgacgtgatggggccgattttcttcgactatggctgcaacatcaccatcggagagcgcgtgttcgccaacttcaacttcactgtgctggattgttgcccggtgacgattggcgacgacgtgctgttcggcccgaacgtttcgctgctgccaccgatgcatccgttgcgttggcaggatcgtaacgtgaggcaggcacctgatggttccgcatacgactgcgagtatggcaagccgattgtcatcggctcgaactgctggtttggcggcaatgtgacggtaatcggcggcgtgacgatcggcgagggttgcgtgatcggtgccggctcggtggtgacgcgcgatattccgccgcacaccgtggccgtgggtaatccggcccgtccgattcgcgagattacggataaggatgcttccgcgctacagtattacgcgcagtgatatatgaatgctcccgctggcgagctgtcagcggagctgactgagggtggttgccggaaatctccgataaccaccctcagcctcacttcgtgaggtagctcccgccagcgggagcatagtaatgtgagacgtcacgcgccgaggtacgccttgcgcaccttctcgtcgtgcagcaggtcggaggccttgccctccatggtgatcttgccggtctcgagcacgtaggcgcgatccgcgatggacagggccatcttcgcgttctgctccacgagcagcacggtgatgccacgcttgcgcagcgtgacgatgatgtcgaagatctccttgaccagcagcggggacagacccatcgacggctcatccatgaggatggtcttcggatggctcatcagggcgcggcccatggccaccatctgctgctcaccgccggaaagcgtgccggccagctggcggcgacgttccttcaaacgcgggaagtagtcgaacaccatctcaagatccttacccagactggactggtctttgagactgaacgcgcccatctctaggttctcctgcacgctcatgcgggtgaacacgtggcggccttccggcacatgggccatgcccagcgtgacgatcttgttcgcatgcgttttgagcagatcgtggccatcataggtaatgctgccggatttggcaggcaccagaccggtgatggtgtgcagggtggtggtcttgccggcgccgttggctccgatcagggagacgatctcgccgtcgttcaccttgaggctaatgcccttgaccgcgtcgatcgcgccataggaaacgcatagatccttgatttccagcatcagcgcgctccttccgtcagtgtcttggcaatgcttggctccggttccgccttggtggtggaatcgccgtccgcgtcatcgttgttgtcgctgcccaagtaggcggagatgacctgcgggttgttggcgatctcctccggcgtgccggatgcgatggtgcggccatagtccagcacctggatgcgctggcatacgctcatcaccaggctcatgtcatgttcgatgagcaggatggcgataccgaaacggtcgcggatcgtgttgatacagtgcagcagatcctcggtttcggtggggttcatgccggcggccggctcgtcgagcagcagcagtttcatgccggtggccagggcgcgtgcgatctcgagcttgcgctgctggccgtacggcaggttggccgcctgggtggtggccagtccctcgaggttgaagatgcgcagcaagtcgatggccttctcgtgcatctcgttctcctgcttccagaagcccggggtgcggaagatggcgctgcccatgtggtaggtgaacgactcatcgaaggcgacgagcacgttctcctcgacggtgagctgcttgaacaggcggatgttctggaaggttcgggcgatgccggcacgcacgacctgataggtcttcttgccgttcatccgggttccgtccagccagaactcgccttcggtgggcttgtacacgccggtcagcaggttgaacaccgtggtcttgccggcgccgttggggccgatcaggccaatgagttcgcccttgttgatggtcatgttgaagttggacacggctttcagaccaccgaaggtgatgccgagatgttcggctttgaggatgggctgggttgcgtcgctcatcgtgaggcctccttcacggtcttgtcgtcggactggtcatgctgcttggcgctggccgcgggtttcgcgcccttgccggcggcgccgcggaacagcatgcggttgaccagacgcggcagtgagaactcccaggatccgaagatgccctgcgggcggaagatcatgacgagcaccagcaccaccgagtaggcgagcatacggtagtcggcgaaggcgcgcagcagctcgggcaggatggtcaggccgatggcggagacgatcgagccggtgagcgaacccatgccgccgaacaccaccatgatcacgtagttgatggagttgagccaaccggccatggtggggttgagcgagccgatgtactgggcgaagataccgccggcgatgcccgcgaagaacgcggagatcgcgaagacgagcaccttgaggtacgtggtgttgagtccggaggcgccggcggcgatctcgtcgtcgcggatggccttgaccgcacggccgtaacgggagcggccgaacatgaagagcacgaccacggtgaccaccatgatccagaacacgacgtacaggttggcggtgcgttcgatgccgatcagcgcctgtccggcggcgcccttgtcgaggcccatgccgccggctaccttgaggttctggatgatcacgcggatgatctcaccgaagcccagcgtgatgatggccaggtagtcgccgtgcagtcgcagggcaggaatgccgatcaggatgccgaacacgcaggccaccacgccgccgatcagcgtggtgagcaggaagcgggcggtggggtcgatggcaatgccggcggcgaccatgtatttggaggtcagtgcggccacgtaggcgccgatggcctcgaaaccgcagcatcccagcgtcagctggccgagcacgccgatggtgaggttcagggaggtggtcatgatgatggcgatgcacgcggtcatcatgatgcccttgatgtaggagtcggccaagccggattcgcacagcgccatcacgatgccgaacgcggcgaggatgccgatgaagcacacaagataggactgtttggtggaaagcattgtcttcttcatctgatcagaccttctccccttcgttcttgcccataatgccggacggtttgacgagcagcacgatgatcaggatggcgaacacgatggcgtcggagaacgccgaggtgatgatgcccgccgtgatggtgccgatatacgccttggtcaggctttcgatcagaccgatggccagaccaccgatcatggcgcccgggatggaaccaatgccgccgagcacggcggcgacgaacgccttcaggcccagcatggcgcccatcataggcgagacctgcgggtaggcggcgcagtacatcagcgaggcgaccgcggccagaccggagccgatggcgaatgtcagggcgatggtggagttcacgttgatacccatgagcacggcggcctccttgtcttcggagacggcgcgcatggccttgccctgcctggtgaatttgacgaacagctgcaggcccaccatgatgaccaggccgatgacgatggtcagcagggtgtctcccggcagcttgagcttgccgaacgcgatggacggcaggtggaagatggtcgggacggtctggaagtcggcgccgaagatggcctgtgagccgttctccagcagcaacgacatggcgatggcggtgatcagggcggtcatggagttgcccttttcacgcaccggcttataggcggccttttcgacgatcacgccgacggccacgcataccaggatggcgggaatgaccgccacccaggcgggcagtcccatggccacgatggccggaatggtgagcatgagcacgtaggctccgaccatgatgaaatcgccgtgggcaaagttgatcagtcggatgatgccgtagaccatggtgtagcccaatgccaccagcgcgtacacgctgccgattttcagaccgttgaacagctggctgatgaacatgatgatctgatcggtcatagctccccctttctatcaatgttgtggttctctaccgctgcgcgcgtagagatattcgtatgtcttgcgattgatggcgcgatacgcccgcgcctggcgatatccgcatatcgacggctgtccttatgcatccgagcccatgaaaacacgaaagggagaggaccggcaaaaccggtcgctctcctgttcatgcggaagtcatgctaggacatcgtgattatgcggtgggaattcatggaattcacttgggctgcacggtggtgttgtacaccggcttgccgtccttcatttccagcacggtcacggacttggtcggcgagccggacttgtccatggtgaacttgccggtcacaccgtcgaaggtcatgccggccacggcgttgcgcacatcctcacgggtggcgttctcgccagccttctcgatggcctgcttgatcatgtagatggtgtcgtagcccagagcggcgaacgtgttcggctcggcgttgttcttggacttgtaggacttgatgaagtcctgcaccttggtgttggtgttgtcgtcggcggagtagtgggtggtgtagtaggtcttgttgtactgggacttgtcaccggtgagcttgaggccatcgtatccgtcgggtcccatcacgtagccctcgaaacccacggagcgggcctgcgggatgatgtacgggccagccacggagtagtagtacggagcgtagagcagctcggcgccggaagcctggatcttctgcagctgggcggagtactcggtgtcgtcggcggaggaggagctttccttgtccaccacttcgaggccgagcttttcggcggccttggcgaaggcctctcccacgccggaggagtacggatcgccggtgccgtagagcacggccaccttcttgaccttcaggttctcggcggcgaagcgtgcagccacctcaccctggtaggagtccttgaagcaggtgcggaacaggtaattgccggtttcgatggagtcggaggtggcggccggggcgatggtgaccagcttggactggtcggccagcggggccacggctgcggtggtggcggaaatggtcgggccggccacggcgagcacgttgttgtcgccggcgagcttgttgtaggcgttggaggcttcggtggcgtcgcccttgtcgtccatggactcgagcttgaccttcttgccgttgatgccgcccttggcgttgatctcggagaccgccagctcgaagcccttgacctcggcctcgccgtaagcggcggcggtaccggagttggtggtcacggtgccgatggtgatggagtcgccggaggccttggcactggagctggaggaatcatccatgctgccgccggagcagcccgcgagggacaacgccataacagcggccgcgctggccgcaacgaacttagtggagaacttcacgttcatcctcttccttcttccttgggatatttcaacatcgttcatctgtcaaccaacgcgcgggatgtgcgcgtgagacgttccactcacataattcgcataccacagaactacatcacacggcttgtgaccgtcattcacgtctctctcatccgatgtttgtcgcggactgttataaccagaccggctttgaacccgcaataaattgttcttattatgagacagcgcaattacggaaacgagaatacaatcccaaggaaatgtgggattcgtggggcttaggacactgcaaacaggtagcggtcgcgacccgtccagtcctggccggtcgatgcggcagcgaatccggtggccctggcaaaggccacgagacgatccccctgggtcacgtcatgttccatgacaagcacgcccccaggcttgagaagacggcaggcccgctcgataatgcgctcgggaatcaacgtaccgtccatcgagccgccatacaaagccaattccggatcccaatcacgcacttccggctgctcgggaatatcggtctgcggcacgtaggggggattggtgatgacgatatcgacggtgccgtccaattgggccaatgtggcgaaggacgtggcatccgcgatttccagatggtaattcgaggcaatggatgggtactttttcgcggtttccgacagattccttcgcgtccattcggcggtgttcggcgacagctccaccgcccacacctggctgccgggcacctcgctgacaacggacagcccaatcgcgccggagccggcgcacaaatcgaccacacaaggatggatcatgccgttttttgtcagccagtcaaggccggcctgcaccacggtttcggtttccggacgaggaatgaacactccgggaccgaccttcaggtcaaggtagcggaaaggagcatgcccggtgatgtattgcagcggctcgcgcttggcacggcggtcgagcatggcacggaagacggcaagctgtccggttgtgccaagttcctcccccataagcagagccctgtcgacgtcgcgcagttcaacgcctgccgcctcggcaaggagcaacttggcatcatgctcaggcgtctcaatacccgcttcgcgcaattgcgaagaggcttggttgatgatgtcggtaataagcactggcggtctccgttgatcggacattaggctcccctcagtcagcttcgctgacagctcccctcacagaggggagccatccggcaaagtcatttctgattggccagacggtcggcctcgtcggcttggatgtcggaatcgatgacggcctgcaggtcgccgtcgagcacggcgtcaaggttgtaagccttgtaattcgtgcgatggtcgacgatacggttttccgggaagttgtatgtgcggattcgctcggagcgatcaagcgaacgtacctgcgagtgacgcatgtcggcggcctcggcggcctcctgctcatgcttcatggccagcaggcgggacttcagtacgcgcaacgcggcggcacggttctgaatctgcgacttctcatcctgcatgttcaccgtgattccggttggcaggtgggtcatgcgcacggcggaatacgtggtgttcacggactggccgccggggccggagctcatgaagatgtcgattttcaggtctttcggatcgatctcgatctcgtcgtcatcctcgtcggcctcggggaacacgatgacgccggcagcggaagtctggatacggccctgcgattcggtgacggggatgcgctgcacacggtgtacgccgccctcgtacttcatcgaagcccacacgccgtcttcgggagcgggcgtgcccttggcgcggatggcgatctgcacgtccttgacgccgccgagctcggtggtgttctcggactgcacgttcacgctccagccacgcttctcggcgtaacgggtgtacatgcgcagcaggtcgccggcgaacagtgcggcttcctcgccgccggtgccggccttgatctccatgatggtgtcgcgcgcatcatccgggtcacgcgggatcagcgcggtgcgcagcttctcctcgacaccgggcagttcgtcttcaagacgcttggcttcctcggcgaagtcggcgtcctcgccggccatctcctgagcggctgccagatcgtccttcacctgcaaccaggctttgtaggcacccacgatggcacccagttcggcgtgacgacgacccagcttgcgcagcttgtccgggttggacacgacttcggggcttgccatctgttcttcgatggactggtactcctcaagcgcggttgccgccgccgggaactgttcgtctgccataacacactttcttctgtatggtgctgttctgttcgattattcgattgcgcaggtcaatgctgcaacaaaacttgtcaaagaatacaaaaaacgccagtcctcgatcgggtatgccggagcatgccaaatcgaatcggactggcgtgaagtatgctacttgctcttcttgccgtagcgcttctcgaagcgagcaacgcggccaccggtgtcaagaatcttctgcttgccggtgtagaacgggtggcactgagagcacacgtcaacgaacatgtgatcttccttgccagcggtgcgggtcacgaaggtgttgccgcacgagcacgtcacctcaacggggtgataatcaggatggataccctgctgcattttacgtctcctatggattcgggggacccgggtcgtcatgcccctatggcaagacgtgaaccggaacctaagggattgtacacgcctatctggacgtgaagacgcgctgcgccgccgcaggagacgacgcaaaagagtggggccgcaggggcttgaaccctggaccgggcgattatgagtcgcatgctctaaccgactgagctacggccccacgttcgctgcgtaaaacagccaacttgccaaagtgtagcacgagcccgctaatgccggcacgcgcgccatgcacccataccatgcacccgccagcaacaagcagcatctcccggcgctacttctcccccatgtaccccaacgggttctcgatgaaccgtcgcaagcccatttcggccgcgccatatagcgagggatgcagcgccaccggcggcacaaacacgcgaatcttcacattcgggtatcccagaatttccgaacgcagccggccttcaagcacggtggccagctcgtcgccgaagtgcgtccacagtccgcccaacagcaccgtatcgacatccaccagattcacggcggaagcgatggcggaaaccagcgcatcggcggcctgatcgaccactttggccacatccgaatccccggctcgccaacgctggaggaacatatcgatggcctcgctgctggtggcatccccatcctcggcaatgccggcagcctcgaccaaagcgcgacggcccgcaaacgcctcaagacacccgtgacgcccgcagctgcacaacggcccatccatcgccacggacagatggccgatctcgccggcgaatccgtgcgagcccatcaccacttcgccgtcgcgcaccaccgcgccgccgatgccgatatcggtagacaggtaaataaaggagtccgtgcggtccaccacattcaggaagggcgcacgttcggtggcataccccggaatctgagcgatggcggccatcttcgcctcattgccggccaccacatccagccggcgcaccacgttgaaccgggtgaggttgacgttttcccaacccagattgcgggccaccaacagccacatgtcgtcggtgacgatgcccggcagcgcaaacccggctcccaccaccttgcagccgcgtcgtttgagccggctttccaacgggaaagtcatcgcatcgagcttggcgaagatctcgtacgggtcagtgccggtcatatcctcactcacccactcccggccgagagtgtcgccgttcagatcgagtgccaggcaaccgtaaccatcggtgttgatctgcaggccgatgccggcgatggatccgccgcgaatctccagcggcgtgctgggccgcccatatgtggtggaaacgaccggctcgccttcctgcaccacgccgctttcaatgagcatcgaggccaacagcgagagcgtggccttggtcaggcccgtctccttggccagatcggcacgactcatcggtttctgcgcacgcaataaggtgtcgagcgtcaccgacaggttatggttgcgcagatcctcctgattgatcctgcgtagatttgccattggcccctacctcctcgcacccctagtctcgagcgccgcacaggcgctcacatccgtctatcacaccatgatattgtgcgtcaaacgattgaatcggaccgcaccttcgcgtgtttccgtttgcaatcgaacgttgagatacagtatagtttaatcgtctaacttattggctatggcgcgccgaaacttttgagcgcgaccctcatcgaggaggaatgcatgacgagagtactggttgccggcgtagatacgtcaacccaatcaacgaaggtccgcatcacggacgccgccaccggcgaacaggttcggttcgggcaggccaagcacccggatggcacctcggtcaacccggaattctggtgggaggccttcaccaaggccgccgagcaggccggcgggcttgacgatgtcgcggccctcgcggttggcggccagcagcatggcatggtcattctcgacaagcagggcaacgtgattcgcgatgcgatgctctggaatgacaccagttccgccccgcaggccgccgccttgatcgacaagctcggtgcagctccggccgagggcgacgaaccggacgacgtgaccgcccgcggcaagcaacgctgggtcaaggccgtcggatcctcccccgtcgcctcctacacgctgaccaaggtggcgtgggtggccgagaacgagcctgagaacgccaagaagattgccgccgtctgtctgccgcacgattggctgagctggcgtatcgccggctatggcccggtggccgagggcgaggacgctcatctcgaagccctgttcaccgaccgttccgacgcttccggcaccatttactacgatgccgcgcatgacgagtaccgccgcgatctcatcgccatggtgctggcccctgccgagggcgaggaagccgccaaggcccacgccgacgccattgtgctgcccaccgtgctgggcccgcgtgaggcagccgccgtcaaggccgaccccgccattgccggcaaggacgttgaaggcggctgcatcatcggccccggcggcggagacaatgccatggcctcgctgggcctcggcatggccgtgggcgatgtgtccgtatcgctcggcacttccggcgtggccgcggccatcgctgaaaacccggtgtacgacctgaccggcgccatttccggctttgccgactgcaccggccactatctgccgctcgcctgcacaatcaacggttcgcgcattctggacgccggtcgcgccgccctaggcgtggactacgacgaactggccgaactggcgttcaaggccgagccgggtgccggcggcatcaccctggtgccgtacttcgacggcgagcgtacgccgaaccgtccggacgccaccgcctcgctgactggcctgaccctacacaacaccaccaaggagaatctggcccgtgcgttcgtcgaaggcctgctgtgttcccagcgcgactgcctcgagctgattcgctcgctgggcgccgagatcaaccgcatcctgctcattggtggcggcgcgaagtccgtggccatccgcacgctggccccctcaatcctcggcatggacgtgacccgtccggccaccgacgaatacgtggccatcggcgccgcccgtcaggccgcctgggtgctgtccggcgaggccgaaccgccgacctggcagctcaccatcgagggcgtggagaccggcgagcccaccgaagccgtgtacgaggcgtacgccaaggcccgcggctgatacgctgccagcaaatccatgagataacaactgaataacgattcctgatgaatgccgccatggcgagcatcgcgaagagccgctgttataccgcgctcctcgctgaagcacacatggcggcatttttcgtttcccacgcaatccacaaatacggctataatcaagtcgtttgaacaagtctggagatgatcctatgaacgaccgctcccgtatgatgctgtacgccctgaccgccgtcgcctgcgtgatgtggatatggcagtctgtcaaagagtcgatgaacgacggcacgatcatcagcacttcgaacatcatttttctggtatgcattggcatcgcggccatctactgcgcggccaacgcgctaatcctgtggtggcgccagcccggcaaggatgacgcggctgatgacgacgaaaccgacagcacggacgccgaggccgaagccgaacaagccgaagaaaacgaacacgacgacgttgccgacaccgcagacaccgacaccgcagacgccaaagaaaaccacaacccacagcactaaaggaacatcatggatgcaaccacattgtcaataaccctcagcgcgatattggccgtcatctgcacaccttgcggcctgtttctggggcttgttcccatgaaggccgacctggtgaccgccaagcagtcaaaggcctcgcagatggtgagcttcatcgttgccatagtgttcatcggcttgctggtcgcaggccatgatctggagacctgggccatggtaatcggtctggtcatcggcttcgccgttgccaagatccccgcactgcacgcctgggctttgcacaagtggccgttcttcgaacccaagaaaatggctcccacccccaagcgcgtcaagaaagccaggaagaagtaagctctggccttacctattcgctgaaagcgggatatcgacatcggtatcccgctttttcattggccgcacatatccgctgaggcacatcgccgaatcatattgtcgaaatacaccccaagtcagggctgatttcgcgaagaacgtacaccgggatccatccatcgcgacaaacggaaaagggacgctgcgtgcaacagcgtccctttcggaggaggaatggaactcaggtccatccccgtggccaccgggcgggcccggaggccaggtttagctcagcctttctttttcttggagagcaggtcgtaggcgacggcggcgatgacgacgaggcccttgatggtcttgacccaggcggcgtccacgcccatgatggacaggccctggttgagcacgcccatgatcagggcgccgaccatggcgccggggatggtgccgatgccgccggtgacggccgtgccgccgatgaagcaggccgcgatggcgtccatctcgaactcatgccaggcctgtctcgttaagtgtgtaactggcgttttcattgttgtgttccctcgcttggccagcggtcggcgaaggtgatggcaaaggcgttgagcgcgggcttccagcgcgcgctccatcgtatccgtcccttgccggtggggtccagcgagcggacggtcaggtacatgcacttgagcgcggcctgctcgtcggggaagtggccgcgggcgcggatggagcgcttgaatctcgcgttgagcgattcgatggcgttggtcgtgcagatcacgcgccggatctccacgtcatagtccaggaacggtatgaaccgttcccacgcgtccatccacagcctgcggatcgcgggatatctcgcctcccacttgtccagcatcgcgtcgcgggccgccgccgcggcggcggcgctcggcgcggtgtagatgggtttgacatcgcgtttgatggcgtcccagtccttcttcgacgcgtagcggaacgtgttgcgcagcagatgcaccacgcaggtctgcacgatggccagaggccataccgcgcccaccgcgtcgggcaggcctttgagcccgtcgcagatcaggaagaacacatcgtccacgccccggttcttcatctcggtgagcaccgacagccaatagcgtgcgccctccgcggcgggcgacgcccagatgcccagcacgtcgcggccgccctccagatccacgccaacggccacgtagaacgcgcggttggcgacctgcccgtcgcgcaccttgacgacggtcgcgtcgatgaacacggccgcgtacacacgatccaggggacgcgagcaccattcgtccttctcggccatgacccgctcggtgatgcgactgacggtctccctggacacgtccgccccgtagatctcctggaagtgggcgctgatctcgccggtggtcaggcccctggcatacagggacagcaccacctcgtccaccccgggcagccgccgctgccgtttcctgacgacgaccggctcgaacgagccatcgcggtctcgcggcacctcgatcctgaccggacctaccgaatcggtgaccacggtcttggcggtggtgccgttgcgcgtgttcgcggccctgccgtccttggatttcttgtgcttggcgcggcccaggtgctcggtcatctcctcgtccagggccgtctccagcacgcttttggtgaactgtttgagcagtccgtcgggccctgtcaggtccagtcctttttccttggccatgcacacgaatgtgagcgccgcctcccgctcggcgttgcgtttttccgcgtccggcttcttcgtcggtgtcatgtttccccttgtcccagcagacatcgtccaccagcctttccgaccggccacacgaccggccagttaaggccagttacacacttcgagagacagtcccgttcccagcggaaggagagaaaggagaaagaaggaatggaaaggtgccatgcgggcataacacaacaccgcacatggcgaaactatcgaatcagcccatcgggcgcactggcatcataattgatgtgtacacgcccgatggagcgaattcaatcggtcagaccgatggtcactcgacctcagccagggcatcaatgatgtagttgttgatggtggccttgacggactcgaggtgatcggacttggtggcggcgatgagctcggactgcggcttgtcgaggctgtaggcttcgaggtcggccaaggtgacgttgccctcgtcgatgtccttgccgatgccggagtcgtaggagctgtagcgctcggcctgaagattctggatgaagccgtcctggttcatcttgtcggcaaccagcaggccggcggcgtaggcatccatgccggcgatgtgggagcggaacaggtcctcctcgtagaaggaggtacggcgcggcttggcgtcgaagttcagaccaccgtgaggtccgatggagccggcctgcaggacttcccacatgacggcgacggtctcgtacagatcggtcgggaactcgtccatatcccagccgatgagcttgtcgccctggttggcgtcgagggaaccgaggaagccggactcgcgggccacgcggatctcgtgctggtaggtgtggccggccaggttggcgtggttgccttccaagttcagcttgaagacgtcggtcaggtcgtggttgcgcaggaactcgatggcggtggcggcatcgaagtcgtactggtgcagcgtcggctccttcggcttcggctcgatcaggaactgggcctcaaagccgatttccttggcgtaatctgcgcacatgtggaagaacttggcgatgtggtcggtctcgcgcttcatctcggtgttccacaggttctcgtagccttcgcggccaccccagaacacgtagttctcagcgcccaggcgcttgccgatctccaagctcttcttgagctggccaccggcgtaggcgtagatgtcggcgaacggagaagtggcggcgccggacacgaagcgcgggttggtgaacagggaggaggtgttccacagcagcttgacaccggtggacttcatattctcgtcgatcttgtcaacgaccttgtcgaggttggcgttggtctcgcgcagggtgtcgccttcgggggcgatgtcacgatcgtggaagcagaagtactcgacgcccagcttctggaacagctcgaaggcgtagtcgaccttggccagagcctggtccatcggatcggtgtacttgtagtacgggcggtgcgcggtgccggtgccgaacggatcaaccagttcctggttgaaggtgtgccaccaagcaacgccgaagcgcagccaatccttcatcttcttgccggcaacgaccttgtcggcatcgtagtaatggaaggcgaagtcttccttcggtcctttggcgcggccgacgtactcgatcttgtcaacatcccacagacccatttgggcgctcctttgcagtaggcgatattacggattgcaggaccaataataaaacgaacgaactaagtttgtcaaatgattgaattaatacgccgcgtctcagcgtgttgctagtcattgcaatggttttcgaatgcagtcaaggcacagatagtatgggcaagccaagaaagacaactcagccaaggaaacgagacttgataattgacgtcacgcaattcctcgccggccaccgctgaggccggctccaccaccccgccaactccaacagcaccacccccgccaacaccaccgccatggtcatcaccctgatgatcggctcgtttgtggccatcctcaaccaaacgctgatgatctccgccctgcccacgttgatgcacgagttcgacgtgcccagcagcaccgtgcaatggctgaccaccggattcatgcttaccaacggcatcatgatcccgatcaccgcgttcctcatcgagaccttcaccacccgccagctgttcctgtacgcgatgggcatatttgcagaatgatcttggcgttaatgcactggtgtccggtctggtgatgatgccgagcggcatcgccatgggcatcctgaacccggtggcaggcaagatgtatgaccgtatcggtggccggccgctcgccttactgggcttcgcgatcatgacgtctgcggctgtgctgctggtcaccatcatgaacacgcacaccgcggcggccatgcgcaccggagtgccggaagcggcggcatcggccattggcgtgcgggcttcgttccgcacggtcgccattgtgtgcgcggtctgtttggttgcgtcactcttcattcgtgatcgcggccgccgacttggacagcagcgttaggcgaatccttcaccgattgctggccttcttgatcagcgcgtccaaagtaccggcttggcgcgcggcttccacatcttcccagtcgagaccggtgtctttggccctcccgtagaaaaaccgcaccagaccggcaaagtccggtttatatccggtttcccggaatgaacgggccagcgaatcaccgatttgcgggtcatcaggccttcgtgcctcatagatcgggatggaacaggatcgccacacgcctctcacatgtgcgatgcgattgacgatcatgccgccgtgcgcaccatcgtattgcgaggcggcatgtacgtccgccacctcgtagacaccaccatgaatgatgtcctcaactgtcagacgacctttgaccgcgctggcatcgcgaatccagaacatcgaagcgaaattggtgtcatcaagttcgcgaaaatcacgtatctcgcgtgtgccgatacgttcgtccttgtcatacatgaattcggccaaggctaggaatggcgagatacctgcgcccggaccgtactgcaattcgatacgtaaatcttcggattcattgccggtcagtccaataccgctgacggcgcagtcataggcaaaccaatcccagaaccaccattcgatcctttgcagcacctgcttcggatactttttgcatgggttcagattcacttcgcgataatatatgcgtctcgcttcggcatagacggcgagattgcagcgtttgaacatctcggctacgtctttggtgtccagcattgctggcaaaccggcattttcggcagtagtagtgattgcggtgctcatggtgtttccccttcatgtgatgtggacggcgggctacgttgcccgccgtgaggcacactgtatgacgttcgtgcggtggctcgcaagcccacatggcgagatggtggataagtggaaaacccaatgattccaaggggtatggaatgtgcataacagtggctaccgtcggtggataaccgcactttcttgcaggttatccactgatcgcgcagctgttatccaccgtctctgggttatccacatcgtctctggcgtgtcgtccactgtcagcagtcgatttctgcttcgtttggcgtgtataagtgcacggtgaagtgtataactccgcgcattaggcatatttgctactgagaaaggtcccgaaatcgccttcgaacgcatagctacactcagcagatgtattcagcatggcaatagacccacttaggcaccagcgaatgatttccccccgcttatagagtcggcaaaggcccaacacctgtcccaacgccgacgctactgcactggcagcgtcggcagaggcccacgacttggcacagcaacgacgctaaaaccgcccagcatcgttacacgtccaagttttggccgctaacgacgcttaatgaacgcttagcgtcggcagcaggtcacgcactggttctccaccgacggtagcgctccttagcgaagccagcccgccactctttggcacatcaccgacgctgagagaacctccagcgaagccaaccagccaaccgctggcgacatgacaccacccacacccctcagcgaagccaacctgccagcgcatggcaccccaacaccgatgagaacacccaccccaccagtgcacaaaaaggctggtcatagcggttgcgatgtaatcgcatcgtaatcgcgatgaccagcctcgggagttgggctgcaatgagcaccgatatgaatcagataatgatgccgttgcagtgatcgacttcatgctggataatctgcgcagtccaaccggcgaaggtggcgtggcgggcgcggaaccgacggttctcgtagttgacctcaatacgtcgataacgcagcgtgcggcgttcgccggtcagggacaggcatccttcctgggtatcgaaggcaccgtccgaagcggtaatcacggggttgagcatcaccgttatgcgcccgccaaggtcttcatccacaaagacgatgatgcgtttgcctacgccaatcatgttggcggccatgcccacgcaccgtgaacggttggcctccagcgtgtctacgaggtcttcgatcacctgctcgtcgccgggcccggccgcttcggacggcgtgcgcaaaaacgaccgcgaagtcataataggacgttgcatgctggaatcacgcttcttcgtgccaatgggggttctggccgaaggtgtgaccttcggggttgtccattgcggcgatatcggccatgtcctgatcatcgagttcaaaagcggtcaggtcgaggttctgacgctggcgctccgggttcaaggacttcgggatggccacgtcgccgtactggaggtgccagcgcaaaatggcctggaccacggaaataccgtgcttggcggcgatacgcttcaggtccgggtcgcgcagcatctggttggcgcggcccagcgggctccatgcctcggtgatgatgccgtgcgcgttgtcgtaggccagctgttcgcgctgctggaagtacgggtgcagctcaacttggttgacggccggggtcacgcccgtatcgcgaatgagcagatcaatatggccgggcaagaagttgctgacgccgatatgcttgaccagcccacgttcacgggcttcgaccagcgcctcccatgcctcaacgaactggccttggctcgggttcggccagtggatcagatagagatcgatgtagtcgaggcccatacggcacacgctctcctcaatggtgagcagcgcctcgtcatgggcgtggtggcggccgggcagcttggacgtgacgatgatgtcttcgcgcggcacaccggattcgcggatagcgcggcccaccacgccttcattctcatagttgaaggcggaatcgatgagtcggtagccctgatgaatggcggacttgatggcgtccacgccggccaggccgttgaccttgtaggtgccgaatccggtggctggcagttcgaggccgtcgttggccttgcggatcggagtgaccggtggttcaagcatgatagttctcctgcttctcctgtgatggcatatctgttccatcataaagccaaccaatccgctgcgggcatactatttgacttccctcatttccggcgggcggcgagtggagaatcggaacatgagcgaggcgaggatcacgccgagcacggccatgccggcgaacaccatcatgctgcgtgggaaggcgatcatatacgaaccggcggcgtctgccccatcgttcgcggcgatgggccaccacccacacattgccggacagcgtcacgaacaccgcgtccatgattacggtgcccgcgaagccgatgatgatgaacttgggtgggaagtggctcttcagcacgccgccgaataccgggccgatggccggtgcagcgcaggtgaccagactgacgatgccgagcatcgagccgcgctgttcaagcggcgcttttccagaatgatgctggtgatgagcgacaaggagatgccggtgccgagcgacatgaccagtcgggcggcgagcagcatcgggaagttgaccgcgagcgcgcccagcagtgtgccggcggcgaagatcacgacggccatgatgaacagggttttggtggcgaacttgcgcaccatgaacggcgagctcgaaatcgatactgacagcaagagcagatagccggtggtgagccactgcaccaccgaagcgccgatggagaactcctccatcagcgtggagtaggcgatgttcagtgaggtttccgacaggatgccgaggaaggtcagaatcgcaagcgagacgaccgcgatgacgagcttgccggaaaagggttgtttgccgccgtgaggtagttgtgttgctgaatcagtcataatcgttgctctcctccattcattcacatgcttttgcgatgctgcgcgtcttcctgcataagccgcagggcttcggtcaatgtgcgcacagtggtttcgcattgttccacggtcagcccgcccaatagctggctaagatgcgcatggtattcctctacgtaaacgcggcggatatctagtccacgctcggtgagcgtgagcgtcaccgcacgccgatcggcggcatccatatgcttgatcaccagaccaagctccaccatctcgccaacgagtttggtaacgctcggcgtagtgacgccgagaaaggcgctgacatcgcttacccgtgcggtgccgatttcctgcccattcgtttcgttgatatgccagacggcatcaatgacgtgtacgtagcgcggtttcaggcctttgggcagtgccggcatcagctcggtgatagccttcgctttccagcagacatccaggaggctccgcacctcattcaccggaagcaagccggtcttggtatcggttcgggaatcgcacatcgctggcccaacctccaattagttaccaatagtcattaccataaataactatatgcaggctctagacaaacccaacggcctgcgcgcccgtgtcgagttccgtttcgacataaaaaagccagggaatccctggcttgcaatgcgcatatcgctgcagatttgccgggacctatatgtccccggcaacaacagccgtatatacgctaccgatcagtgctgccctcatcatccttggcacctgccgtggcggcctcagtctccttggcgttccacccggcgacggcattccaaccactccatccgatgaccactagcaagcacagcgagaagacaatagtggcccaattgaacagcgagccatcgttattggcctcgaccagtgactgccagagccagataacgcaggccaagcaggtcaatgcatacatacgggaggtggagcgcgcggtgagtttcatggcggaaaaagtcctttgattacaagaatgacggcagataacagtgtgggatccgcaccagcggcaccggcacgaatcccacatcgaggaggagaaaggggaaggtcagctcttcttgcgcttggacatgatgtccacggcgacggccagcaggagcacgaggcccttgatggtcttcaccacggcggtgtcaacacccatgatcgacagaccctggttgataacacccatcacgaatgcaccgatcacagcgcccgggatggtaccaataccaccggtaacggccgtgccaccgatgaagcaggcggcgatggcgtccatctcgaactccataccggcctgagcagttgcggaagccagacgggagagcatgcagacagcggccactgcggacaggaagcccatgtggacgaacagcaggaagtccacgcggcgggtgttgataccggagaggatggcggccttgcggttgccaccaacggcgtacacgtggcgaccgaacacggtcttggtcaggatgaagttgtagatgaagaccagcacaccgacgatcaccagcatgatcggggtaccaccctgatcagcgttaccggaggaagccagcaggtaggtgacgaaggcgatgacgaccgcggcaagcacaattttgaggacggtcaggctcatcggctcgggcaccaggccgaccttggccacacgggcgcgcttgcgcagctggctccaggcaaagccgacgatgcacaggatgccgagcacaatggtcagaccatcgaacggaccccaccagccaaggatgttgggcaggtagttacgggcaatgccacggaattcgagggaggtaatcggcacggattcgccgacgatcacggtggcgagaccacggaagatcaacatgccggccagagtggtaatgaagcccgggatgccgatgacggcgacccagaagccctgccagacgccgacgatcaggccgacgaccagagcgatgacgatggcgagcatccagttgactccggcgcgttccatcagcagtgcacacacaccaccgatgaaggctaccaaggaaccaaccgaaaggtcgatgtgggtggcgatgatgaccatcaccataccaatggccaggatgatcacgtaagcgttctgctgaatcagggacacgaaggagttcggcttcagcagcacgcctccggtcaggacctcgaaggccacgacgatgaccagcagtgcgccgacaataccgtattgacgggcattgttggcaaccgtggccagcaggccggtcttttcttctttctttgcaggtgttgcagttgcggcgctcatcaggctgccacctccctttccttggtcatacccttcatcaggtattcctgggtaaatccattcttctcaacattgtcggtgacgacaccgtaggacaccgtgtaaatgcggtcacagataccgatgagctcgggcagctcggaggaaatcacgatgacggccttgcctgcatcggcaagcttatcgatgatttcgtagatctcatacttggcgccgacgtcgatgcctcgggtcggctcatcgaggatgaggatgtccggctgcgagataacccacttggcgagcagcactttctgctggttaccaccggagagggtggagacattcacatcgatgtcatggcacttgatgttgaagtccttgcggtactgttcgacttccttgcgctcaaggttgtcgtccacaaccccgcccttgctgatcttggtcagggaggccagggacgcgttctctcggatgttctgcagcaggttcagaccgttgcccttacgatcctcggtggcgtaggcgagacctgcgtcaatcgcggactgcacgttgggcatcttgacttccttgcccttgacgaacaccttgccggagatgttggaaccgtaagagtggccgaagatggacatggccatctcggtacgacccgcacccatcagacccgccagaccgacgatctcgccggcatgcacgttgatgttcgcatggtctacgatcacgcgctccgcgtcgagcggatgatgcacggtccaatcctcgacacgcaggtattcctcgcccggggtattggaggggtggttcgggtacaggttgtgcagcggacgacccaccatcttgcggatgagttcttcctggtcgagcggcgtctccggcgtcacgtacatcacaccgacggtcgaaccgtctcgaatgatggtgacattgtcggcgatggcggcgacctcgttgagtttatgagtgatgatgatgctggtcacgccctgctcgtcacgtagctgacgaaccaggtcaagcaggtgggcggaatcctcatcgttcagtgcagcggtcggctcatcgaggatgagcagcttcacgtccttggacaatgccttggcgatttcgacgagctgctgcttgccgacgccgatgtccataaccttggtatccgggtcttcgggaagtcccacacgatcgagcagcttcttcgcctcggcacgggtcttgtcccagtcgattacgccacccttggcctgctcgttgccgatgaagatgttctccgcaatggacaggaacgggctcaacgccagttcctgatgaatgattacgatgccgtcggcctcggaatcattaatagtatggtatttgcattccttgccatcaaaggtgattttgccggaatagctaccgtatgggtacacacccgaaagcacgttcatcagggtcgatttacctgcaccgttctcgccgcagatggcgtggatctcgccgcgatcgacggaaagattcacatcggtgagggctttgaccggaccgaacgtcttcgtgatgttttccatcgtcaagatggtgtcatttgatgacatgtcaccactcctcgtcacagttctgtgttcatggacatgcggcgcatatcggctatgcgccgcatgtcattgtgtttgtttacggattgcctgatgaggactacttagtcagctcgtcgaagcgatcctgggtgatgtagttggccgtgaccagatcctggaggttgtccttggtgatgttctgggggtcaagcagcttggacgggacgtcgatgttgttgttgttgaacttgccgttcaggccggagacttccttgccctcggcgatctcgacgaccatgtcgtacacggcgtcagccagcttgttcacgtccttgaacacggtctcgccctgcttatccttggcgatgttggcaactgcgatctccatggcgtcctgaccggtgatgtacggccaggagtcggtgcccggcttcatgtcgggacgcttggattcgatggcgttgatcacaccctgggcgatgccgtcgtacggagtgaggaccgcgtcgagcttctcgccgtgggcgtaggtggagtcaaggatggattccatgtccttctgcgcctgctcggtcttccagctcatcacggagatcttctgccaatcctcaacggtgaagtccttggtcacgccaccctgaccgtgctgggacggggagacgagcacgcccttctcgaagtacggctgcagcagatcccaagcgcccttgaagaagtacttggcgttgttgtcatccggggaaccggtgaacagctcgatattgaacgggccggtggcgccatccttaagcttgagctggtcaatgagccacgtggcctcgagcacgccgacctgctccagctggaaggtggcgtagtagtcgacggcgtcggtgttcatgatcagtcgatcgtaggcgatgaccttggcgcctgcatcgcgggccttctcaacggcggggcccactgcggtgccgtccttggaagcgaccacgacgatcttggcgtcgttgttgaccatgttctcgatgtcagcgttctgctgggccggcttatcgtcggcgaaggacaggatgaccttgtatccggccttctccagcttggccttcaggttgttgccgtccttgttccaacgctcttcggacttggtcggcatcgaaatgccgatagtggcgcccttttcgatcttggcatcaccgccagttgcctggccgctacggctgccaccgcaggccgcgaggcccgcgcacatggcaacgcctgccaccacggcgacgatcttcttagtgaacttcatttgttctccttcatcttcgaggggatggcgaaccctccttggtcgcccgaacctgggaataacctcaggttcatctcatagaataccgtattgagttaagttgtcaaactcaagaaagcgaatttcctgtcgtttatgttcgaccaatgaacgcaatggcgatttttctcgcatcacaaggcgacacgccgaaaaatccacgctctgcgcctcgctgtgcctcatgccggtaacgactacactgaactcttatggcaacaaggcttttcggttcgcagacctcgcttcgcgaggcaaaccgcgccaacttgctggccagtatccacaagttcggcgccatgacacaggtcgaactggcagaggtgacaggactgtccactgcgaccgtgtccacgctcgtccatcagcttgtcgacgaagaccagctggagaccaaaaacaccgttcgcaacggtcgcagagccactctagtgacccttgcacggcatcagggcctcggcgtcgggctttggatcgcgcgacgtcatcttacgctttctatcgttgacttctcgaagtcaatcatcgctgagcacacgctccccttgccgttgggccacaaggcggacacaacgctggaacgcgccatgctgctcatcaatgagaccctgagcagcatcgacgccgaagccagcgagctggtcggcatcggcgtggccgtggccgcaccggtggccaccagcgaccacaccatagcgattcccggcattctgcccggatgggacggcgtcgatatcacggccccgttgcgcacggcgttcaacgttcccgtatacgtcgataatgacgcgaatttcgcggcatacggcgaatcccgtatgggcgtggcggcaggcaaacgcaatttcgtatatatctcagccaacgacggggttggcgcaggcatcgtcatcaacggcgaaatcatgcatggcgtgaccggcctggccggtgaaatcggccatatccaggtcgacccgctgggtgccatctgttcgtgcggtaaccgcggctgccttgacaccgtcgtggcggaaaacaggctggtgcagttgctcagcgtcacacacggcaatatgacgctggatgatctggtgtcctttgccaacgaaggcgaccccggttgccgtcgcatcatcgccgacacggccgtgcgtatcggtcaggtggcggctgatctgtgcatcagcgtggatccggaggtcattgtgctcggcggcaagctggccatgaccggcgacgtattcatccaaccgttcaatgaagcgttgcagcgcatgctgttccctgatgccgtggcacccatcgatgtactcgtgtcatcccacccgaacgacaactgcgcgctaggcggcgcattatgcgccatcgagttctcggttcgcaatgacgtcagccagtgaccggtaccaggagaagagtgagaagaaggaacacaccatgaggaattcgagcacacctcctctgctgcggctggaggacatctgtgtgaagttcggcttcgtcgaggcgttgaaatcggtgaatctgtccatccaacgccaggaggtcgtcgccatcgtgggcgataacggcgcaggaaagtccactctgatcaaggtcatcgcgggatttctgcagccgggattcggccatatctatctcaacggcgaacaggtgaccattccctcgatcagggaggcggaccgcatgggcatcgcatcggtgttccaggggcaggagttctgcgacaacctagacgtggcctcgaacctgttcctcggcaaggagatcaatcagattggcatacgcgatgacgattcgatgaactcgcgtgcccgttccgtgctgaagaccctgagctcggcgattcgggtcggctcccctatcgcatccttatccgtcggccagcgccagaccgtggccatagcacgcacgctgctcaatgacccgcagcttattctgctggacgaaccgaccgccgcactgtcggtgatgcagtcggcggaagtgctcgcatatatcaagagactgcgctccgaaggccggtccgtggtgatggtctgccacgatctgccggatgtgttcgcggtatccgaccgcattgtcgtgatacgtcaggggcacgtcaccggcgtgcatcgaaccgtcgaaacgtcctatgaggagattatcgccgaaatcgccggcgtgaccaccgaacacgagtacgaggaaatcgctgagaacccggaattcgattccatggtcaggcagcggaaactcatcgaccgcactatcagcgcggcagtgagccatggcaccggccatgactcaccattagactaacgtcccgttgccggagcgacatcgtcagcgcagagccaggttggccgcgccgatcagaccggcatcctggcccgcagtggccgcgacgatcttggcatggccgcggtaggcgctgccttccaggaaacgctggtagttgtagcgggccggctccagcaggatgtcgcccacggccaccacgccgccgccgatcacgaacaggtccgggtcaagcacggcggaaacggcggccatggtgcggcccagccattcgccgatcttgccgaacgcatacaggccaagtacgtcaccttcctgagccgcttgggacaccatcggcccctccagtttggtgatgtcgccgccgcacagttccagaagacgcttggcgtcctgaggacgacggcgcacggcggacttggcgaagttctccagcgaggttcccgaagtgtaacgttcggcgcagccgcgcaggccgcagccgcagtggtcgccgtccgggaccatcggcaggtggccgagctcggcggccatgccgaaggagccgcggtagagctggccgttgatcacgatggcaccgccgaggccggtgcccacggtcagcgcgaccatgttggagctaccctggccggcgccgtgcacgaattcgccccatccggcgcagttggcgtcgttttcgacgatgaccggcacggcatggtcgatcagcgcgccgacgtgctcggacagatcgtagttgatccatgccggaatgttggcggagaaggtgagcgtcttgcgatccgcgctcacattgccggcggcggagatgccgacggcctcgatatcggtgtgcccggcggccacagcctcgcggtacacctcggcgatgtgctggttgatggcgtcggcgtccatcggcgtggggacgcgccagcgctggatgatgctatcgttttcatcgcagacggcggcggcgatcttagttcctccgatatcaatggcgagcgtggtcatggcttactccttgaaggcttgtgtggcgtacgagacagcgaaaatagtaacgagttgccatgacctcccatagcgtatttttcatgatttgtcatatctcgcgcacgttctgccaatgtgaccctgcacacgtttttcaccatttataagcactgttaacgctaacgttgtcattcaatagcaaacgttgtcattcagactatcggcgtgtcgagcagagccccaaggccagcacgaaaccttcggtatttccatgcgatacggcatcggcatcgactgaaacagcttccatgccagagtcgaatggccatcaaacgactaaacaccagacacacattttggcctataaccccatatttcgccctacaccacgaaatacggcaaaagaacaaaaaagctcctgacatttgtcaggagcttggtggcgaccccggccggacttgaaccggtgacctccgccgtgacagggcggcgctctaaccaactgagctacggggccatctgtacctcaatgaagcacaagaggatatactacagcatcactggaccacggcgcgccgcccggcgcgtcgcgccacggcaatgtcaggcccatccattacccctccaagccatagcgacgcccgccattccagcccttccgataccatggtgggcggtggtttggcgtggattcgatcgttatgcggacagggcggcacaggcctgacgcggcgcaccgcgatccgtgattcgggggcgtgctccgcgctgcacacagcgtatccatcacaaactaaagactaaagaaacagcggaatttcaacccctttttaaggagtaactgcacaacatggcagaattcgtatttcagatgatcaaggcccgcaagtcttacggcgaccgcgtgattctcgatgacgtgaccctgagcttcctgcccggcgcaaagatcggcgtcgtgggcccgaacggcatgggtaagtccaccctgctcaagatcatggccggcctggagaccgtgagcaacggcgaggccagcctgaccccgggcttcacggtcggcatcctgcagcaggagccgccgctggacgacaccaagaccgtgggcgagaacatcaagatggcgttcggcccgattgccgagaaggtcgcccgattcaatgaaatcggtgaggagatggccaatccggacgccgacttcgacgccctgatggaagagatgggcaagctgcagaccgagatcgacgccgccgacggctgggacctcgactcccagctcgagcaggcaatggacgccctgcagtgcccggacccggacaccccggtcaacgtgtgctccggtggcgagcgccgccgtgtggccctgtgcaagctgctgcttgaggccccggacctgctgctgctcgacgagcccaccaaccacctggacgccgagtccatcctgtggctggaacagttcctgcaccagtacaagggcgcagtcatcgccgtcacccacgatcgttacttcatggacaatgtggccgaatggatttgcgaggtcgaccgcggccacctgtacccgtacaagggcaactactccacctacttggagaccaaggccaagcgtctggagatccagggagccaaggacgccaagctcgccaagcgactgaagaacgagctcgactgggtgcgctcctcccccaaggcccgtcaggccaagaacaaggcccgtctggagcgttacgaccagatggaaaacgaggcacgcaacaacaagaagctcgacttctccgagattcagattccggccggcccgcgcctgggttccaccgtgctggaagccaaccacatccacaaggccttcggcgagcgtgtgctcatcgacgacctgtccttcacgctgccgcgcaacggcatcgtcggcgtaatcggcccgaacggcgtgggtaagtccacgctgttcaagaccatcgtgggcctggagccgctgaccagcggcgagctgaagatcggcgacaccgtcaaaatcagctacgtggaccagaaccgtgagggcctggatccgaacaagaacctgtgggaagccgtgtccggcggcctcgacttcatcgaggtggccggtgtggaggtgccgacccgcgcctatgtggccagcttcggcttcaagggcgccgatcagcagaagctgaccggcgtgctctccggtggtgagcgcaaccgtctgaacctggccctgaccctgaagcagggcggcaacctgctgctgctcgacgagcccaccaacgatctggacgtcgagaccttggaatccctcgaaaacgcgctgctcgaattccctggctgcgctgtggtgatttcccacgaccgttggttcctcgaccgtgtcgccacgcatatcctcgcgtgggaaggcgacgacgacaacccggccaagtggtactggttcgaaggcaacttccaggcctaccaggagaacaaggtgacacgcctcggcgaggatgcggcccgcccgcaccgcctgcacaagaagcttgtgcgcggctgagatacgccggcattagtgccacaacgcgctttatacgtcgaaagccgtccctcaggggcggctttccccataattgccccatggctgcccgccccgcatcccataaaatcccacagtcgcctacggcaacacaccggcagcgcagcagcaacgtagcggcaatgcgccgcataacccaccgtttaccttccaaacagtctcgttacatttcgctcccggaactcttaacccccaccggatagactgccaaccataggttggaatacgataaccgaatactgaacacagcagaacaagaatcgaggaacgccatggctcaggcaaccaccgtaactccattggaccatctggtgaaggtgctgaagttgggcgagccttccgcttaccgcaatcacacatatatcaatggcgagagtatgtacttccccaccggccgcgtctacggtggccaggtcatcgcccagtcggtgatcgccgcgtccaaaacagtgggcccttcacgcctgccgcattcggtacatggctatttcattgccgccggcgatattcgtcaagacctgttgtttgacgtcgagaaccttcgcgacggccgctcgttctccgctcgtcgggtcaacgtcacccaagccgaggggtcgattctcacggccatcgcctctttccaggagaccggccaagagggtgtggaatttgccgatccgatgccggaaaacctgcccgatcccgaaacgttgacttccgccaaagaactcatgcagccgttcgccgagaagtcgccgttcgccaattactatgccgagaaatcgccgttcgatatccgccacgtgacgccgaccgtgatgctgcgcgcggacaaggattccgccgagcatgattccggcaagcagatggtgtggatgaaggccgatggccacgtcgatgtgccgcaggtcatgcatcgtgcgatgctggcgcttggctgcgatcaggtgatgatggagccggtgctgcgccgcgccggactgtcgatttccacaccgggcatttcctatgcgtccatcgaccattcgatgtggtggtatcaggatatcgatatcaacgaatggcatttgtatgtgcaggatacgcctatcgccgcgcacggacgcggactcggcattgccaaagtgtatgcgcagaatggcgacttggtggcggccatcgctcaggaagctatggttcgcgtgccgcaggaatagtggtaatcggcttggccgatggtgtggttttttcttcttctctcccccagtcggctacgcctacagccccctcgccagagggggcttatcacggattatcttttgtaggcctgggctatgtcgctacggcgcttggcttccttgattttcaggttttcggggccttcgttcggcggtaactggcacaaccattcgccgataatgccgatgatcatgtcggcgatgcacaccacggccgcgattgcacactcggtgacggcgtgtgcatagaaatccgcctcgatatggctcaggctcatcacaatctgaccgccataccagccggcgagcgttgcgcccgccaatcccagtgccttagacagcaccagcgtatacaccgcgatagtgggattgatgaagctatgcggacgcttcttggggtcggtattcgcgtatttatgcacttgcagggccaagatcagcacgataacgcccagcacggccagcaatccggtcacaatccgaggcgcaccaatcagcgacagtcccgagctttcgccgtaggaggccagaccgatacccgccaacaggcccagcacggcaccgatcacatactgccaccatggtgttcgccgtgttttcatgtccggcctccttatcgttgcgttgctgtttgctgtttgcgaacggccctcgctcctgggctgctcatcttgatttggttttcgtcactgccgtgcccggctgttcgaggccggagactggtccgtcaccgtctggtttctagcctaccgttcgtaactggttctgccatcagctcaactgttcgacagtatccagttgtccgatagcaatccgacctgtccggcatccggtgccatggccaaaaggaaggccaccgggtcgccgcccagagaagcattcgggtccatatccagccaaggtgccaataccgacgcatggttacgggccgacggccaaggaatgctgcagttgggctcgtcggaagtcacgccttccatgtcaacaaggtcaaggtcgactgccaggtcatgaacgctttcgatgctgcccaatacggcaatcaggtcggcgggcggcaacttggtttcgatttggatgaccgcgctcatcgcgtccgggccgtcgaaatggctgacatggtagagcggcgagatgccctgtacctgattgccaggaacactgtcgatggaaacgatggtttcgcggaacagccgttcggcatcctgcgaggtggaatccagcgaaataatcgccttgcgtgagacgggttccgactccgacgctgattcttgcttgactgcatgcccgccgagcatccagtcttcgctctcgagctgcacggcgttacggtccggcgcggcggccagcaaatcggctacaggcccctcatgggctccagcaagtttggcgttcggattcagcgccgcccagggagccagcacaaatgcgcgctgccaagcacgcggatggggcaatgccagatccggatccgcgctggtgatgccatcaaagtcgataatgtccaagtccaacggcctggaatcccaatgattctcacgaattcgcccatggttcgcttcgatgttttgcaacgcggcgagcaattcgtggctgcccattgtggttccaagctccaccacggcgttcaggaaatccggcgtaccgtcagccatgccccacgcggccgtgcggtaaagcggcgaaataccggtcacctgtgtgccaagcagcgcgtcaatctcccgaacggcggctcgcaaggtggattccacctcgcccacattgccccccaaggccaccaccgcattatggatggcatgcttttcagcagtgcgtccattatcggtggcacgcacgcgcgagatggagaccgatacatctgcaaaagccacgacgatgggcgcgtgaggcttgtgcacggtgacgtcgatggaggcgacggccggcgcatcggcaagaatcttatccgcgatacgttgggccagacgctcgatcaggtccacatgagggccttcgatgacagccacgatatccttggccacgcggccgtaatcgatggtgtcattgagatcgtcggattggccggcggcggccagatcaaggtgcagggtgacgtccacgacgaaggtttgtggccgttcgtgttcaaaggtgagcacaccgtgggtgccgttggcatgtacgccggtaagtgtgatggtgtccattggtaaggctttctgttcaaatgctccccctcagtcgccttcggcgccagctcccctcgcccgaggggagccaagacctagaagcaaccaaaaacagggagccaggggaatcatgcgtattcgcgccaggtgttgccggcgatgacggcggcgcggcttttggccacatcgtgtacgcgcacggcccatgcgccgtgctcggcggacagggcggacaaggctgcggtcacgtcatcgcgctgggccatggtcgggccatcagcaccggcagtacccgccccggtaagcatcgccgaaatgaagcgcttgcgggactggccaatcagcaccggatatccagtggcgcggaaggtctcgagcccggtcagcagcggtaggttatgctcgatgccgggcttggagaagcccagaccaggatcgatgataatgcgctcaggctttacgccggcggccagcacgccgtcgacttggcgcatgagttcgtcgtgcacgtcggtcaatacgccatgctcgtatacggaggtgtcttgatcggggttcgcgcccttggagccgacgagccagccgcgccaatgctgcacgacgtacaggcagtcgtggtcggcgaccacatgcggcagctcggcgtccagcgtgccgccggaaacatcgttgatgatctgtgcgccctcgctcagcgcggcggcggccacggatgcgcgcgtggtgtcgatggacagtacggcaccggccggaatcaacgtcttgacggcaccggtgatacgggccagttcgtcggcctcggacacgcgcttggcaccggggcgcgtggattcggcgccgatgtcgatgatatccgcgccggcggccatcatgtcgcgcccgtgctgggccgccttggccgggtccagccacaggccgccgtccgagaacgagtcctcggtgatgttgagcacacccatcaccatggtgtgcgtggcgtcatgcaacgcctgcaaatcagtcataggtcatctccccttcattgtttccccttcgctcccctcagtcacctacggcgacagctcccctcagagaggggagcctaggttgcgtcacttgtcaagaatcagactcatggcttcggctcgggtggcggggttgcgtagcagaccgcgcaccgcagaggtcaccgtgcgggcggaagacttcttgatgccgcgcatcgacatgcacaggtgctcgcattcggtcaccacaatcacaccacgtgcgcccgcatactcgaccagcgcgtcggcgatctgctgggtcaaacgctcctgcacctgcggccggcgagcatacacctcaaccagtcgggcgagcttgctcagccccatcaccccatccttggcgggaatgtagcccacatgggccacgccatggaaaggcagcaggtgatgctcgcacaccgaatacagttcgatgtccttgaccagcaccagctcgtcggtatccacgtcgaagtgcttctccagcacatcggccggcgaggcctgcagaccggcgaacagctcgcggcacgcgcgggcgatacggtcaggcgtttccaccagtccctcgcgctcgggatcctcgccaatcgacttcaggaacagacgtacggcttcgcgcacgccttcctcgtcgtatgtgcgtttctcccgctggcaagactctatattttcgttcatctcatctctcccttgtcattgtccacaacgacgtcggcccggcctgcgtacgtgagaaaccacatacaggtcgggccgaatcgtcatcgtgtctactcttccggcttcatgccgaccgagcgcttgaggctttcgggaatctccaccggcggcttgtccgagtcggggcggcggtcgttggacagccacaccggacgaaccggagccttcttgatcggcgcgaagatcgccgcaagttccttctcgttcagggtctccttgaccagcagctggcggaccagctcgtcaagaatctcgcggttgtcgttgatgatggtccatgcctcggtgtgcgcggtctccaccagcttcaacacttcgtcatcgattacttcagcagtacgatcggagtacttgcgcggctgcagaccatccatcacagtggtctgatcgtcatcggaaccccacttgatggcgccgagcttatcggagaagccgtattcgatcaccatcgtacgggcgatgctcgtagccttctcgatatcgttcgaagcaccggtagtcgggtcgtggaagacgatttcctcggcggtgcggccacccatcgcgtaggccatctggtcgagcagctggttgcgcgactgcgagtagcggtcggaggtcggcatgacggcggtgtagccgagggcgcggcctcgcggcagaatcgtcaccttggtcaccggatcggtgttgttcaaggcggcggccaccagcgcatggccaccctcgtggtatgcggtgttgcgcagctcttccagagccatgcccttagacttgcgcttcgggccggcctgaacgcggtcgatggcctcgtcgatggcgcggttgtcgatcaactgggcaccggcacgggcgcacagcaacgcagcttcgttgagcacgttggccaaatcggcaccggtgaagcccggcgtgcgcacggcaaccatatgcaggtcgacgtccggtacgaacggcttgcccttggcgtgcaccctcagaattgcctcacggccttccagatcaggcgcggccacacctacctgacggtcgaatcgacccggacgcagcagagcggggtcaagcacgtcagggcggttggtggcggctatgatgatgaggttggtgtcgttgtcgaaaccgtccatctcgacgagcagctggttcagcgtctgctcgcgctcgtcgtggccaccgcccataccggagccacgcttgcgacccacggcatcgatctcatcgatgaagatgatggcgggagcgttcttcttggcctcatcgaacaggtcacgcacacgggaggcaccgagaccgacgaacatctcgacgaagtcggagccggccatcgagtagaacggcacgccggcctcacctgcgatggctcgggccagcaacgtcttaccggtgccgggagggccgtacagcagcacgccgcgcgggatgcgcgcacccagcgccttgtacttggacggatccttgaggaagtccttgatttcctcgacttcggccacggcctcgtcttcaccggccacatcggcgaacttggtggtgggggtctggccctcgagcagcttgccgctgttcttcttgccgcccatgccgagcatgccgccggcaccgcccatgcggctcatcagccaccagaacaaggcaaagaagatgatgaacggcaaaatcgaggtgatgaggtagctcatcacactggtctgctcgatattcgaggtccagcccttttcgagatcgccgttctccacggccttggccacctgcgcgccctgggcgaaggtgtagtagaactgcacgttcttgccgtagttggtcaccttgccggtgtcggcgttcttcttggtgtagtcattcttcagctcaaggcggacgacctgcttgttgtccgtgatctcggcgtatgtggccttgccctgattgatcagcgcgaaaccatctttagtatcgatggttttggtgccaccgccggcgaacatctggaacatcagcacaaccatgaccacgagcacggcaccccacagccagggggactgccatatcgggcggttctctttgttgcctttgccattgttcccgttattgccacggttgaacgggttggtgaacgggttgccgttgttacggttgttgttcgggttcgggttattgccgttacccggcccttgcgggaagctcatgcttgcactccttggtagacggacggcttgaggaccgcgatcgaatcgaggttgcggtagcgttcgtcaaagtcgaggccgaagccgacgacaaactcgtccggaatctcatagccggcgtacttcacatcaacgtccacctctcggcgggaaggcttgctcagcaaagcgaagacttccacggaagcggcaccacgacgtttcagttctgcgaccagccacgcgagcgtgcgtcctgaatcaacaatatcctccacaatcaaaatgtgccgtccgcgaacatcggcggacaaatcctgcctgactgtgacctcaccgctcgacactgtgcccgagccatagctcgacaggctcatgaaatcgatctgtacaggaatgctcatggcctgggtgaacgcgaccagcgtattcacggcccctttcagcaccgcaacgagcagcggattcttatcgcggtaatcctcgctcgcgagagcagccatctcgtggatcttggcatcaatctgttctttgctgaccagctcgtggtcaatatcttcctcaacgtcagcgattcgcatgcgctccatcttggcacacgcgaatgacgtgtttcttgcgattggctgaataacctctgggaagtgagacgccgccttgcccatgccaatcgacgaccagccggtcgatggcggcaatctgggcagcactggcgttcacaccggcttggctcagcgcgtgagcgatgacccgcaaccgaatcgcctctggctcacgtgcaatacgtttgacgctgatcatcaggccgatgccatggctcgaatcgttggtatcgcctgccacacaggctcgtggcgcatcggtcgatacagctgccgacgatgccggccaatcaactgccgcaaccgcctcccccatcacctcgtcggatcgctgatccagatactccttatccattctggccaaccgtgcgctttcggcgaaatggcgggtgacattgaatccagcgaatcgttcgatggccggcagcaggtcgtgacgcacccgcgagcgcaacggatagtcgttcggcaactcgccgtctaccgcatcgccattggtggggtcatcccaatattccacacctaagtcttcacagatgccggtggtttcggctcgagtaagggtaagcagtggccgcgcaaaagtcgcgccactgcgtgtgaagacctgcggcatgccagccaacgcatccacgcctcgactgcgcagcaggccaatcaatacggtttccgcctgatcgtccatagtgtgggccaacagcacggcaatggcacccgattcatgcgccgcggcgcacagctcgtcataccgggcctgccgtgcggccgcttcgaggccctcgccgcgcgcctgtacggttgcgttgcgcatgatgaccgggcccagtcccaacgcgtggcaacgatccgcggcctcgctggcgacctgttcggagcctgcctgcaagccgtgatccacaatcacggcaccgcaacgcacgcccatggacgtgcatacgatatggctcaccgcagccagtgccatcgaatcgcgcccgcctgaacaggccacgagcacgagcggcgcatcggcggcaacggcatggtccccatgctgcgcgaattcgggagcctgcacatcgcatagttccacggcactcagcgttgcgcggaccgcgcctacggccttgcgcaatcgtgcggaatatgccatgtactcaccaccttttttctggttataggcactcgtgcgtttatggacgtttacggcctttatagcccttgatggcccttgatgcctcttttacagccccgcgagcttggtgataaacgagtcgatggcgctacgcgcggcggcataatcctcaggattgttaaccaccacggcaaacgacaacgctcccccattggtgcgggacacattgccggccatcgacgtaaccgtgccgaggctgccggttttgacgcgcagcagaccagccacggcatcatccgtataccgatcctgcgccgtgcccaccaatcccgcgatggatagaccttccgcaccagcagcaccgctctcggtggtcagattacgttgttggacggccgccagcgtgcgtacggtgagccgggagccgggagacaggccggagcaatcggccatggtcagaccggatgtttcgagaccgagatcgttcagagtggatttgaccgcttccgtgccgccttcaggactgtttgtcgctgatttcgccaaggcggtgagtctgccgaactcctcggccagcgtattgtccgaatgccgcaacgtgtatgccatgatttcggacagtgttgccgaactcaccgaagccaaaggcgtttcaccggatggagcggtgtttgccgtcacgtctccggtaacggccacgccgttcgattggagcagttcggcgaatttcgtggccacgtcgctggcggcgtgctgggacagttccgggtatccggccgaatcatcggggtcggccggcgcaggcgtatcggcggtgtattggcggcctccatcaatcgccattgatgagaccggcgtgaagtagacggtgtagtcgcttaagactgcgccgccttccgacagacctgccggaatgcgtgagtcgccgaatagggtgtcgtcgtactcgagattgacggaagtgatgcctcgctgggcgagcgcggccacggtggccttggccaaggtgttcagaccggcacgtccgttggtatggttggcgtcagaatcgcctgcagacagcagcatgtcgccattgcctttgagggtcaacgtattggtgccgtcatcggattgggtgaggaacacttgggtatccaaggtggatgccatattcagggtggatgaggcggcgagcgcggtcagcgttttcagtgtggatgcaggctcgcgtggagtgttcgactcatgttcggcagcgacggtgccttgggcgtcttcaatgatcaccgacgtatcgtttcccacgccttgcgcggacagcaattcgttgaccagcgcagaagcggccgtggaatcaatggccttgttcgcgttcaaggtgccggcgacggtgccgcctgatttggcggtggctggatcggcaaaaacaggtgcggcgacgggcttcaacgtcaataatccgggggccacgtcggtgatgtcggcggcgcagtaccccgcgaacagggcgatggtggtcagtgcggaaatgatgacggtcagtgttcggcgatgcgatcgttgggtccgccgttgcgcttcacgccgctgacggcgtgataccgctgtagataccatcgtgctccttatgccaaggcgatcatttctgcaatgaggcgaacgagtcgagtgctgccacaatcgaaagcattcgcgcatccatcagcttaccgcccagccatgtcccgagtgccaggatgccgatgccgttggccagtgcgaccggaataatcgccagccatatgccgccttcggctcccgtcagcagcatgaccagcgccacgatgccggtgggcagcatcagcagcaggctgccaagcacgtagacgaacgggaagaagccttgggccatggcgcggccttgaggcgcggagaacggcttgtccattgaggcgaccgggtacatcagcacacaggacgtgacttcggccacgcccaggccgctcaaggcgacgcccatgcccacggcgaggaagatcaggccggtgacgaggtcatcgggctgcgcccagcggccggtcagtgcgccgaccagcacgatgccggcgagatagagcagcaccatgtagacgaccatgatgccgacgtagacgcgcacgcggccgattctgtcggtccggccacgcacgccggcgatgacttccatggtgaagccgcggccgtcatatgcgagcccgttgctttccaccactgacatgaaccagccacaccagatcagcgactgccagacgaccgcgctgatgccgtgcgcctggaaggcgaagatgatcaggaacaggaccggcatggcgaaggtcatggcttggcgggggtctcgtttgagataggtgatcaggcgtgcggacaccgcgccggatgccgaatcgggcatccatgcgaatgcgccgatgcctttggcggtctcggacggactgtttgcgccgatggtgagccgttcatgcctcagacaccaagtgcatacggcgaagcagacgatccatgtgacggcaaggatggcgatgcgggcgatcagcaccgcccaagctccggtaagcgcgtcgaacggcagttggaaggccgcaccgaacggcgtccatgcggcgatggcggtcgccgcgccccaggtctcggtgttgaggctgaaggctatgccggagttgaccagaatgttcggcaactggcagatgatgacgaaagtcagcacgatgaagatgtagaacgcgcctttgccgcgtttgctggtcaccagcgtggtggatagggcgatgaccagtttggagatgctcatcatggtgatgacggccagcactgcggcgaggagggaactgatgattacggctggtcccatatgccgataggccagtgtccagagcatcagtgaggccacgccagtaagggaggggatgccggacaggccggaaagcagcaagccgaattgcaggttgcggtcggcgatgccgtagatcgcgaatttgcgtgggttcatggtggagccttcgccaagcatcatgagctggatgaagccgatgaagatggtcatggtcgcgccgaccagcacgacgactatgttgacgatgcctccgggaccaaggatgttcagcggaaagccatccgcgttcacggtgaagggcggcagtatgccgatgaaccatgcgagcacgccggtgccgatgatggtgccggccgcgagtacagcggaaaagacataggcgacggtctgccacgccgattttcgcagggtggcgagcgtgagcgtccagcgcaggcggaccagggtgatggcggtcttgatcattggcgggcctcatcggtgggtgtggcgggcgtaggcagaatcggctgaatcgtctgggccgaagttggtgcttgggcttgggcctgcccgccatcgagccacgcgagatgggcggcttcgtggcggccaccgactagttgcaggaagcggtcttcgagttcttcgccagcagcgacctcgtccaccgtgccggccgcgcataccagaccgtcgttgattacggccacatgcgtacacatcttttcgaccaatgccatcacgtgtgaggagatgatcaccgtgccgccagtcttcgcgtattcgatgagaatgtctttgaggttggcgctggacaccgggtccacggattcaaacggctcatccaagaccagaatgcgcgggctgtgaatcatcgcggaggccaggcagatcttcttggtcatgccggccgagtaatcggtgaccatcgtgttggcggccccggccaagtcgaaagcattgagcaggtcctgggcgcgacgcgtggtctcctcgcggctcatgccgcgcagcatgccggagtagacgagcaattgcaaaccggtcagtcggtcgaagatctggtcgggctggggcatgacgccgatcatgcgcttggccgtgttcacgtcgctccacacgtcatggcccagaatcatggcggtgccggcgtccggcaccaatagaccggtcaccatattgagcgtggtggttttgccggcgccgttagggcccaccagtccgtagaacgagccgattggaatgtcaagcgcgagcccgttgacggcgatcttccggtcgaagtgcttgaacaggccgcgaatggacaccgccgtattcgggttcggcggccatgcttgcggctgtggctgttgcgactgcgaagacgcgggagcggcggctggcatcatcggcggctgaaatccgacattcctttgagtattgtctaagctcatgcatctactctagcccaccagtcaaccctcagcgcagcacccccgggttgctgttggattgccccgctgagcagctccggactagcggactcggtcagcccttatgtgcgatgggcctccactgggctttggcgaagatggcctggaaggaaatcggcacgtagctgagcatgtaaatcgggaagctgagcacataggcgagcagctccttgttcgtggcaccgatctggtcgtgctcgacaatgatggtcaatgcagccaatgccatcagacccaacaccgatgtgatgatgccgctggaccaaccggccagcgattgcagctggctcgaccaactcacgaagccacacgcggcgaacagcaagcccatcaccgcgcgaatcacgcccaacacggtaaacggacacagcatcaaggtgaagtcgatgcaggagaaatcacgttcgcgaaccgcgcgtttcagcaatgccgagccataataacggaatacctgcaggaatcccttgctccaacgcaaacgctgacgccaactttgcgagaaggtaaccggctgctcgtcgtagaggatcgcagtaccgcaatagccgatgcggtcgccatgcagaatcgaatccatagtgaattcaagatcttcagtgagcaggtggaacttccatcccttgttccgcttcatcacctcgcgggagaacatgaatcccgtaccgcccacatggcaagaggaaccgagaatcatacgcgagttagacaggaatcgcgattcacggatgaaccacagcgcagaaccagaagacacccagttatccgccagattcaccgaattacggtagctggtcagaatcttgaatccggagcagaacgccttgttcatttcctcgaagtaatgcttgtccagcttgttatcggcatcgaacacgaagtaggcctcataatcatcggccacaccgatgtcgagcatatgccccaacagatacgtcagcgcatatcccttgccaaccagttcaagattgtggcgttccaccacatggcagcccaaagaccgcaccacgtcggcggtgttgtcggtgcagttgtcggccaccagccagatgtcgatgaggtcggacgggtaggtctgatcgcgaatcgacccaataaggttgccgatcacgttttcttcgttgcgcgcggagatcagtacggcataccggttggtcatcggggcgtcggggaagcgcacgggcttggcgaacagggacatcacgatgcacagtccctgatatatcatgccggcaccaccgacgattaccagaagaatatcgagtacggaaagcagggtcatcagcgccaccccgccctaggattgctggaggcagattgatcagactgcttggtttgcttgcgttgcttgggctgctcagactgctgcgtatccgcggcaccacgctgcggaatcgccacggtggcggaatcgtccaaatcggattctttcgtctcgtgtggcggaatcgcatagatctgttcctgcagcaaacgcagttcctcattcatcggcacacggctggtggaccccttggccgcacgcggcatgtgctcgccgatcggctgcagcacatgctcgccgaacgcttcggacgcctcgacgatcttggacttcttctccggagtcggatcgttcatcagtggtgagtcaatcagctcatagcgcttggtgtacgcacggaagatggcctgcagcgatgcggtgaccggcagcgccaggaacgcgccaaacgcgccgaacagcgagccgaacgccagcaccgcgaggaaggcgacggccgcgttgatatccatcgtgcgctgcgaaatcctcggcgagagaatcaggttctcgatctgctggtagacgatgatgaacaccagcaccgccacggcgtacgtccatccgcggttgccccaagcgaacagcaccggcagcgcgccgccgatataggtgccgaccgtggggatgaactgggataccacgccgcagaacagggccaacggcagccagtagggcacatgcagaatctctaagaagatggcagtgcaggtggcgttgatcaacgccagaatcgaacgggagaacaggaaggacgaaatctggccttgggccacggtccacaccagcaggaatcggcgctgcgtgttgggggccagccactggcagaaggagcggcgcagtttggggccggcggcggagatgtaatacgtggtcatgaccacggtcatgaggttcagcaggaaggagaacaggccgcccaccgtactcatggcggtaccggcaaaatcggtgacccacgaggtctggatattgttgaagatttccatgccgagattgctgatttccggcatcttgaacgtggcatactggtccacgaactcacgaatctgctcatacatggccggcaaaccgcggaccatggcaatcatctgctgtacgaacatgttgccaaatagcgtgagcagcacacccacgaccacggccacgcccaccaagctgacggcggaagccacgccacgcttccagccatgagccaccagcgccaccaccaacggttcgacggccagcgccaggaacagcgagatgatgatgtcgagcaccagataggagatgtcgccccacgagcgccagcagaacatgaatacgatgacggcgagggccacatacagcagcgcgcggccgaaccattccggtggcctacgggaatctcccttggcggggaacaaagtaccaaagtcgatacgattctcgtcgtccgggtctgccccggcctctgcggcaccggttctcaacgtgtcggtgctgtttacgtttcgcacgcgttcgctcatggctccccattgtagcgaggggtttgaagctcggatacgccggcggcgtacacccgcttttctattgttgatgttatgctcaacgtttcgatcatcatcccagcgtggaacgaagccgaacgcatccgcgactgcctgctgaacgccacccgtcagaccatcatgccgcatgaggtgctggtggtggacaatcgttctacggacaacacctgtgcggttgtcgaacagttcattgccgaacatcccgaggccccggtcaaactgttgcaccagaacgatgaacaggggctgattcccacccgcaactttggcctgaacgccgcgaccggcgatgtgctgggccgttttgacgccgactgtatgatccggcctgactgggtggaggtggtctccggcatcttcaccgaagacccggccgcgatgggtgccactggtccggtgatgtattacgacatgccctcacgccatttcgggttgaaaggcgacaattccttacgcaagcgaatctaccgtgccgatggcggccagccgctgctgttcggctcgaatatggccttgcgcgcttcggcctggcatcagattgtgaatgaggtctgccgggataaggccgatgtgatgcatgaggatatcgatatttccctgcatctgatgggcaaggatctgaaaaccgtgtactcgccgcgcatgatcgccgcgatgagtgcgcgacggatggatacgtcgttgagttcgttcctgagctacatgcgacgttttaagaatacgtttgatgcgcatccgcaacatacgcgcacgcataagccggaggtgttgttcaccgccatgtatccggcgatgcatatgttctacccggtgtggcagaaagtgctgaattccgcggatatcaatccggctgaagccgcgtggatcaacgagcagatggaactggcggaggcgcaaggcaagcagctgtacgacgagacccccaccgacgaagtctacgacgaaaagcacgaaaagtagctagatatacgagccccctctgcttatgcaagctccctctgataagggagctgtcgaatgaagtgagactgaggaagagactgcgacgcagtcgctaaaacattgaatcggacgcaggccgatacctattattcagcggctacgccgcaacttctctccctcagtcagctacgctgacagctccctcatcagagggagctaatgtttactgtcattgactgatcacatcagcgacttgtaaatcgcgaggatgtcctcttcggttgcctgacgcgggttgccgggggtgcacacgtcgttgaaggcatcgtgagccagcggcccaaggtcggcctcggtggcgcccacttcggaaatcgtggtcgggttcttcagatccacggtcagcttgtggacggcctgcacggcctcttcgcgcaccttctccaggtcgccggtgtaggcgtcctcaacaccgaacgcatcggcgatgtcgcggtacttctcaccggtgaagtccttgttgtattccatgaccggggccagcagaataccgttggccacaccgtgggccacgcccagacggccgcccagcgggtgagccatgccgtgcaccagaccgaggcccacgttggagtaggccataccggtgatgtaggacgcgtaggccatctgctcgccggccggaatgtcgccgtcggcggacttggccaggttcttggcaatcatgcggatggtctgcatggacaggcagtcggacaggctccaggcacccggggtaatgtaaccctcgatggcgtgggtcagggcgtcaagtccggtggcgaccttcaggccgcgcggcatcgagtcggtcagatccgggtccacgaaagcgacgatcgggatgtcgtgcgggtcgacagccacgaacttgcgcttgttggccgtgtcggtgaccacgtagttgatggtcgtctccgaggcggtgccggcggtggtcggcacgccgaagatcgggacggacgggttcttggtatccgcgacgccttccagagaaagcacgtcggcgaactccgggttggcggtgatgatgccgatgcccttgcaggtgtcttgcggggagccaccgcccaggccgatcaggaagtccgcaccggactcggcgaacttggcgacgccgtccttgatgcactcgaccggcgggttcggcttgacgttggagaacacctcgtacggcaggccggcctcatccagaaccttggtgaccttctcggcggtgccggtctccagcagcaccgggtcggtgacgataaatgccttggtgaagccgtgctgcttggcgacggccggaatctccttgatcgcgccacgtccgaagtatgcagtctggttgaaaatcatgcggtacaccataggggctctccttttgagctagtgtcttaactggtggtccactctgtctttgagtggtccaacggttccccagtctactccgcgcatgagcattcacctgaaaacacgctgaaagaacaacactgaaaataatggcaagaaatggcggaattccgcacttgtcgaattattgtccattgaccaaaccagttccatcgcccgaaatctcaacgataagaccattttccggagtcatctgacgctctccgagaaactcgtctctcatccgcttacttcgcgcgtagcgcaatcaatatgcgagatgcctaattccattcgtgcttcatcagccgaacgcgaactggttcaccagatggtgtattcaacggtttcagtctcctgaagaggactaagatacctcgacagttggggtgatcatcataagagaatgaggtagataatggcaaatggcaaggctatgacggtcggcgagatggcgtccctgtttctcgaccccgccactcccgttcgtatcgacgctttcgacggctcgcatttcggcccggcagacgcggatttgaaggtcaaaatcgccacgccgaactgcatgtaccagctactcgcgcacccgaatgaaatcggcatcgtgcgctcatacattctgggcgatttcgacgtggacggcattgactacgccgacccgtatccggcgatgcgcaagctggtgtcgctgtccaaatacgttcgcccactcactcccacatcaattgcccgcgtatctgccggcatcctgagccatggcttcaagaagccgccggtgcccgccaccgagggcccgagcaagttcgcccgtatcaagcgtggcctgatgccgcacaccgaaaaggccgattcggaaaccgtcagcttccactacgacatgtccaacgagttctacgccgacttccttggatcctccatgacctacacttgcgcggtattcgacaacgaacacatgagccttgaagacgcacaggccaacaaactgcgcctgattctcgacaaactggacttgcagcccggccagcgcttactggacatcggctgcggctggggttcgatggtcatcaccgccgcccgtcgcggcatcaaggcgctcggcgtcaccctttccaaggaacaggccgcgtacgccaacgaatggatcgcccgtgaagggctgcaggatctggccgaagtgcgtgtgcaggactaccgcgaggtgcctgagcacgacttcgacggtatctgctcgatcggcatgatggagcacgtaggcgtcaagaactaccagagctacttcgaagagatgttccgccttctgaagccgatgggccgactgctgaaccaccagatcaccatcagccatgacaagcctcacggcaagcccggtaccgacgaattcctcgaccgttacatcttcccggacggtgatctcggcgcgcccggcttcatcgaatcgtgcatccatgacgccggcttcaacgtggtgcatcaggagaacctgcgccagcactacgcgctcaccctgcatcactggaaccagaacctctccgagcattgggacgacgcggtcaagcaggtcggctttgaacgcgccaaggtatggggtatgtacatggccgcctgcgctctgaacttcgagctcgacggcatccagattcaccagttcttggccgtcaagccggatcgcgtggcccacccggacggcaagtggtaccccctgcgccaatggtggcaggcctgattcctttttgtgggacggcacgcggtttttaccattgttcatctgccgtcccacacgattctcttcgcacgcgcatttcgcgggtgctttttctgcaatactgactctatgagcgccacagccccgaactacaaccacactgtcaccgcctgcttcgtgggatacatcactcaggcggtaatcaataacttcatgccgttgctgttcgtcacgttcgcggcgacactcggcatcgacatggcgcggctttccgccctcatcaccgtcaacttcgtcacccaactggtcgtggacgtgctggccggcaagttcgtggaccgcatcggatacaagccgtgcattatcgccgcccacctggccgcccttgccggactgctggcgttgggcttgctccccacccgcgtgccggacccgtatctcgcgattctggcggcgattttcctctacgcgctcggcggcggactcatcgaggtcatggtctcccccatcgtcgaggcctgcccgagcgaacacaaggccaaggcgatgagcctgctgcactccttctactgctggggccagctcggcaccgtggccatctccacgctgtttctgtttgcgttcggcaccggctcatggccggttctcgcttgcttgtgggcgattgtgcctgccatcggcatcgcgatgttcgctggcgctcccatgccgcgcattgtgccggaaggcacggcgaccatgcggttcgccgacttgtcgaagaagccggtgttctacctgatgttccttatgatgctgtgcgcgggcgcggccgaacagggcatgagccagtgggccagcgcgttcgccgagtccggtctgggcgtgaccaaggtgattggcgacttggcgggacctgccgcattcgccctgatgatgggcctgtcccgcacgatttacggagtgctggggcatcgactggatctcacggcattcattgccagcagttccgtactgtgcgtggccatgtatctgaccgcagccctaaccacggcaccggtactgggtctgcttgcctgtgcgctcaccggtttttcagtgggtattatgtggcccggaacgttctcgatggctgcagacgccatgcccggtggcggtacgctgatgttcgcgctactagccgtggccggcgacctcggatgcgccggcggccctgccgtagtgggactggtggcctctgccaatggcgacagtcttaagaccgggttgctgttcggatcgatgttcgcattggtgctgttggcgtgcgtagttgcggcgaggaagacagttgttggcgaacgcgagcctttgcattgaccggccagcccgccattttggcctataacccccgccggagtaggtacgcgacggatatgcaaaagccccgcacaaggcggggcttcattatggtggctccgaacggcgtcgatccgttgacctagcgattttcagtcgctcgctctaccaactgagctacagagccatgaacagtcaaaaacccggataatccgggcttcataaccattccagcgaccccggccggacttgaaccggtgacctccgccgtgacagggcggcgctctaaccaactgagctacggggccattgttctcacttgcgtgaggcaacagatgtatatattactgaaattcgccagtcatgcaaacttcggcgtgttccgcataatttcaaggtttttgctatcaccagcacgcgaacacgtctgtcacaaacatccacaaaacgacgaagggcgcgaccggaaccccggccacgcccttatggacggaaacgcttcgcggcatccaccgcaaagtgaccgtcaatctcagtcagcctgcttccaggtgtcgacgtcgatgtggtgttcggggttggcctgccaggcatcccacgcggacttgacgatgtcttccacgtcgtacttggcatgccagcccatctcctcgttgatgcgcttcggggagccgatcaggtgcggcgggtcgccggcgcggcgggccatgacagcctcggtgaacggcagaccggtgaccttcttgacttcgtcgacgatctggcgcacggaggtgccttcgccggtgccgacgttgaaggcgtcgtacttgcgctcgtcacggtcgaggtacttgagggcggcgatgtgggcgtcggccaagtcggagacgtggatgtagtcgcgcacgcaggtgccgtccggagtcgggtagtcgtcgccgaagatggcgggagccttgccctgcttgaggcgattgaacagcatcgggatgaggttcaggatggccggatcctcaagctccaccggaccgcagccggccacgttgaagtagcgcagcgcgcagaagcggatgccgaacggctgctcgcaggcgcgtgccatccactcgccgaacagcttggtctggccgtaggggttgatcggcagcatcgggacgacatcctcaggcaccacatcgaccggcggcacaccataggtggcggcggaagaggagaagacgagcttcttggcgttcttggactgggtcatgccggtgagcacgttgagcatgccgttgatgttctgctggtagtaccacagcggcttctccacggattcgccgacctgcttgcgagcggcaaagtggatcacggagtcgacgccttcggcatcgaggatttcggccaaacgctcaccggcgcccggggcggcgatatccatgccgtacaggcgggagccttcgatgcgagtgggcttgccgtagctcagatcgtcgacgacaacgaccttttcgccggcctgatggagtgcgtgaacgacatgagcgccgatgtagccgcagccgccggtgacgagaactgtcatagttgacctttccttgtgcgggttgcaagtgtcggccgtggggagttcagcggctgttcacttttggtccgctttgttaccttttgaaacaatttgagtatatcacacgaacataatcgcacaaaacggtggtgtcgtccggcaatatctgcattcattaggtcgatttggcgttcattaggtaggtcggcccggagccggcccgcacggacaccgggtaaacggcttgatatggtggttggtatcgcacaccacctacctaatgaacgccaaatcgacctaatgaatgaacagcggtgcggcgcacaaggaaaatccgaggaatatatgaccaatcccgaatccacagcaatcgatcccgtcgccgcgatgggcacagaccacaccgaggcaccggcgcaccccctgcacaaggtgctctccttcgtacgccgctccggacgtttggacgatcgcctgcagcgcgcatgggacaactatgccggcacatatctgttggatattgcggccggcaacctgctggacgtgcgcgaaggcgtcacgctcgaccgcgcgttcgtggagtccgcatggggcaacgataatccgctcattgtggaaatcggcaccgggcagggagaaaacgtggtggcagcagccgcagcccacccggagacgaacttccttgctctagaggtctatgaccccggcgtggcccacacgctgctgctcgccggcaagcaggggctgaccaacattcgcgtggcccaggtcaatgcgcccgagctgttcaaggtgaccgcggccggcaccgtggccgaggtatggaccttcttccccgacccttggcccaagaagaagcaccacaagcgccgcatcgtgcagaaggccatggccggcgacattcatcgcgcgctggtcacagacggcgtctggcgtatcgccaccgacatcgaggactatgccctgcacgtgcacgaggtgatggacggcctcgatggctggaagaacctgggcagcgtaaccgtcagcctgccgctggagcacgtgggcaagggcaatgccgacatggccgccgatatgccgcacgccgacttcaccgaatccgagcgattcgagggccgcgtgctcaccaacttcgagaagaagggcctggccgccggccgcgtgattcatgacttcacctatcaggccgttaccctgaactgattgcgacacgccgaaatgccgtcgatttgcataaccgaacaacctcccgtaaagtaattcgagttgttcgcccccatcgtctaacggttaggacaccagactttcaatctgacaacgagagttcgactctctctgggggtacgcaagtaaaatcaagggctccgaggacttccccggggcccttgattttattgcgtgtgactactgtgtgactaaaagtacgtcttttttgtctgatgacaggcactcgcaagctactttgaattgtttttactcaggtgtgacgcttgtttatcgtgcctcggtttcgttgacgctgatgacgttgatgttatccttggtgccgtccacaaggcaagtgatggcggtgtggcgaccatccacggtcacgttgtaggcggcaaggtactgggcatcgtcaatcccaacctgtcccttctgcttgccaaggagcggactgctttcataggcggagccgggaaagagttgttcgcgggccgcgttgtcgcatgctaccacggcgtctccgtatccgattcctccgctggttgtttccccgtcgtcgggggtctcgtcgctgcctgttggttcctgttgtggttcagccggctgctgctgcgcatccgtggctgtattggcgttctgcgtttggccggctccggtgtccgtgccattgcccgctccagtcgcgccgccaatggcggcaatcaccagcacgacaatgacccagaaccaccagcgcttccagaacggcttcgctgtcgtctcgacattccgatttgtcttgggcatgttgcttcccttcccgtgtcgttgtctctttcggtctgcttggccttagtggttcttcttgacttggttgtttaccgcgaccatgaacttctgcgcgtccttgatggacttgcgatccacctcggcaccccacatgaactctggcccctcgacggtcaggaacttggtgccgccgctcttcttcttcgccgcgagcgcgaacgcgcccaagagcgccacacgggtcgctgtgacacgcgactgcaattcctcgccagcctccagccgggccgttactgccgccagaggctgttcatcgccgtccttgtcgatggtgtgctcgtacagcgtgaatttctgtttgtcggcctcgaacgacgcgacctttttgccgcgcgcttcggcggccgccttcttctcggcctttgcggcgtcggcgttggctttggcctccgccacggcttcgagcgcctgttgtccagcgtccttggcgagctgcgttgcctgcgctttgagattgtcgaatagtcccatcgtcggtcccttctgtgtgttcttggtaaggctttactgattatgccttaccggtaagtccatagtttagtgtgcggggttctagcttgacaaccatgccacacaccccgctgcccgatggatgggcgtcgtatgccaaggaactcgggctgaacgtccaacgccgcaggctggcgctgggcatgagtcaggaacatgtggcgtacaacgccaacctgtcacggttcgcctaccagcaattagagcgaggcgagtcgcgtcccggcacgccgtcgaaccccagtctgttgaacgtgatggccgtggctcaggtactcggcatcaccatggatgaccttctgcctgaaccatggcctgacctgcatacgcggtagcgctcgcggctacgatcggctggtgtcggaatgattgctgggattatcgtcaaacggtcgaatgatgatcgtcggtggcatcagtcccgcctcattgatgtcggcgcttacgcgaggcttgccctcagctctgtccagcaattccctgagcgcagacaactgtcgtggattattcgcatccttcgcctgtctgatcagttggagggttatctgctcggcctgagtaagcgtagctgaatcggataattctttatccagttccgcatcggtcatatccaaaaaacgctgcgcggctttcgacaccgaatggcgattgcccgggaaagtcgctcttcgctcgggattcgtatgaaagcccgtcttggggtggttgccttcggtgaacctgccaagttcgtcacgtccgtcattgttgctgttcatcattattcatgtcctttcctccgcttgactgcaagcggtttgtgtgagcctccagtaggtcgtgttgctcggccatgctgtcgcacgctgcggccactagatagtagaagtcatttttcaggctgcgtatggctcgcgcattgccgtgtagtcctcttgcgtccaattcgcgtgcctgtgcttccagtgcgtcccgttccggctgtatcagaccgcagtagttcagcgcgtcataggcttcgagcatgtacaaatcagccatcagcaattgctcttgatacatgcgtgcgtctacgccttcatctggtgacagtgatagtggattgcacatgtccttcctttcgcttgttcatacccggtctgcgagcgccggcaccttgaacatggttgtggcgctcgctgggttggtggttatttgctttgtgctgtcctagttgtcctagtgtcctaatcgttgatattccagtgttctcggcgtcctagctgtttgtcctagctgttggtggttgtcctagtggaacgtgctaggacgtgtggctaggacgccgtgaatggcggaataacgccaattaggacgctaggacactaggactggcggttggtcgcatcgcgaccatgtagctgatctggaatcgctgttgcccgcagagtctagcttgccttcgtcgcgtagttcctccaatatgcgatagacatagcctcctttgcggtcagtacttcgcgcggcgttgctgattctccaaccgactatgcctttcctgtccgggtcatgtttgtctagatagttcagcacggtgtttttcacgcgttccgcttttcgtttgtcggcttcggcccttgcgtcatcatctaaggcgattgcttcggctttcagtgtgcgcttgatctcctccgcctgttggatggcttcggcacggaattgggcggacttttcgcagacataatcggctaacgtccagtcccgctcccttaccttcaacgggtcattgggatgatcgagcattgccagcaaggcggcgaccttggttttcaagccaagccggtgcgcgtcaagcgggtcagacaccttgccgtgcaaggtatccgcccgaacacgccttgcttccgcgtaagcaatttggggatattccattaccgtcagcggatagcttgtttcgccgtgatccatcatgtcgtaccggctgccggcttgatagagcgtgtccaaggcgctcaccatcatatccgccggtagtgctgctacatcgaacgggaatatgctgccgaaaggcgcttgcgggggttcctcgggagcctccgagtcggttacgggcgcgaataggaaccgttggggcaagcctgtgcccgactcgtccagaatcatgcccaagttcgagggctgcacgccagtgatgagggaaagccgatacccgtaccggggcacggtataccggttggcctcgttcttggtgaaacagcccaagtcttcgcctgaccacgcgctagtgagcatcggtatcagtatggaaccttgacgcttgctgttacctcccagcactgctatctccgggatgtctagcaaggcgcggcagttggcacacaccactacttgaacctgcctgtcgccttcgtcctgttttttccgcgtcgtgaacatggccggtatgccttcgcctgaagcgggctgggcggtcatggccttgcggatatcgggcaccaagctacgggccacgccagtggtcaatcccttgcccatgccgctggggcccagtatgccgacgaatacgttcaacgaaccatactcgctgctgaccagcgagggtgtgaccacgtgtggcggcatcgcgaccgatatgcgcgccagcactacgaacagtgtggcccaaggcgcaacctgcttggccctcgcgtaatcgaacacataccgcaatgacggggtgctatcccagaattgacgttcgtccatcattaggccacctccccaagcattacttgtaggaaagcaagcgcacgcatgatgtcgttacggcacgcgcgggtcatgcccgagtaaccgtgctgcttggcgaagtcatccaacctctcgcgggtttgcagccgttggatttcctctctggcggcttctttggcggctggggaaccggggtagctgttcatcgttctgtcaacgcttgccccggagttgaccatgtaatcagggtggataccatcaggcctgtcggctataatgggaaccgttgttcgagccgctggaatgtttgtaacgttctggcggttcatttttgatcaccgacctcagcagtggcaagcgcggtgtaaatgtcttcgggaacgacgcctgcgagcgccgccacgtccttgattcgaaacctgattggccggttatccctgacacggttgggctttcgccgtcctaatttgactctggggagttcgccagaaacaatccaccgtttaacggtgctttcactgacatgggcgacgaaagcgacttcttgaagcgttaaaagagctgcgtgcttatgtaaaaaaggcatgccaaatccttcccgcaagcgcacgatacttgcttcaggattcggttcgaacgttcacgtcgttgacgtgagctcccacgcgctgtgaacagtctagcaggggtcatctactgtcatcaagtttcaccgatgattactctgatgggcaaattcccaaaggtcgcatacccgtactttgcctgtgtatggaatgatttcctgcgaatccgcgatggtgctatcgagcataaacaccgaaaaccgaacaccattcagcatgatttcgcgtgattttcccactggttcaatccctatgtcatcatggagcatttcttctcgctttacgcgcgagattgcattgacttgatcgagtagcttaaccgcccattcatcttccgcaaagggatacaactcgacgactatacgccactgtttctgtaattttcctcgatatttaatcggcttcgccggctgcttccactgcattgtttctttatcgaaaagatatcggaatgcttcattttcacggtggtgaagcacggtttcatcttcgtcacgttcaagtctatgacgtatatcctgcgcctgtcggcgagtgctcgctgcatctttttttcgcccgagctgttcgaaataattggccaagcgctctaggcggcagatgctcttttgctcttcgtctgttagtttgcgaatcatgccgttgcctttcttggaaatacgattaacgaggaactgtcatcaagccggggcagccggttcgccaactccgctgttagcccatgctcttgttccagatacgagagtgaggcagcaggcgtgccatgtcccaacgcggcctgaagctctttaatgccgacaccactcttagcaaggttcgtgccgaagaagtgacgcaaatcatgccaatgtatcggtgcgtctatacctgcgtcggccattgccttgtgcagcacgcgcccccacgttgccgtgcttacgtatttggcaccacgactagtgacgaacacgcgacagttcgggaactggctgacgttcctgcgtaaatgcgtctcgacatcgggggttatccattccggcaatgtgacgaaacgcacgccgtctacggacttcgggggtttcacgatccactcgccgtcaagccattgtgcctgtttcgtcacatgaatgacaacacgtccgttacgtacctcgatgtcctgccgttccaaggcggataattcaccggccctaaggcccccgaatgcagctatcagcaccgctacgcgccactgtccctccaaatggtcgaggatacgcttcaactcgccagtggtcggcgcacggtgttctttgcctgttttggagcgtgtgagttcccccggcacggggtttttctccagaacgtcatcgttcacggcggtctgcaaaatcgctttcaatacgcgtgcttcgttgcccgccgtggtcgccccggcatccttgcaacgcttagcgtgccatttacgaatcaacggagcatcaatgaccgtaagcgaatacgggtcgaagtaactcaaaccatgttccagcattcttagaatttccgccttcgtccgaggtgccagaggtttgcccttgcttgtgcggtgctgttcgatccaagtgtgggcatactctttgaaatttgtggccttgatagctgcgggcggcttcaaggtaccggccctacgctccgcttcgagttccgcgcggtagcgttccgcctccatcttgtcgtcaaaagcagatgtggcgtaccggtggccgttcaaataatacttcacacgccacttaccggatttcagcatttcgagtgtaccgaacgtttccgtccgcttcttacgctcacgggtaacaccattgatggtgtattcgaccgtcggggttttacgccgtgccatctatacctccagtttttagtcccacgattagtcccacatgtgactactgtgtgactacttgctggtattacctgaccttttatgaactattctaacatgacctaaagccaataaacagtaagcttgagaagctataaagcagcttaaaatcaagaatggcggaatatcaacgaaaaaggcttattgccagtctttcaatctgacaacgagagttcgactctctctgggggtacttcactaaagaccccggtcatagcgaccgaggtcttttcgtattcgcgggaccaggtctgaaagcattcggcccgcttgatatgtgctcatggtttcatctcagcacgtgttcgcgcccgccacaaggactatcccaccgtagacgatgtgacatcctccacactgtgacttcgcgcacagggtcccgacgccaccctcaccccgtttatcgacaccatgcgtgtataaccgcatatggcatcatcggcgaacatcggccggcagaccagttgtacaaggagaacatcatccacatggcagacaccgccaacaccaacaccaacgcctggctgccggcgctcaaagcggcgtttccgctgaccataccgatttgcctggggttcctgtttctcggcgcctcgtatggcattctcatgggcaccaaaggcttctccttcgtatggccgatgtgtatgagcgcgttcatcttcgccggttcaatggaattcgtcacggtgaatctgctgctctccgcgttcaacccgctcgccggctttctgctggccctgatggtcaacgcccgtcacctgttttatggactatccatgctcggcaaattcaaagggctcggctggaagcgcccatacctgattttcggtatgtgcgacgagacttttgccatcaactccaccgcgaaaatccccgccggcatcgaccgtggctggttctacttctgggttacgctgtgcaatcagctgtattgggtgaccggcgccacactgggcgggctgatcggcgcgcatctgccgttcaataccgacggtcttgatttcgtactgaccgcgctgtttctggtgatcttcctcgatcagtggctcgacggcaagcatcgcgagcgactgtccgccgtcatcggtgtgctgacatcactggcctgcctgctgatattcggggccaatgatttcatgattccctcaatgatcgccatgctgatactgttcgtcgcgctacgcccgcatctggacgtgttgcggccggccgccgacgccccggaagccacggcagaccatgccatgagccacgcagcggaccagcagaaggaaggacagacgcgatgacgatgaccatctggcaaggcgcaatcactatcgtgacggtggtgctgggcacgatgtgcacccgttttctgccgtttctggtgtttcccgagtccaagcagccgccgcgcatcatcgagtatttcggccaggtcctgccctatgcgatgaccggtctactggtggtatacgcactgcgcaacaccccgattctgaccggttcacacggccttccggaactcatcgcctgcaccgtcatcgtgctgctgcacgtatggaaacgcaatatgctgctttcaatcgccggcggcacaattgtatatatgttgctggtgcaactggtgttctgaggcacccgactcgttagtctctccctccgcttcgctatgctcagcacctcccttacagagggaggtaatcttctgtaccttcctctgacgagggaggcggcaccgcgaagcggtgacggaggtagagacccgcagtcgtaagactgcgaaacacacagcatcggccacaggccgattcctacagctgcttcgccacccaatcgacgatgtacggggcgacttcctcaatctggtcgatggcgacctcgaactcgtgcttgccgccgtaccacgggtccaccagatcgatctgatcttcgcggccgggcttcggcttgggcagattcgggtcgaagctgcggtacatgtgcacttcggcgcgcttgccggccggcagcatgcgcagcagggcgcgcatgtgggaggcggtcatcggcaggaacaggtcggtacggtcgatttcctcacgcgagatgcggtgtgcgaagtggtcacgcggaatctcatcaccatagccacgttcgcgtagcacgcgcacggcacgcgggtcgatcgggtggctccactcctcgtcggacacaccgctggattccacgttcacctggtcgccaagaccgcgctcattaaagaagtgacgcagaatgatctcacccataggcgaacggcagatattgccggtgcagacggtcattacggtgtagggttgggtattgctcatagctttgaatcaatcctcaatcgggcttcaccgggccgcacacggcccgactgtattgttggggtcgaatgaatatgaatccggctcatgccgctataaagggcataagccggattcgcatgcttacttggttttggccaagatacggaaacgataggaatcgatgccggactcctccttggcgggcgtatgccactcgcccacttcggcttcccgccacatcccggcctcgaccagcgacgccatatcgggcgcgtagctgtcggcatccacggtggcggccagatcagtcacataggctttgtccgcgaacggcaaagccttggcgaacaactgggcgccgccgatgatccaaatctccgaacggtccagaccgtcgtccggaatcgcctcctgacgggccatatcgagcgcgtcgtcaagactggtgaccacagtggcccccggcgcacggtacatcggatcgtgggaaacgacgatgttgtcgcggttgggcagcggccggtacttgccccccagcgattcccaggtcttacgacccataatcaccggatgggagacggtcagctccttgaaatgcttcatatcctcggcacagtgccaaggcatgccaccattgaggccgatggcaccggcgcgaccttccttgtcacgggcttcggcccagataagattcaccgagaaggtcttgggataatcgtcaccccagtcttcttcagtggcagacagcccggcagatccgggctcgggttcgtgatagccgctacggctactgtcatgctccatttcgcttactcctcctggattgcggaactgggccttagtgtagtggacagcgaagactcgggggccgtcaccttcacagtattcgctgtccacgaaacggtaatcagcatcagaccgcaacaggtgccttaatagtggggtgatgctggtagccgacgaccttgaagtcctcatactggtagtcgaacagggaatcggccttacggatctcgatggtcgggtacgggtagggcttgcggcccagctgctcaaggaactggtcgacgtggttgtcgtaaacatggcagtcgccgccggtccagacgaattcgcccggcttgagcccggcctgctgcgccatcatcatggtgagcagcgagtaggaggcgatattgaacggcacgccgaggaacatgtcgcaggaacgctggtacagctggcagcttagcttgtcgtcggccacgtagaactggaagagcgcgtggcagggcggcaacgccatcttctccacctcggccggattccacgcggagacgatcatgcggcgcgaatccggatgatgcttgatgaggtcgagcacattggagatctggtcgatggtgcgattcgggtcctcgggggtcggcgcgggccaggaacgccactgcacgccatagaccgggcccagatcgccgttctcgtccgcccactcatcccaaatatgcacgttgtgctccagcagccagttgatgttggaggaacccttcaaaaaccacagcagctcataggccaggcctttgaagaacacggtcttggtggtcagcaacgggaagtacttcgacaggtcaaagcgcatctgctggccgaacagggaaatcgtgccggtgccggtgcgatcggacttcagcgtgccttcggtcaggatcttgcgcaccaggtcctcatagggcatcggaatgtccgtttcgggacgtgcggggatacgggagcgaatatctgcgagttgttcttcggtcaaagccatgtgcaccagtgtagcttaggggcataatagagaagtccactgatgcgggagagcggccaggtgccgcgctcccccgctggcatggcgatgggccagatcgccggcggctgaaaataaaggagcagctatgggtaagcgactgtgggttgagcgtaacaaggacggttcgtgggatgcgttcagcgacgatggcgcacacattaagttcggcaaggatcgtggccagttcacgccgggcgatctgatgaaggtcgcgctggccggttgcgccgcgctgtccagccagttcgccatcgaacatacgctgggtgagggcaagggtgccaagattgtggtggatggcacgtacgacccggaaaatgacgcctacaccggtttcgaggagcaggtggtgattgatgcttccgacgccggtctgtccgaggaggatgccgacaagctcaaggagcgcgtcacccgccatatcgacaagggttgcacggtcaagcacacctacgtgcaggagaccccggtgcgcatgaacgtcaccgtcaagcactgagacgggatataaattgaagaggctccctggcgggagcctctttccgtatattcggactttactggcgatcgggatcgatggtcttttcgatctgctgggcgacttcaggctcggctgcggacaccggaatctcctcgacgccggcaatctcctccagcgacttggtaggcacttcggcgggcgagctcggcacggtgtcgagacgcgattccgcggcctcaacatacttgcgtggcaccacgtacaccgggccgaccgcatgctgcagcaggccctggctggtggagcccagcagcaagccagtgaagccgccgcgaccacgggagccgacaacaaccacatcgtgatcgtagctggccttggtcagggcgctcacggccgggccggaaacgatctgcttgttgatcttcagatcaggatgcgattcctgcaacggcttgatgcgcacctcaagatcgtccttgtaggactccatgacggcgtcctcgccgtccacacccttcaggttcggcacagcggaaatcacgtccagttccgcaccccagcacgtggcgaagtcggcggcaatgtccagcgccttcagaccccacttggattcgtcggagccgacggccaccttggtgatcgtgttgttcaggtgcatcaggttaccgtcatcatcggtgtacggcaccaccacaatcgggcagtaagcatatgccggcagcgatgaggacgtagtgcccagcaggcgctcggccagaccgcccttgccacggttgccaatgacgatcagattgtagttacgagacaattcgacgaacaccgatgccggatctccggtaacaatcagtgtggcggcttcgacgccctgctcgtctgcgatggccttggccttggacagaatctcctgagcatcggaatgcgcggcgttatcgtcccccatcgccgtgtaagtggcatcgaacgaaacggcggcatagctcggcagggaatatgcgcagacaatctgcagcgtcagccccgcgtgctttgcataattcgcggcccaccatgttgccttgtaactggcatgcgacccgtcaacgccgacgagaatagccttgtcgttaatcatgacgacctccttgaagttattgcggcacgaataccgcgtatctcaacaataccccgcgacactcggtttggccggtatcctccgctcaaaaagaaatccgcgtatacgaaaaaaggcacaccccaaaggacgtgccttaatacgaattcgcttaccgcataattcttgtcacatcacgcggcgaatggaatatccagctccaccgaatacggaaacgtcgcttactgccgttccctgcaccgggttcatagcattcatcacctgtccgttaccgatgtaaatggccgcatgagtaccattcgcaagaatgtcacccggcttggcatccgccaagcttgcgaccggagtacccacggtggcttgagcaccagaggtacgaggcagggagatgccaaactgggagaagacgtactgcacaaaaccggagcaatcccatcctgccggagtgttgccgccggcaacatacggatagccttggaacttcagtgagaagctagcaagctcagcgccagtgccagtgccagtcattttacccaagtcaacctgtggaatcgacgcacgctgttcagagcggctggctgccgcagcagcagcggactgggctgcagcagcttcatcagcggctttctgagccgccgccgctgcagcagcttccttctcgccctgagactcggtctgtggcacatcaagagtctcgatgccaccccatttagagttctcatcaaccgaggtggaggtggattcggcgaacaaattcttcttcaccgaactcgccttcgggaaagaacgtgaggacaccacagcactcgtctgcgcggaatcggcagaggcaaacggggctacgcacgcaaacatggcacccgtggcgataatcgccactgatgtggaaataatagtcttaacgctcatcatcaacgccatacactagcacacatgggtcgatttcataacaggaatagcatttcgaagatgatgtcgcgggtgcatcattcggcaggagaacgcaacaggcctcggataccgatcggcatccgaggcctgcaataaatcaatcaataagactgcatcacgggatacgcaccacgatggtgagcttttcggtcatggcactagcgagagccacgctatagccattccatccaccatggaccgcctgaccgttgccgacatacaacgccacatgatcgtagtgtgcaccaccgttccatccaccggtgttggcataaatcagaatatcgcccggctgcagggatccgtctgtgactacgtggccaccaggaacattgacgtactcttcaggccaaccgtggaagttaatgccacgggccgccaacgcttgactgaccaatgcggtgcagtccatgctctgtccgatcaaagaatacgcacggtcgatagaggcaccggcaccagcggaaaccgaaccactggcatcggaataagtaacagaagagcgagactcattacggctcgcggcgttggcctgctcctgggtcgcctgagcctcgacctccgcctgcttctcggcctcctcttcggcagccttcttggccgctgcggcatccttttccgcctgagattccgtctgcggcacatcgaggttctcaatgccgccccaatcagcattgtcctcaacgctcgtggcagtggcttcagtcgtcagatctttgcgcacctgggtgtacgaggggaaggacttggtggaagtcacagtaacaccctcagctgcagttgctgtaggaacaaacataaacaagcaggcacaggagacaatcgcggcaacaatggaagaagctacagttttggtcttcatagaaccatcaccctacacggtgcgcattaactcgtacaggatggaagaaataaaacaccccggagctattgggatatatcggcgtgtcggcacaggtcagttcggactaatacgcggccgcaacacttgaaatgtcatttcgcgcgaacgattgccgatagggcgacgtcacatccgaacagtaatcaccgaatgtaagccaatgaaatgaatcagtagtgaacgtactggaacttaccggcttcggcggcgctgaacgtacgggtcgaaatcacacccaatcccttggcattggattcggagatctcaatggagccgtcggcattgatcttttccagaacggcaacatggccgtacgcgccatcggcatcggcctggccaggagcgaacaccacagcatcaccgacatggcgaggagtgttgtccacccaatagcccagagcggaagctgacgccgcccacgcgccaccattgccgaagttgccgctggaaggcaggcccagttcggcacgacgctggtacgcgtaccacgtgcactgaccccacggatagttgttggagttggtgccaacggcatggttcgggttgaagccagccggcacagcatcgccatcggcatccacgagagccgacaccacaggattgttcgcattattgcgattcatcagcttggcgtccaaggtgctgtctgaattgctcagcccccagccgccttcattggtggactgtgcggtaacggaggatgaactcaaatcagtacgcgcttcggaacgagaagccgcagtcacatcgctgatgcgcttaatctgcgtggtcgtcgtggccggatcagccacgaacgagttcgtggcgtcttcattgttggaaaacgcgagagcacctgcggccgtgccgaccagagcggccagtgaggccgaggcaagaatatggctacggcgttcagcggcacgagcggcctcacgaatggaacggcgggtctggggagcgatttcgttgatcttctcggcaatggccggatcaagccccaaaacaacggcgtcgctaccagcggattgcaccgcacgcacagcacgaacggaatgagaacccttgccggaggcaaacaatgccttcgctaagctgaacttctggcgcgagaccgtggtcgctttatgcgaagcatgcttcatactacgttaactccttggatgggttcggcggggtcatttcgatgacctcgtatgaccgtcacaattgagtactgtacaacgaacagaggtcaatcctcaatgtgatcccccaccatccgggtgtgtcaaacgatttacgtaaccgtgcggccgggtgaaaaaactgccttgtttccgcccgttcacgaacctcactatccggttatcggaagaatcactaactcatgtcattccgacacaccgtaaccatgatgtgctgcgtacattctgcactgcattccgcattgccaccactgccgcccggcaccccggaattccgcagtaaccccgcagtaatcccgcacaccgagcattatccgcgatattccccaacactggtctacccttgaaaccatgactatcacactgagtattcccgagtcgctgaagcccgaagatggtcgcttcggctccggccccagcaaaatccgccccgaacagatcgccgcgctcgacgccggcgccaccaccctgcttggcacatcacatcgccaggcaccagtcaagcaactggtcgcttcgattcgtgaaggtctgcgcgagttcttccacctgcctgaagggtatgaggtggcgcttggcaacggtggcgccagcgcgttctgggagattgcctgcgcttcgctgatcacccgtcgcgccgcattcggcacgtatggctcgttcagtgccaagttcgccgcgtccgccgcgaacgcacccttccttgaagacccggtgctgttccccggcgagccgggcacttaccgtctgcctgagctcaccgagggcgtggacacatattgctgggctcacaacgagacctccactggtgtggccgccccgattcgccgcgtggccggaagtcgtgaagctggtgccttgaccgtcatcgacggcaccagcgcagccggcgctttgcctgtggacatcagccagaccgacgtctactacttctcaccgcagaaggccttcggtgccgatggcggtctgtgggtcgccatcctctcccccgaagctatcgatcgtgcggcaggcgtcgaatcaagcgctcatctggaaggcgcacatcgctgggtgccgccgttcctctcgctgaccacggcactgaacaactcccgcaaggatcagaccctgaatacgcccgccgtggccaccctgatcatgatggaaaaccagattcgctggctcaacaacaacggcggcctcgcctgggccaccacacgttgcgccaagtccgcatccatcctgtactcgtgggccgagcgctccgaatacgccgctccgttcgtcgtcgatgcggacgcacgctcgaacgccgtggtcaccattgatctggacgagcgagtccaggcctctcaggtactgtccatcctgcgcgagaacggcattgtggacgccgccggctaccgcaagctgggccgcaaccagctgcgcgttggcgtgttcccctcggtggaaccggctgatgtcatggacttcaccaagtgcgtcgactacgtggtcgagcacctgtgatggcatatatgccccgcattgccgaccatatatgccatgcacattgatcggtctcaactgatgccgattgaataaatcgtagggagggatgtttgacgcccctccctactcttactacagtgcatgagtatgaagttcgcgcctctcattgaccctgccgtccgcaaacccgcacccaagcccgtacgggtggatctgcgtaaggtgtttgccatcggtaccggtctatggattgtggcgttgattgtcgtgctgattctgctggccgtgggctacagcgtaatgccgttggtgattatgtgcgtggccggcgtcattattggcttgctactgctggtctgggaatacttcgaccgctgggactaccgccgcctcggacagtaacgcaacacaagctccctctgatgacgggagctgtcagcgtagctgattgagggagagaccgcggccgcaggtcgctcatcaaacagcattggtggcatgcaaggcatgccaccaattccttacctcactgcgccaacggcaacgtaaggctgaacgtactgccttgcccgggcgcgctccatacggtcacatcgccatgatgggtcagcgccacatgcttgacgatggccaagcctaggcccacgccatccgccgtgcgattgctctgttccacgccccggtagaaccgctcgaagatgcgcgcctggtccttcttagcgatgcccgtgccttggtcaatcacgcgaatcaccgcgcggtcgccatccttgtctttggatgcggacacgctgaccacgccattttccttggaatagccgatggcgttttcgatgagcttggtcacggcgctgtcgatctggtccgcctcaccattgatgactagatcatcgtcgcccttgatgttcagctgcacgccagcctcggctgcctgcggctccagtcgcgccgccgtggccctgagctgttccataacgttcagtcggttggcggaagacggcgtaatcggctcctgcgcgcgtatgagcagcagcaaatcagacaccatgtggttgagcttgctgcagctggaacgcacctggcgagcgtcggcagccacctgctgttcgtccagattgccggactccagcgaatcggcgagtttggccagagcctcagtggggcccaacaattgctcggacacattggtaataaacgagtcacgcacttgagcgaaacgaatcacatcactgacatcggtaatcaacacgatgacgaactgctcgttgatacgccctacagtcaccttcagccagttggggcggtggacggactgcgtggcgacgtgatcgcccttgttctggtctgcgacgtaccgctccggagtatcggtggtcaagtcgaactggcgcttgccaccggacttgcgcgcctcgtgaatggcatccagcacatgctgctgggcaatggcgtcatctgacaccacacccaggcggtaggcggcgggattgcagcggaccacctcgtcgtgctcgtcgaccaccacggacgcacctggcagcatggacagcagcgtggcggtgtcgtcggacagatcgtcattgtcgtcatcatcggccagcggcgattccatggacactcgatgtgtcgcaaatcccacgatgagcgtgatgattcctaccacaaataaaacagccgtgacaataagagcaatcgcggcgacgagcggcatctgtgtcatgcccccattctttcacaccacacgccgggattgcggtttgccggcacgccggtaacatgaatttcaggtgaacaacccaatgaacagtagaacaacttgaggttgccattacctacgttgaagtggggaacaagtactggaataatacactggtacaggttgcaataagcaagcatgaaaggctagagaaatgcgcgttattttcaacgaggagctgaagcaggttgctgacgacctcgaccgtatggcgcagaacgtacgcaaggcgatcaaaggagctggggaagccctgctgaatcaggacgttgaagccgcacagactgtgattgacggcgacatcgaaatcgatgccctggagtcctctgtgattgaccagtgcgtcaagttgctcgccaagcagaatccggtggccaccgatctgcgtgtggtcgtttccaccatgcgtctggcttccacgttcgagcgtatgggcgatcttgcccgccacgtggccgaggccgctcgccgcacctatccggccgccgcgattcctgaatccgctcaaccggtgttcgccgagatgatcgacttcctggacaacaccgctgaccagctggtggccatgctcttcgatcgcgatgccaagaccgccgaggccatcatcctggctgacgacaagctggacaatctgcaccaccagaccttcgatctagcgctgtccgatgacatcacccgtcagcagaccgtggatatcgtgctgctgggccgcttcctggagcgtctcggcgatcacgccgtgtccgccgcccgccgtgtggtgtacatcgtctccggcttcgaccccactaaggagccgacccgcgacgagggcaccgacatcgactgattgggacttgttctcacattgggcgaataactgaacacttgttctcctgtggtttgaggaggatgcccgaaagcggcgatccggctacggctggacgccgttttttgttgcttttgggcggtacaccggcgtatccatggggcggcaaaacacccatagggcggtaacttgcccatggggcggtttgaaggatatgtgaaaccgcggaattaagccattctggcataccgccccatgagggttttaccgccccatggggtaatcaccgccccatgggggatttggcaggcatagcaaaggggagccgcacgttatgtgcgactccccttacagcttgtaccgtgttagcggcttaggctcacttctggccctgagcggcgacagcggcggcaccggcagcagcagcctccgggtccaggtactcgccacgcggcttgatcggcttgaagttctcgtccagctcgtagagcagcgggatggcggtcgggatgttgaccttggcgatctcttcctcagacaggttgtccagcatcttgacgatggcgcggagggagttgccgtgggcagcaatcagcacggtcttgccggccttgagctccggctcgatagcggactcgaagtacggcttcacacgctcaacaacgttggccaggcactcggcttccggaaccggatcgccggcgtagcgcgggtcgttgttctgggcgtactggtcgttcgggtcgatctcgggcggcggggtggcgtaagaacggcgccacagcatgaacttctcgtcgccgtactcttcgcggatctcggtcttgttcttgccctgcagagcgccgtagtgacgctcgttgagacgccagtcacgctgaaccggaatccacagacgatctgcggcatccagagcgatgttggcggtgttgatggcgcgacgcagcagggaggtgaacacgatgtccggaaggacgttcttctccttgagcagctcgccgccacgcttggcttcggcttcaccctgctcggtcagcggtacgtcgacccagccggtgaactggttagttttattccatgcgctctgtccatgacggagcagtactagtttataagtcatacggttcagtctacagccgcgtgcgcccaaacacgagtattcgtcttattatttcgctctcagagcgtcacggaaaccgccagcaccaccgcaaacagcaaggtctggaagctggcggcgggcagagccgggcggaattgacgtttattcacgctggagaccatgcgcacaggtattccgacgcccgagatcaacagcactgcgccccacggccaccatagggtcgcgcacatgagcagggctatggcccacgcggccacgcagcacacaatcagcagcgtacgcgcgccggattcacccagccgtacggccagcgtgcacttaccatgctcacgatcctcgtcgatgtcacggatattgttcaccatcatgatcaggcaggagaacaggccagccgccacagcacccaatagtccgccgacgtccaccgtgccgcacagcgcgtattcggtgcccaataccgcagccaagccgaagaacaggaacacgccgacttctcccagcccgacgtatccatacggatgcttgccaccggtgtagaaccagccggccagcaaggaggccacacccacggcaaacagccaccaagcttgggaaatcacgatagcggcaatgccgcatatgcaggcgatggcggcgcaaatcatcgccgcgaacagtacatgcttggccggtaccagtccggatgcggtcagtcgctggggtttgcctgatttcgattcgtccgtgtcacgcccggcgtcagtgccgcggatgccatcggaatagtcgttcgcatagttgacggcgatttgcaggaacagcgcgactagcaggcacaggatggtcaccggccagaatcggtccatcagcagggtctgctgttcacgggccgtggcgcaggaggccggttcgggatatattgcgatgcaggtgcccgactgctcgatatgcgcgtatgccatcgtcgccccaaccatcaccgacgcgatggaagtggccaaggtcttgggacgcgcgccccgaacccacaagccgatggacataagcaatccctttcatatataactcggctcccctctctgaggggagccagagtatgcctaatcagccaacgagcggcttgaccagcgggaaggtgatggtctcgcgaatcgtggcaccggtcaaggcgataagcagtcgatcaatacccatacccataccgccggccggaggcatgcccacgccgagagcctcgaggaagtcctcatcgatgtcgcaagcctcttcgtcgccagcgagcgcgtccttggcctgagccacgaaacgttcacgctgcacgatcgggtcgttgagctcggagtagccggtagccagctcgaagccgcgcacgtagagatcccacttctccaccacgccgggcttggtgcggtggcccttgaccagcggggaggtttcgaccgggaagtcacgcacgaaggtgggctcgtaaagcttgtcctcgtagaagtgctcccacaggtgttcgacgagcttgccgtggttctccacgtcgtcgcgctctacgccgagcttgtcggcgatggcgcccaggtgctcaacggaggtgccgggggcgtccgggccgccattcggcacgatctcctcgcccaacgattcggacagggagtcgtacatgctgatggtcttccattcgccgccgaagtcgtattcggtgccgtcgagcagggtgaccttgtgcgagccgtagacgtccatggcggtcttctgcacgagctccttgaccagctggccgatggaatcataggtgccataggcctggtaggcctcgaccatggtgaattcgggggcgtgcgtggcgtcgacgccctcattgcggaagtcacggttgatttcgaacacgcgatcgatgccgccgaccaggcagcgcttgaggaacagttccggggcgatgcgaaggtacaggtcaaggtcgaaggcgttcatgtgcgtggtgaacgggcgggcggccgcgccaccgtgcagggtctgcagcatcggggtttcgacctcgaggaagtcgtggtcgtcaaaggtgcggcgcagggaggccacggccttggagcggttgcgcaccatgttgcggatgttctcgtccgcgatcatgccgatgtacggcttgcgggtgcgggtgtcttcgttcaggtccttgtgcagggccggcagcggctgcagggccttagaggcgatagcccactcagtggcgaatacggacagctcgccggtcttggaggcgatgacgcggcccttgaggtacaagtgatcgccaaggtcgacgagctgcttgaactgcttgagcgaatcggcgccaatctccttcttggagatcatgccctgaatcttggtgccgtcaccggcggacagctgcacgaagcacaggccgcccgcgttgcgcaggaacagcacgcggccagcaatgccgaccatgtcttcggtctcttcgccagcctcgagcttgccgtcatacttggcgcggaccgcctcgatggtgtcggtgacgtccaagtgcaccgggtagggggcgatgccggcctcaagcatcatcgcgcgcttggccacgcgcatctgcacctgctcggggtgggccagcgggccgaactccttgttggaggggtccacggcttcgtccagcgtggcaccggacttgatcttctcgcggatggtggcgtcctgcttgagcagcatttccgcacgttcgacggtgctcatctgcgggacggccggggtttcattctcagtgttttcggtattttcgacaacttcagccatgattcatcagtgtacgcaaggccggcgattatgagcccggcagaccgcacggccatccgaacacccgctcacatgacgcaaaaccggccctgcacaaggcttgagagacctgtacacatggcgaatccaccatcacgcaacactcgcgacatgccgatttgcattgtccaccaccacaatgtaatatctacatctgttgccaaacgggctgtagcgcagcttggtagcgcgcttcgttcgggacgaagaggccgcgggttcaaatcccgccagcccgacaactggaccggattgttgagaaatcagcaatccggtttttcgtttcctgtcccaacaatcaaaccaagcgatcgaacagcggtaaacaacccgccgcacacagcgacaaaccacatcacggcaagcccccgtatttgttggcggaccaccgtaatatatcgctcgaatcaatcgattgccgcactgtttttgtaagtaatactgaagtaattagaggaaccatgaagaagagtctgcttgcactggcttcgggcgcgttcattctcggtgccgccgagttcgtgatgatgggcattctgccgcaggccgcggccgccaccggcgtggacatccccaccgcaggccattacatttccgcgtatgcgatcggcgtgtgcttcggcacactgattctggtattcggccgcaaggtgccgccgaaggacctcatcatattgtttatggtgattgccttggtgggcaatctggcttccgcattctccgtcaatgccgccatgctggtcgccgcacgattcgtcgccggcctgccgcacggcgcattcttcggcacagccacactcatcgccaagactctggcggaggaaggcaaggaggcgcaggccgtatccgtgatggtcaccggacagaccgtggccaatatgctcggcgtaccggcgggcaccttgatggccgagttcctttcctggcgtcttgccttcggcattttggccgcttgggcggcaatgacgattgtgctggcgtcggcgtggattccgtacgttgcaccgatcaaggacgcaggcatcgccggtcagttcaagttcctcacccgccgtggcccgtgggtgattttggccgccgtgttcaccggcaatgccggtgtgttctgctggtggagctacgtctccccttggctgcagaaaaccggcggatggtcgtcttccctggtgccgatgctgatgatgcttgccggctttggtatggtcatcggcggtctgcttggaggtcgtctgaccgaccattggaggcatgccggcgcggccgcaataggtcagtccatctcctgcctcggcttgttgctggtgcttatcactccgggtaatcagccgatgaccgctgtactgacgttctggatcgccatcggattgttctttacttccgctccacagcaattgctgatgaccgaagccggccagggcggcggcgagctgatcgccggcgcggctgtacaggtggcgtttaacttcggcaatgccatcggctcgattgtcggcggcgcgatgctcaccaccttctcgatgaactatcgctataccggcctgggcggtatgccgctggctctgcttgccgtagggctgctggccttctactcgtggcgctgcgaaaccgataccgacgccattcaccgcttgcgcgaaaccaaggtggactgagaccaagctcacagcaaactccctgacgtgtttgttcacagtattaatagactgaaatcagacacgattcagggaggtctggcggtatggatgaggaagcactgctcaaacaattcgccgcgcaattcgcgcatggtccagacgatgccgacgacaccgatgcggcggccgcagcacaaggtgccgattccacggcgaaccaggttgcggacgatgccgatcaatcgcccgcaacctttgatacccaacaattcctgaacggactggacgcgattttcgatcgccacacggccgccaccgaagccggcccgtacttggaacaggcgatggtggacgcggaaaacgccggcgacgaggccggactgctcaccgtgctcaacgaaacgatgggcttctatcgctcgcaaggtcggcacaaggagaatcagtggattgtgcagcgagcgctggaactggccgctcgtatgggcttgaccaccggcacatccgaggcgtgggccaccacgctaatcaattgcgccacctcgatgcgcgcggccaaacaatacgatcaggccgaggatttgtatcatcaggcgcagagtgtctgccggcattcgctggcgcccaccgaccgtaggctcgcagcactgcacaacaatctgtcgatgctctacagcgagacgaatcggcccgacaaggcggaactggagttgcgtgaagcgctgcgcattatcgaagcctcgagcgtgaacccggacgcggatatcgacgtgtccagctcgcacacgaatctggcgttgaccctgctgaccgaacacaagttggaggacgcgcattggcatgcagccaaggcgctggaaatctatcgcaccggccatctggaacattccgcgcattatgcctccgcactggcgggcttcgcgcaggtgtgctttgccgagagacggtatgcggatgcggttactggataccggcatgcgctggccgtgatcgaggaatgttacggcaaggacaccgattactggcgtatcaccgccgacaatctgcggcaggccgaggaagcggcgacgcaggccggggtgacggttgacaatgcaggtgttgccggcgatgcaggcgcgctgccccagtccggctcgcggctgccgaacagcccggcacagggcaagaccggtgcgaacgcggcatcttccccatccaccgtttcggtgtcgaccggttctgcgggcgcggccgaggccgtttccgcatgcccggtgtccggactgaagctggcccgcgcgttctggacgcagatgggcaagccgatgattgcggcgaagtatccgcagtatgccgggcgtatcgccgccggtctggtgggtcatggctcggaatgctacggattcgatgatgcgtattcgcaggaccacgatttcggcccgcgcttctgcctgtggcttacggatgaggattacgcggcgatcggcgagcaacttgaggtcgattacgaggcactgccgcgcaagttcagcgtggatgcgcaaggccgcgtgacgttcgaggcgcatgccaggtccgatgcttccggagcattcccctccgcaggtgcaggctccaccgtcatacccgatgcggcaaacgcacccacccccggcaccgctacgcacgataccgccactgccgagtcaggcgcggcgtcctctgatgtggcggaagcgatgacgactccgattgatgcaccgctctcccccgtcacgccgcgcgcacagggcgcgaatcgccgtgacggcgtgttccgcatcggtgacttctttgagtcgatcaccgggtatcacactgcgccggcgcagaccgcgccgcatgagtggctaatgcttcaggaatcgaccttggccgccgccaccaatggcgaggtgttcgccgatcccaccggtctgttttccaagacgcgccaagggttcaagaacatgcccgacgatgtgcggctcgcgctgatctccaagcgactcggcatgatcgcccaggccggtcaatataatctgccgcgttcgttgaagcgcggcgacggcgcggccgcatggctgtccatccacgagttcgtgcaggccaccgcctcgttggtgttcctggttaacgtgccgatggtggtgggctatatgccgtattacaagtggcagttcgcagcattgcgcaagctgtctggctcgatgttcgcgctgttgccgaacgtgggcgaacagttggaaaccgtgatgcgattgagttcggcagcctgctatggcggggccggatttggcgaaggcggcaagggcgcggctccagcaatcgagaaaatcaacgatattgtggagcagattgcggtggatatcgtcaaggaactcaaacgcgaacacctgaccacgtccggcgagaccttcctcgaatggcagcgcccgtatgtcgaggaccacatcgcctctgatgatccggtgcttaaaagtttgtagattcaagctccctctgccacggcttcgccgtgccacctccctcatcagagggaggtatcagtgaaaggaacgtcgatgaccaacgaactgactgatgatgaactgcgcgaggctattgtgcgtcatgaatgggatcagttccagcgcaccaacaatgagggtggacgcgcggcatgccaaggcaactggccggtgttccaccagatgcggttggcccagttcctcacatgggagcggccattactcaccagctatgccgctgatcttgacgcggccgaccacgtgggccgcaacctcgtaaccgaaaaatacggccgcatgatggcctccaccgcaccggaaaatttcacgaagaacatagagccgtatattccgcgtctctctgaagagcgcgcggcccgtcaggaacaggtcatcgcccagcaggtcgcctgggccaaggatttccgcgagcgctaccccaagctcggcgaggcgatgcgcgcactcaccaccaccgaagacacaccatctgccacctcattcgaaacctatctgcgcggcgagcttggtacgtattccgaccagaccttcgaacgttacgaagcgatgattggcgagcgcgccgcagccagcccgcaacgcaatatcactgaggaaaccttgttgcacacagtccagctcggcggtttcgacaccttagaggaggccgaagcctcccaagcgtaatactcagccattcactgtgtatcggacaccccgactgatgtacgtcggccggccatacccaggccaacgcaatctgccgatcgccccacacccagaccaccaacgcagcctgcccgccaggccccatttaccagcgcacatcggcagaattacagcgagaataggccccaaaatgccagtgtcatcagtgtggcgagagtgccgagcgctaccatcacgcatatgacgcgccgcacaccgacgatatcggcgcggcaataccagacacgttccatttcccaagcaaacagcaccaccaacagcatggtcgctattcgcagcaccacccatccgacggcaaacagccgcggttgaggcataaccaatacagccgatacgcctacggcgctcatatagccgtacaacagcccagtaatcaccatcaccgctgtgccgataccggcagataagccggcaatgccgtgcaacatgcgccgctgggcggcccccagctcactcggcgtcgcatgcacggcccgcacagtcgccacactacgtcgcccggccagcaacgtctgtagccaagaaaacacagtcaagccaatacctaatatcgccgccatcacgatcagcacgggccctgccaccatcagaccggccagcacgccaagcgagccgacgataccggatctggtacgttgcgacgcggcgaagcgctggtgaggtgttgcaccggcgacttgaggcgttgcccatccatcggctttggttccggcagtcacaccgttcacccaattttccagcgcttgcgtatagccttcggccaatggcaggttcggggtgaataagccctcaccagcccgcatctgatggttgccggcaaaatagcgtacggtgacgttctcgttgccggacttgttggccgtagcgatgatccgctgcgccccctgttcgatgggcatggccgtatcgtaggtgccgtagttcaccagcaccggcatggtgagggatttcagataccggtcggcatcaaagtcggcataggctagatcaaatggcgcgtagtccagcgacatcaatttggccatgtctttgaccacgggcttgggcgcgccggcctcatgcgtataggcgctgacagccatggccatttgctcacgtccattgaacaccggtgcggatgtaagtacggcaaaggcaatgtcttgccgtttcgaggttagaatcgtggcgatccaggtgccttcggattcggcgtagatgccggttttggcggggtccacgccgattctgccacgcaacacgtcgagcgaacgcccgtattcgcgagcaaaacgcgggtagtcgcgatgcagcacggtgtagttgtcgttgcgcttggccggcaccaaggtcacgataccggcagaggccatggcgttggcgatatcgccgaaatcctcggcaccactggtaccggacccgtgaatgaacagacaagccgggcgtggcccgggagcgccgaccggttcacgtagtacggcgggtagcgtgacgccgtcgccggtcttgatggatagtcgggtttcacgcgtacgatatcgcccctcgtggggaatgttcgcatgggcaggggtgatggtggtgtcggcagaagcgataacgatgtgcttggtgtagggccgtgtgttccattgcggcatcatcgcccagccaagtgtggcgaataccagcgtcatcgccatcgcggtgacgatgacgctcgctacccgccgcaccgaaatccgcttcatagttactatgcctccccccccatcagcatagaacggtcggctcttatcggtcggctcccgtcataatgtgcttctactgggaccgtaatgcaatggtttgtaacgctattttctcttcttgacggcaccgactatggcccatacaacggccactattaccagaatcagtcccactacggcgcaaataatagccgtcagcaattgcggattcggcgagaacaacgaaatcatccgatccggagatatgtacccgaaaaccagcgcgatcacgccgataatcacgcctaatagtccgaataccacagtaggcgcgctggtgctctgtttctggatgttcttggcactcttgacatccttagcattctggacgttcttggcgctctggacgttcttggcgctccccccaggctggcatggtttgccggcggtctgagactgcccatagggaggtcgtgctgaagatgctgcgtacatcggcacatcatcggcagatggaatcggcccaccatctccctccacggcatcggcaactgtttccagggcaatccgatctgtggttggttcgatgggcgatggagaggcagctgttgcctgcgtatccacatccgagaccgacgcatccgcatgattgtcggggacgggcagcacagccgtttcgtcatcatccgctgcggatggcagcaccgtggtatcggttcggtcatcgacggtcaccatggttgtggtcgcggtggtcgcgtcggtttcggaaggtatggccgtggtcggtgtcgcatcctcgatggaggcgaattccttggtttcatcagtcatgattccatctcctagttgcaacggcttgatcattccgattgttcggttgtgttcttgcttgtactgttgccgtcgtatatatcggcaagcggctggaacgtagagccttcccaatcggaggcgtacaccacgttgacacgtgcttccaccacatagggaatattgatttttaattctgggccgttgtccggcatggcggattccttatacaaccattcgtgatcaggcccattggtggcactttcagcttcgaagaaaacaaagcttggacccatgtagttgttgtataccatctcgtatttgccgccaacgtcactcgaagtggagtagtaggagtcggcggtgccgaaggcgtaagtgcaggaatccggcagaacgatatgcacttgcgcctgtgttgcggctatggtgatggtaccgaccgggcaattactgatggaagttttgccatccagcatcttcaccgtgtgcggtccatgtgtcttgtcccaatcggaccaatcaatgattgcctgatcggtgttgtagttttcaccgctgaacgccacaccttgctgcaatgtttcaaacgtggcatcgctggcatcggcaacgaagatgccatccttttgcacatcgttcatgccgtcgctgtttctcgcactgacagattggctcagtgaaacaacagtattgatgccgctggcaccaagatcacggtagtacacgccatacgtgcctgaaatgatggtcatgcagagcgcgcatccaccggcaaccagtccgagaggaatcagaccaccggtacgccgtcctctgaatccgagaatgatgaccaccagccccatcactatgcatactgcggcaatccagatggtgcccagacgcataatgccgataatgcccatgtcgtttacccaaatcagtcccatcagaccggcaaaggagaggaaggtaaggcccagtatgctcaagaccacgattgggcccgccggcttgcggcgcttggactcggtgggggcataggccgtcgcattcatacggtcgggggcaaacggcccgttgggtactgtgccgggcatcgcgccgggcacagtacccggcatcacgctgggcatcgactgatagacaggctgtgaaacaggctgtgaaacactaggcgcggtttgtgaaacaggttgtgaaacaggttgtggaaaaggttgcggagctgaatacaaaggagattgaggtactggttgcgcggctggatatgagacaggctgtggagctggatatgacacaggctgtgaaaccggtcgcggcgcagatgccccgaatccgtacccttcctgctggcgaatgccgcttttggccaacagccatagcgctaaggcggcgagcgcaatacaaccccaccccgcacctggaatcacgattgccacggcgaggaacaggaagcatcccagacaattccagtcccattggccggcaatgaggtcctcggccaagatgtgcccatcgcgtacatccggcatcagaaaccagccgagtgcgtacagagctgcgccaaaaccgaagaacaatgtacatacaatcaccaacgcacgtactaatgtggggctccagccaagccgtaaagcgatgccgctgcatacgccgccgatccaccggtcgtcgccgcgaaccagtccactggatcgcacccaagtgaagaagcgtcgcgatgtcttgtttttttgcggaccaggctgcggctgtggctgatatggattcgcgtttggattgctcatgattccattacaccgcccgaccactgccacaacgctcggggaacaccctgattgttccctgaacaccgggtaaaaccccggccgcaacgccctgagcgcggcacaataggagtatgacgtcatctcccgaaccattgctgcccgcgcgcatgccgttgatgcgcccccggcagggccgttggctcaccggcgtgtgcaagggcatcgccctgcacttgggcatcggcgtggcatgggttcggattgcgttcatcgcactgaccgtcctctacggcgcaggcatcatcgcttatgtattcctgtgggtgttcatgcctgccggagacccggtggcggctgcggctcgcacagtgcccgttaatcaggcgccgcttgcgcgaggcaatcagccacttgccgctcatgacgacgaatcggctgccgcaccggaatcattgtccgaggccatccaacgtgctccgaaaccggccgtcgtggcattggccggtttcgcgttgatggccactggactgttgctcaccagcaccggtgcggatgtccagattgtgtttccgctgctggtagggttgggcggcatcgcactggcatggatgaatcttagtccgcgaggcacgcagctgttgtctatgttgggcggcatcgcactgattttcatgggatgggcattgtatgtgcataatgtcagcattcctgggtggggcacctctcctcgacgcattgttgccagcggattcgtgatgatcgtcggtatcgtggtggcggtgatgccgtgggcgaacgcgatgctgcaacgactcacccacgagcaggcattgaaggagcgcgaagaggagcgcgcggacatgaccgcccatctgcatgatggcgtgctgcaaacgttggcgctgattcagctgaactccgaggaaccgaccaccgtattcgccctggcgcgtagccaagagcgcgagctgcgcgaatggctgtatcaggaacgttccacatcggatcgttcggtgggagccggattgaagcagatcgccgccgaggtggaggacgagcacggcaagccgattgaggtggtcaccgtgggcgacgcgcggccgagcgcccagaccgatgcgctgctggacgccacccgtcaggcgttggtcaatgcggtcacgcatggcggcgagccggtgtctttgtattgcgaggccagcgacacgatggttgaagtgttcgtgcgcgaccatggcgaaggcttcgatatggacgccattccgcccgaccggctgggcatccgcgaatcgattatcggccgcatcaaacggcgcggcggtacagtggagatagtgtccagggccggctggggcaccgaggtcagaatgcatatgccgatcgcgctgaaagcggcgcagggagaacatcgatgagcgagaacgagacagccaagattcgtgtggccatggtcgatgaccatgagatgttccgtgcgggcgtaatcgccacgttgcgcgattccttcgatatcgtcggccaagcggcggacgtgcccggttcggtggcgatgatcgcacagaccaagccgcaggtggtgttgctggatgtgcatgtgcccggcggcgagggtggcggcggtgccgagatcctcgccaaatcgcggccctactcccccactaccgtgtttctggcattgtcggtttcggatgcgccgcaggatgtggggtcggtgattcgcgccggcgcccagggctatgtaaccaagacgattaccggcgctgatttgatttcatccatcaagcaggtgcatgagggctatgccgtgttctcgccaaaactggccggttttgtactttcgaccttccagggtgtgccggcggcggggtctgatggcggcgctgatggtgcggcacgggctcatgatgaggagctggaccggctgtccgcccgcgagcaggaggtcatgcggctgatcgcgcgtggttacacgtataaagaggtggcggccgaactgttcatttcgatcaagacggtcgaaacgcacgtgagctcggtgttgcgaaagcttcagctttcgaatcgcaccgagctcacccgctgggccgccgataggcgcattgtgtgataaacgacagatgagctccctcatcagagggagctcatctgctcatatcactccgcgtcgcggaaaccgttggggttcttggtctgccagttgagggaggaggcggccatgtcgtcgatggtcagctcggccttccagccaagctccttctccgccttggaagcgtcggcgtagcaggcggcgatgtcaccggggcgacgcggcttgatcgcgtacggaatcggatgaccggcggccttctcgtaagccttgataacctcaagcacggagtagccgtggccagtacccaggttgtagacgaacacgccttccttgtcgatgtggtcaatgacggccacgtggcccttggccaggtcgaccacgtggatgtagtcacgcacaccagtgccgtcgggcgtgtcgtagtcgtcgccgtagacctggacttccttgagctcgccgaccgcgaccttggccacgtacggggtgaggttcgccggaatacccttcgggtcttcgcccagcaggccggactcgtgcgcgccgaccgggttgaagtagcgcagcagcacgatggtccaggacggatcggccacatgcacgtcgcgcagaatctgctcctggaacagcttggaggtgccgtacgggttggtggtgccgccggtcggcgtctcctcggtgatcggcagttccttcggcgtgccgtacacggtggcggaggatgagaagatgatcttcttgacgttgtgcttcttcatcaccttgagcagcacaagcgtggagtacaggttgttgtcgtagtattcgatcggcttggccacggactcgcccacggccttgagaccggcgaagtggatgacccagtcgatgttgttttcagcgaagacgcgttccatgagcgcctcatcgcgcacgtcgccgtcataacgcttgaccggcttgccggtgatttgctcgacgcgctcaagcgccacgggcgacgagttgccgtagttatctacggaaataacgtcgtagcccttgttgagcagttcgatgtcggtgtgggtggcgatgaatccagcaccgcccgtaaccagaacagtagtcatattccctcctttggaaggacttgccttcggtttttccttcagtattgagcttacttcacttgacctgtttcacctagcggcaaaaccaaggctttcgaggaatgtttgcgtggtggctttctgcttgaagacggccgtgttgccgaggatgcggtagcagacgctgccgagctcgtcgtgtacggcttggcggatggcctcgcggtcgtggtttccggccaacgtttcagcgagttcgccccattcgagactgaattcgctgacttcatcgggcaaatcgcggccttcggcgagcgcctcttcgacaatgccgagctggtcgacgagccgtccgggcagaatgaacaagccttgggcctcgatcagtccgatcggctcctgcttgaccggccagtattcggggtgtgcatggaaaataccttccgggtactcgtcgctgatcgcattgttgcggaagatgagactcatctcatagccgcgttcggtgatgatcgcgctgggcgagagggcggattggcggttgccatccgcgtcatggctggcgatgccgttcgccgcgtcgtcataaccgacccatgcctcgcggatgatgtcggatacgtcgatgatgctctggcgactcttcgacaccacgcgcacggcggtgccgggccagtcaaggatttcaaccacggcgtccggatagtcggcaagtgtgaaggcggcccaagtggcggccttgtgcatcggcagcagttcgccgccgccctggtaatggtcatgggcgagcaccgagccgccgatgcgaggcagcgcggcgttgcatccgaggaagtatccggggaaacggtccacgaagtcgagcagatggccgaaggtgtcgcggtccacatgcatcggcgtgtggtcggtgttcacgcagatgccgtgctggtcgaagtagccgtagggcgagaactgccagaaccatgactcgccgccgagcgtgaccggcaaggtgcgcagcgtgcgcttgtcacgtccggcgaagccctcgttctcatggcagatcgtgcacttcgggtagccgccggccacggcgttgccggccgccgccttcttcatgttcttgaattcgggtttggcgaggttgatggtcaccgtcagcccgtgcgagtcgaagcgcgggttccggtcgagctgggcacgcttgacataattgttggccacacagtagtcgtagaaccattgcatggcggccatgccgccatcccggtgctcgacgagcaggaatcggtcgtcgagatcagcggggttggcggagaggatgcccatgatggtgtcggcgtaggccgggccttcctccggcttgaaaaggccggcggttgtggcggcggcgcggaaggcggcgagcagggggtcgggggtcttttcgccatagggggcctggcttcggctgccaacaatgtcttggactacgtctgacactgacgccgccgacgttgtggttttgggtccggggtaggaatctaggcggaagagggcgaagatttggttgcgggtccagtctgcgttgcgtgggtcaaggtcaagatgggccaaggcataatcgatcagggcgtcgatgctggcgtatacctcggtcagctgatcgttcattgctctgcctccatcatgctggttcgggtatggttcggctgacggctcacctggcagcctccatgatgtcggctacgatggcgcgggtttcgctggccttctgctccatctcctgcacgagtttgatctgggtgcgggtgcgcaccagattatgctcggggtacttggtggcaaagtagatatcgccttccaagtagtcggcgagaaagcgcatgccgcattccatggtgagcaggttgccgctgaacggcagcagttcggcctcgcgcgcggtgatgctgccgcgtagttcgcccacgaagccttccgtgtaggcgcggaacagctcggtgctgaaatgcaccttgctgaggtccttttcgtcttccagagcagtggacgcaccaaagcgtatggaatcgccgaagtcgaacagcatggagccgggcatgatggtgtcgagatcgatgatcgcacgcgccttgccggtggtggcgtccatgaggatgttgttgagcttggtgtcattgtgggtcacgcgcagcggaatcgaaccgtccctgagcccatccatcacgacggcatactggtcggcgtgactcagatagaagtcgatttccggctggcatgcggcggcgcggccgagcttgtccgcggcgagggcggccttgaagtcctcgaaacgatgcggggtgtcgtggaagtgggcgatggtttcggtcagctggctggcgtcgaattcggacaggaagttctggaagtcgccgaatgcgctgccggcttcgcggaacacgtccgggttcggcacgaggttgtaggacacggtgtgttcgatgaacttgtagacgcgccatgcgccgccatcgatctcggcccaggtggcgcctgaggtggtgggcacaatgtccagcgtctctttgccctgagccttgagagtggaggtgaccagttcgacattgcgcatcagattcaccgtatcggggaagatgctggtgttcatctgctggaggatgtagcgggggccgtccgtggtcaccagataggtggtgttgatgtggccgtctccgtaaggttcgataccggtcacggcaccttccagcgcaaaatgcgaggcgatgccgaataaaacttcattgctttcagtcatgatgggtccgttctccaaaacgtgggatcaggcttcacgccaggcgataccgctgtcaggcaggtcgaagtcctcggtggtgccgtcggccaaagtcaccgtggtcttctgcggctgatcggtgttgttgattacgcaatacagcccttgctcggggaagtgtgccacttcgcattccggattggacgagctccaggccgcatacttgtcttcgttgtgggaagcgtagaacagcacgcgttccagcagtcgggcgttggccgccgaatagggcaggccggagatgtacacgccgcggcccttgccataatcgttggtcgcgagctgtacctggccgccgtccgcgcgcagcagggtcacgttttcattgaccggatacgtgttgagcacgggttcgccgaaatcgatgccgcccaacggcttgatggactggccgccgccgcagccgctcagcgggatgcggtagccggcctgctcccaagcctcgcgggccgccgggtcgaccggcacatcggcggtgatgaagtggtccggcaccaccggcgggaaatacttgtccaccgaaagggtctgatagcgctcctcgtccacgccaatcacgtcggccagctggaagaaccggcccgtttggaagcgcggtgccgagctcggctcgcccacgcccacgaacgcgccgccgccacgcacccaggcgcgcacggtttccacgagcttcgggttggtccacacatcgccgccggtgaatgcggtgtcgaccgggccgccgttgatgattacgtcgatatcgctatcgatgccatgcgcgagtacgtcgtcgaagctgatgaaccgcacgttcacgcgcatgccggacagggattccagaatgccgtagtaggagtaggtctgcttgttgggcagggcgtgtgccacggtgaacgccatccaggagcgcatcttgccccaggaattcagaatcgccacgttgagctcaccttcggcggccaccccaccggtgcggtcgtggatgtcgcggaattcgttggcgatatgggtcaccgtgtccacgaacttcgggaacttggcggccagggagaggtagccgccgtagcccatgcggctgatcggcgagcgcaggatcgcgcggcgggccttgcgccagttgtcgaggccttcgatgctcggatcgttgccctcgtagaacgtgtcggggaagaagtacggcaggaagcggccttcggtgtacttgacgcccggaatatcggcgatcatgcgggtggtggtgccgtcgccgatggaaccgaccacggcgtccaggccgagttcgtcgaatccgtccttgtacggttcggtgccgatccactggtcgccgaggaacatcatcgcctctttgccggcggcgtgggacatgtcggcgagctgcttgacgttttcgcgcacgaagccggagaggaagtcgatccagtcgcgctgggcttttctgggcacgcgccatgcggagttgtaggcaccgccgtccacgaagtcctccgggcgcaggcggtagccatacttggcttcgaaatcatccagcgcacgcgggcttacggtgcaggcgcaaccaaaccagtcgacgaccttttcgcggcgcttttcatcgaacaggagcgtgaactggtagaagaacgtggtgaatcgcaccacatcggtctgcgggctgtccttaagccactgctcgaacgtgtcgaacacgaacttgcgggtggccggatggtagatgtcgaacgggatctcgtgttccttgtcgccccagtcgttggtcagatggttgtacatctcgaccgggtcccagatgatgtaggccaggaaactcaccgtgtactcatgccatgcggcaacgccgctcacatgcacggtgtcctcgtccgcgtcaagcgtccagttcgccgaatcaacgacctcgccggtggtgcggtctacaacctcccaatacttgtgagggtcggcatcacgattcggcttcagctgctcagcgaagaagctttccatcagcggaatatcaaccgtatccgattcggcgagaatgcgatcggtcagcagatacacctgtggcgtctcatccatatgcagcgtaatccactcgttatgcgcgcgagtcgggaaatacgcattgtaaatcttcttgcccaaggcaagcacagcctcatccagatgcgtgccatcggagttacgaatggcgtctgctccccacagttcggcaagctccttggtcttctccgcaaaattctcctcgctaggcaaggtgaagcggccggtgctagtcatagtctctcctttgaggacattgattatttttttggataattaaattgtaaacaatatatgcatataaaacaagaatccgacacaaccgtcgggcgtccaggatcctgactgtataaatccttgagagtagccccacggcaacgccggaagagcgaattgaacatcaccggagcttcccggtcagtttcaccgacaatctcatgacaagaatcaggaaggctctggatcggtatggttgcgtgctacttattgttgagaagccgtccggcgccggaaggagtagcacgaggcaccggacggcgggaattattggtcttaggctgtccgcttaacgcgtcgccttcggcccctgcaattaaggactcgcctacggcgagactcaatgctgccttcgctcggctaccgcctcgctcgggccgacgctacagacagcccaccgggctgtccgcttaacgcgtcagcccttgaccgcaccagcggcgaggccggcctgccagtagcgctggagaccgaggaagagcacgatcacaggcagcacaccgagcagagcacccatcatcagagcgccacgatcagtgaaggtagccagagagaccatgccgtacagacccaaggtcaccggcttcaaggtgtcggaagagaccatcatcaacggcagcaggaagttgttccaagtggccacgaacaggaacaggaagatcgtgaccattgccggagccagaatcctcaacacaatggtgaagaagatgcgagcttcgcttgcaccatcgatacgcgccgcctcaagcagctcgttcggcactgaggtctgcgcgtatacgcggcccaggaagaagccgaacggagagacgcagcacgggatgatgatggagagcatcgtgttggtcaggtgcatggcatggaagatggagtactgcggaatggtcagcagagcggccggcatcagcatgcagcccataatcacgccaatggcaaggttcttacccttgaagttgaactttgcggtagcgtatcccgccatcacagccacgagcgtacccaccagagcggaaacacccgagtagatcagggagttcagcacccagcgccagaactggccacgggtccaaccaatcagcgtgccatagttcttggcgatggcggcaggcaaatcgctcagacccacggcgaaccacagaccgttgctgccggtcatctggctcggcgtcttggtcgaggcgatgatggcccagtaaatcgggaacagaaagtagatcagcgcgaagaccagaacaacgatggtgatggtcttgaccagcgcggaaggctgcatggaacgaggcaggtcgttggcatgcttgtcgcgaatcctgtcagccttcttacgagcgcgtgcgaccgcgcgggattccttatcagtagcttctacggtgctcattctgcgttcaccttcctttcaacgagcgtgtagaccacggcgagtacgccagcgatcagtgccataacgatggccacagcggatgcaggtccgtcaccacccggggtcagcgtgccctgcgaggtattgagggccatcatcattggcgtgtacgacttggaaatgctcggatcggaaatcgacatcacctgcggctcgttgaacagctggatggtgccgacgatggagagcagcatggcaagcagggcggctgcacgcacgttcggcagcttgatcttcatggcgatctggaagccactggcgccatcgatgcgtgcggcctcgtacagatcgtgcggaatggcctgcagtgcggcgaggaagatcagcatgttgtagccggtgaaggtccaggtcgtgatgttggccatagagccgaggaccacattgtcgccgaagaagttcaccttgatgccgatggcggcaagtcccttaacgataggggaaatctggccgttgtagaggtacacccagatgatggatgcgaccacgcccggaatggcgtacggcaggaagtagctcagacggaatgcggtgatgtgcttgacgatataggaatcgatgagcattgccagagcaagtgccgcgatgatcatgaccggcacctgaatcacggtgtagagcactaccctgcccacgccagcccagaagttgccggaagtaataacgtattggaagttctgaagtccgacgaacttatcgaccagttccccgccgccgtatgcgccaccgcccgtggtgacctggcggaagaagctggaataaatagcccaaatgatgggaagaataaataccagagcgaacaggatgccaaacggtgccatgaaggcccagccggtacgattctcacgcttcacagcatcagaagcctttggcttatcggcacgcctggcgacccccgtcttcgccgtttttgttgttgcagtcatagggaaacctgtctttcaaaagaacagtgagaaatagaaagtacgtaatgcagttcgaatcgatgcagtcagatcaaacacaattaatgacgaaccgaactcgagtaaaaggaaaggccggagtgttgagctccggcctttcgatgtgtggttgaggatatcagcggctggaaggaaccctaaccgttaatgtcactcggaaacagacaagccgaagttcttcagcgtatccacagaggtggtctgtgcgtcggagaagatgtctgcaaccttgccggagccatcggtggccttggcggcggtttcgttcatcttggcggcgactgcggagaagccaggcatgtaggtgaagtcacccatgttgttgttagcggtcttgaattccttcatgatgtcctgaccaccgaagaaggtggaccactcggaaggagtctcagcgtcttcagtggtagcagccggcacgaggccctgggaaaccagatcaggaacctgggtgttgaaccaatccaggaactccattgcttccttcgggtgcttggagttcttcagcacggccacggcggaaccaccgtcagggccggtcttgccagcgttgccgaaccagtcaccgagctgagcgacctgccattcgccggagccggtgccaccggaggaggtcatgaacagcggggcttcccaagcggcggccacagtaccgatcaacgagccatccttgatggatgcatcgaaggacggatcccaacgcgggttggtggtggctgccttggcgtcgagcagctgctggtagaagtcagcggttgccttggagccatcggtctcggtgttgacgacccaggagttgcccttcaccttgtaccaaccaccggaggcgccagccagaccggagatcatgttgccggcctcatcaggctggtaggacatgatgtacttgccagcggcggcagcggtcttggcagcggcgataaactcatcggcggtctgcggaatctcggtgatgccgagcttctcgaactcagccttgttgtagaagtaaaccagcgggccggtgtcctgcggcaggccgtaagccttgccgccaacctgaaccaggctgtacgggccggatgcgaagtcgttcttgtactgctcggcatactgggtcacatcctgcagcagacccttggtgaagacctcaggcagctcggcgtaaccgacctgagccagatccggagcctcgccggacttgacgtcggtctcaagcttcttgatcatgtcagaggccttaccatcgaacttggtggccttgacctgaatatccggatgctgcttattccacttggcaacgatgtcgttgaccagagtcatgccctcggaatccggcagacggtgcatgtaggtgatgttgaccacgccaccatcatcggtggtcttcgtgtcgccggcagtgtcgctgccgcaaccggccaagcccattcccattgctgctaccgcggcaaaagcagccacgatgcgcttattgcgagataccatatctctactccttcgtagtgaaatcatcatctcagtgtgatgactgattactaatgtatgccctcattcttttattgtcaacttagctaacaattaccgcgcgtcccgttgaggcgagtagcattaaaccggttcgatgctcgattgtgcgagtttgttcatttcattaactccccttacaaagcaacgtacttttggtccaccggtaggcctaatgagatattggatagcggcaacaatccaagacgttagcttgcaatcgtccaccgcaaattgcaagcacttgccaacattatcggttttcaggtcgccggcgcgatacccgaccagggggcaccgcaccttaatgagacgctacacgagcagtctcagcaactggtagagctgccacaggctacgcacgttgaagtgcgtgccgtcaaccgtggcgttcgcctcgccatcgcccatatggacgatcacggtgcgcccgttcacggtcagactaccgtgcatcgtgatatgattcatcttgcaaccttgttgattaaaggcgcaagccggtaatcaacgcaaaggcccgatgctgcaaacgtcgggccttttcttatcggctcacgccgatcggcccgtcatatcaacggggacaccgcatgttacggcatcacaaaccaatatatcagcaccccggcggcaatcaagaagacaggttccagaaaaagaaaaaaagggcctgggcatgttgcccaggcctcggttcgcggacagggcgagattcgaactcgcggagggttgcccctcaacggttttcaagaccgtctctttaggccgctcagacacctgtcctgatgcgcgttcacacgcgcaagtattcattatacagaagggagggatgttgatattcggcagtgcggtcggtcttggattcgcctgctggctatcagcgatctctccctcagtaatctctccctcagtcagctacgctgacagctccctcatcagagggagctaaagcacgatgagactcaggcctcccacttcgtgggctcgataacttccttgccgcccatgtaggcgcgcatggccttcgggatctcgatggagccgtccttctgctggtggttctccatgatggcgaccagccaacgggtggtggccaacgtgccgttcagggtggagaccgggcgggtgccgccgtcttccatacgctcgcggatgttcaggcggcgagcctggtactcggtgcagttcgaggtggaggtgagctcgcggtaacggccctgggtcggcacccaagcctcgcagtcgaacttacgggcggcggaggaaccgaggtcgccggcggcggtatcgatgatgcggtagggcacctcgaccttggcgagcatctcctgttccatggccagcaggtgctcgtgctccttgtaggagtcctcctgcttggcgtaaacgaacatctccaccttgtcgaactggtggacgcggatgatgccggaagtatccttgcctgcggcaccggcctcgcggcggtagcaggaggaccaaccgcagtagcgcagcgggccgttgccgaggtcgaggatctcgttctcgtgcatgccggcgagcgccacttcggaagtgccgaccaggtactggtcatcgggctcgcgcagacggtagatctcgtcggcgtgggagttcaggaagccggtgccgcgcatgacctcggggcgcaccagcgtcggggtgatggccagcgtgaagccgtgctcctcggcctggtccacggccatggtgagcatggcgatctgcatacgggccacctggccacgcaggaagtagaagcgggagccgccgaccttgacgccgcggcgcatgtcgatgccggccacgccggtgccgagggtcaggtggtccttgggctcgaagccttcggccgcgaagtcgcgaatctggccaaccttcttgacgaccacgtagtcgtcctcgccgccttcgggagcttcgggctccacgatgttggagagcttccacatggcggtggtgtattcctcggcggcggaatcggccttggacttgtattcggagaccttctgggacagttccttggtctcggcgatgagcttggccttctcgtccgccggggcggaggcgaccttcttgccgatttccttctgctgggcgcgagcctcttcgaaggccttcagcgcctcacgacgtgcggtgtcggaggagagcacttcgtcgacgagttccacggactcgccgcgcttgcgctgggattccttgacgatatcggtgtgttcacggatgaattgaatatcaagcatgggcaccagactagccgcgtaagcagacaccgacaatggccgaatgcacgggagtcacgcggaaatcacagggaagcccgggaaagtccgcggacgggtccacccggccaatttcgtcagatgagacgcgattgaaccataatcgcgccccacggggctgttgcgtgcaggaaatgttcacgtacggcgcaccatggccgcaaacgacctccccaccgataacaataggagccatgcctcagcctgccctcaccgtgtttctgatcatcgccgcaatcgccattgtggtggtgctcatcgccgtcatcgtcatcgccctgcgcgcgcagcgccgccgcaagctggctcagacgctggagaagcgccgggacgacgaggtgcagtacgccttcatcgtgaatccgtccaaaccgcaggccgaagcccgccggctgcatatccagaggttctgcgaggccaaggggctcaatcgcatccgcttctacgacacccagcttgacaaggacggcagggtctgcgcgcttgaggcgctggaggacggcgccgacgtggtgatcgcggtcggcggcgacggcacggtgcgcacggtggcgagcgccgtctccggcaccggccatgcgctgggcatcatccccatcggcaccggcaacctgtttgcccgcaatatgggcgttcccgtggacgatatcgacgccgcgctgaccgtggccacctcccacggctcccgcctggtggacatgggccgtctcaccctgctcgaccacccggaggacgaccacggccacgccttcctcatcatcgccggcatcggcttcgatgcggccatgatcgacgacaccaaccccgagctcaaggcgaacatcagctggctcgcctacttcgtgggcggcgtgaagaacctgttcgcgccgaagttccgcggcacgctgacagtcaccagcgccgacggctcgacccacaccatcaagaatctcgatttccgcacggtgatggccggcaactgcggccagattcccatgttctcgctgatgccggcggcatcctatgacgatggtctgctggacttcgaaatcatcgacaccaccggcggcatcctcggctgggccaacctgttcggcgacgtggtgcaccagacgatcatcggcaagcccgaacagaacccgctgtccacgaactcgaccatcgaacaggttcagggcgtcagtgccgaaatcacattggaaaagccggccaaagcgcaggtggacggcgacatgctaccggagaccaaacatattcgtttctcagtggatcatcgcgcgctgatcgtgcgcgtacccgacgcctccgcgctggaaaagaccgcacaggccgctgcctcaaacgccacctcggatttcgccgaaatgaccggcacgctcgagccgattcgctgatccgctacgatgcgtggccggtgactcgggcgacgtgcattgccagataggcggtttcgtcgtcgctgatatccgtgtcgaggcgcagttcgagcagggaggcgatggttcgcgcgcatcgtagcgcggcgggataggactcacgaatcaccttcatcaccggtgccggctcatccgtcagttgctggtgctggtggatgcgtacgaacaggtaacgcagatgggtgatgaacctgcccacattcacggaactgcggtccaacgtgatgccgtagctgtggtcgataatgtcaagcagttgctggatcacgcccgtcatcgtatacgtataggacaggtcgccggtggcgaagccggcgttgaccagatgcatggcaagcgcggtggcctcgccgtccggcagcgtgacgtcgagccgcgcattgagcgatgcgagcatcgcacgcccctgcgcgtattcctgcgggtacaggttgctcacctcgccgagcagcgggtaggtaatgtcgatgccgcgccgcacccgctccaccgcattcgccacgtgatccgacaaggccatgaccagcgtggtgctgccggtctcacgctcccccagtccggcttcctgcatggattcgacgaccacgcggatgatttcgggcggaatgtccgccagcatctgcgccagatggtccgggtcccgcccgtccgacggcacgaaggtgcgcacgactttcgactcgtcgaccgtctgccccggcttggcttggaaccccagtccacggccggtgagaatcacctcaccgccgtcgccgcctttggcgagcacgacgttgttgttgaacactcgcagtatttccatggcatcctttcgcaacgtcattgttccacatcgatgatcgggctgccggctgatacggttttgcagtcaccgccgttgttgtcgccgctaccgtcgccgatcaacggcgtgaccacggtcagttcagcggcgttgaccaccgtcaccaccaccacaacgctgtgcccggccgccgcgactttgccgaaatccacggtggccagtggctctcccgccgcgatccgctcgcctttagccacgaccacagcgaatccctcgccatccatatcgacggtgtcaatgccgatatgaaccagcacctcgatgccgccatcggttttaatgccgaaggcatggccggttcgggccacggttttcagcatgccactgaccggtgcgagcacggctgtctcaccggtcgtctccggcacgacgcctacgccctcccccagcgcgcgggaggcgaacaccggatcgccagtcgcttccagattcaccagccggccggcgaccggcgacaagatggcgttggagtcaagagcccgatcggaggcgggccgcgatggagaatcttccgcagactccgcatccgacgatgtcgtgccaatccctctcaccgcatcctgcgagcgtgcgttctcgcccgccgagaccatctgtgcctccgtggcgcgcgacggcgtgcggtacccgaacaacaccgtcaacaccatcgccattacaaacgcaacggcgatggacagcgcgtacacccacatccgatcgaacaccggaatcgtcagcaacgaggagaaggcgaatgccgtagtcgtaacgccccggaccatctggccggatggcagcacggacgggaacagccagccgaacaccgcgctggtcactccgccggccgcgcagccggcgagcagccagcggtagacgcggcggtgatgcagatggatgccgtacaggctcagttccgaaacgccacccagcaatcccgcgagcaacgcccccaccgcggtctgccgcatggccgaatccttgccgcgtacggccagcacgagtacgccggcggtggcaccgaagcaggcgaagttccatacacccatcggaccttggacgaagtcgtagccgagcgtctgaatgttcatcagtatcagggcgttcaacggccagtgcagaccgagcggcacgagaaacgggtagagcatcgggatgatgagcgcgaacaggaatggcacgtgcgcgttaagccatgctgtggccgctcccagcccgctgccgagccatattcccagaggcccgataaccagtatggtgagcgcaaaaacgacgaccagtgagaggaatggcacgaacaccagctgtacgctgtcgggaatgacgcgcttcagcccgcggtagaccacggcgagcacggcggccatgagcaatggtacgaagatgttgccactgtagtcgttgagttgaatcggtatgccgaacgccgacacggtgcaggtttcggtgccgaatgtggcggtggccgagcattgaatctccccggagagagcgctggatacggacgtcccggacattccggacatcacgccagtaagctgcggggtcataagcgcggccataatcgcaccgccgagccaagggtcgacgtccagtttcttggccgcattgtaagcgatcataatcggcagaacggtgaacacaccctcccaaatcgccttgagtagtatccaaccggtggacgtctcgccatcaggcacaatgccgagtgcaacgatcacgttgacgatggcgatgaccagcgaggcaccgagtagcacgcccagaatcgggcggaacgagtcggacaggtagtcgaaaaacgcggcagcccgggcacgggcggcactgccccactcgcggacggtacgaggcgtgaagtgacgggatgtattggatgggccgcaactttgttcggcgtcggtggcagtatcgcgcgatggtgcggcatcgtcggaaaggtacggcgcggactgcgcgggttgcgtgggctgtgtggattgcgctgactgcgcgggctgcgctggctgagtgggctgcattgactgagtgggttgcgttgactgcgacgctgactgcatcactgccgatggcaattgcgctgccggcatcaatcgcgccgtccgcagccgaacgatctgctcgtacaccgaggcgaccgctccgccgatgatgacctgataacgattgccggctcgcgggaatgcaccgaggactccggggatggattcaagaccgtgctggttgacatggccggcatcggccagttcgaagtgcagtcgcgtggcgcaatgggtcaggctggtaatgttcgcggggccgccgacggcatcgacgatgcgcgccgcaatcactgcaggcgttgcgttcgatgcgttcgccacggttcctccttgctgccgtatgccactgtgttccattatcggcgctgggtgccccaaaagcacggcaatgccggcaaagcatcgcgaaacggcaactatgcgctacggtgctccgcgatggtgtcccgccataatgttccgcgatgatgcttcgccacacccgttctccgtatttgccgcagcgcccattccgacatcattccaccatgcagaatcctgcaatcgttgtcaaaaatcatcgttttttgctgcctattcggagtgtcgcgactgcggaagtcgtattctatctttcacacacgttgcgtagcagggttgttactcaaaacgaggcaagacctggagcgacgtggaatttgcgtatcgtaatatgcgaattccacgttgttccaggtctttttttgttttcgggcgacttcagacaatcgaagcctgaccttgcacgcggcagaggggccacgcaacaggcgcggtccgtcaacggcgaaaggacaaggcaatgacgacgacaacggcatcacccgtatcgaaacagacggcatccgcggcgcaggaaaccagcgcaaccggggcggcggccaccgcaatcgaaaccatcgaaaccggcgtggccggagtggcgggcgcggccacaaacgcggcagcaaacgcaatcgaggacctcgaagccgccgaatcacgcgacttctccacgcgcttcccgctcaacagcgcattcatcttcaccttcggcgcgctcggcggcatgctgttcggtttcgacaccggcattatctccggtgcctccccgcttatcgaatcagacttcggcctgagcgtctcccagaccggcttcatcacctcctcggtgctgatcggctcgtgcgcaggtgcgttgtcgatcggcgcgctgtctgaccggttcggccgcaagaagctgctcatcgtctccgcgctgctgttcctgctcggctcaggcctgtgcgcctcctccaccggattcgcgatgatggtgtgcgcccgcatcatcctgggcctcgcggtcggcgcggcttctgccctgaccccggcgtacttggccgaactggcgccgaaggagcgtcgcggctcgctgtccacgctcttccagctcatggtcaccttcggcattctgctggcctacgcctccaacctcggattcctgaaccacaacctcttcggcatccgcgactggcgctggatgctcggttcggcgctggtgccggccgccttgttgctgctcggcggcctgctgctgcccgaatccccgcgttatctggtgaacaagggcgacacctgcaacgccttcaaagtgcttacgctgattcgcaaggacgtggatcagacccaggtgcagattgagctggacgaaatcaaggccgtggccgcacaggacaccaagggtggcgtgcgcgaactgttccgtatcgctcgtccggcgctggtggccgccattggcatcatgctgttccagcagctcgtgggcatcaactcggtgatctacttcctgccgcaggtgttcatcaagggcttcggcttccctgaaggcgacgcgatctgggtgtcggtgggcatcggcgtggtgaacttcgtgagcaccatcgtggccacgcttatcatggatcgtttcccgcgcaagggcgtgctgatcttcggttccatcgtgatgaccgtttcgctcgcagtgctcgccgtgatgaacttcgtgggcgacgtggccgtgctggccgtgccgacgatgattctcatcgctttctatatcctcggctttgcggtctcgtggggcccgatcgcctgggtgcttatcggcgagatcttcccgctgagcgtgcgcggcatcggctcctccttcggctcggcggcgaactggctgggcaacttcatcgtctcccagttcttcctcgtgctgctcgatgcgttcggcaacaatgtgggcggcccgttcgcgattttcggcgtgttttcggccctgtccatcccgttcgtgatgcgcttggtgcccgagaccaacggcaagtcgctggaggaaatcgaggaggaaatgaccaagcgctagacaaccggcacacgattcgcacaaaagttgacaactcttaacataatcgtacccaacgtggcgaaaaaacgtggcagaatagggagcatggtagcaaacaatgcgggtcagcccgccaccccagcagatctgatcaatgtcgatgaggttatcggcaaatactatgacctcgtccccgatcccgaagtccccgagcagcgtgtcatcttcggcacctccggccaccgcggatcgtccctgaagacctcgttcaacgaggcccacatcatcgccatctcccaggccatcgccgaataccgcaagaaggccggcgtcaccggcccgctgtacctcggctccgacacccacgcgctgtccggcccggccaagaagaccgccatcgaggtgctcgtcgccaacggcgtgcacgtacgcgtcgattcccgtgacgacttcgtgcccaccccggtggtctcccaggccatcctgacccacaaccgtgcggccgacggcacccagcgcttcgagggcgagggcctcgccgacggcatcgtcgtcacgccgtcccacaacccgcccaccgacggtggcttcaagtacgaccccgtcaccggcggcccggctccggccgagaccaccaatgccatcgccgctcgcgccaacgagctgctcggcgacttcaagtccatcaagcgtgtgccctacgaggaggccatcaagtccgagtacgtcgagggcttcgacttccgcgagcactacgtggacgacctggagaacgtcatcgacttcgacgtgatccgcaactccggcgtgcgtctgggcatcgatccgctcggcggcgcttccgtgaactactggccgctcatcaacgagaagtacggcctgaacatcggcgtggtgcgtcctgaggtcgacccgacctggcgcttcatgaccatcgaccacgacggcaagatccgcatggacccgtcttccccgtacgccatgaagggcctggtcgacgagctcaacgccggcgcttgggacaagtacgatctggtcggcggcaccgacccggacgccgaccgtcacggcatcgtctgcccgaactggggcgtgatgaacccgaaccactacatcgccgtgtgcgtggagtacctgttcggcggcaaccgtccgggctggcctgagggcgcagccgtgggcaagacgctggtctcctcttccctgatcgaccgcgtggccgcatcgatcaacgcgaaggtcatcgaagtgccggtgggcttcaagtggttcgtggacccgctgttcagcggcgaagtcgccttcggcggcgaggagagctccggcatgagcttcctgcgcaaggacggccgcgtgtggaccaccgataaggatggtctgatccccgacctgctggccgccgagatcaccgccaagaccggcaagaacccggcccagcttcaccaggagcaggtcgagcgcttcggcgagtcttggtacaagcgcgtcgacaccccgaccacgctggagcagaaggccaagttcgccaagctgaccggtgatgatgtggccgccacgcagctggctggcgaagacatcaccgccaagctgaccgaggcaccgggcaaccacgccaagatcggcggtctgaaggtcaccaccaaggacaactggttcgccgcccgcccctccggcaccgagaacatctacaaggtgtacgccgagtccttcgtctcccccgaggctctggacaaggtgctcgacgaggccaccgtcgtggtagacaaggccctgagcgagtgaaatcgctgcgttagccgcgttcacagcaaccaataaggctctgcattggattcatgcaatccactgcagagctttttttagcgcatatgcagttcgcgaccactgaaacacgcaggtcaacggttctcctcatgcaccgtgaccgcattttctcaacatcactgcagggcaggacggccatatggccgcgaaacgttcgcctgcctacattatgaccgagtttcccatcatcattgtggggtcacagcggccagatgaccaccgaagcgttcggtcggcttgcatcatggtcgagttttaacatcgttgtgggacgccacgacgaatttgcccattccagagttgccatcccacaaaagcgtgggacaacagctaagtcaatcgttttacattttccccatcccacacactcaaactggaaaccccggaaagacgccattcctgccacacccgtcacagccattacccgaggggccgtgggacgccacgcaaaaatcggcaaaacacgcgtagcgtcccacacccattggcgcaaatccacgctcaatgcaccgacaacacccccaatcgaccactatgacacatttccctccacaatcgaacactagtcattcacgaaatccatcactacgaggcatcgcaatcgaacggcatgcaatatcaagcacacaccacaacaacaggtcgtacaaatattgcctttacatcagtccgtttcgaacatcatggtcacagcaggctctgcgccaactcttcaagagacatggcaactacatgaaactcgaatacggcaccgcgcgaagcaagcgccctcgccacgttgaaagcgaattcagcacgagtatcctcgttagcgatacttgccgccgtggcgatgaagaccagccatctccgcccgaccagcatgccccttttctcttggtcacggcgccattgagtcttactcgtacgatgatgatcgccatcatattcaacagcgaccttgaactctggccacgctaagtccaacgttatgggagctccagatgcaaaagccgcgtccggcaccacatagttcgcaaccggctgtggaatcccatgcgccaccagagagagtcgttcttctgattctttgggcgaatcagcaccaggtgatatcagaggcaatgctcgaacgcaggacgggcgccctctgaatcgggtaaattgctccacgaacttcaccagatcctgatagattgcagcagcatcacgatccttagccaatactggctgtttgctcgtagcagtaatgacggcatccccgagcacaatcagagactcaaaagaaacatacggggcaagttgagcccatacgtgaaacaggtccagcgcaaacacgtgttggttcatttccacattggcggctttagccgcatgtttccaaatatgcgtttgcagtggtgcatggcgtgtacgaaaccgcttgctcttaacgctggatacagtgtgcagcttggccgagtcgaggtcgcaatcggcgggaatcggtacggattgcagagcgagggaagtggtcatgccgaaaagcagcttcttgcccgcccgtttcgcttcctcagtgcagcgtgcgaccatgtcgcgtttgcgctgggcgaggctttcgctcatggtcggtgtcgctgcagaatcatgtgcaccactgttcggcgatgacgagtcgcgagaagtcgggtatttcgagtcagtagaaaatgaccccgcaaattcgggcggaacaaaaactgcctccgattcttccggaggctgatcgtatatagagcctggcagagctccatagttggtgatgccgtcggtcatcctgttcatgacaccaccatatgggtagtgggtgcggaaacggaagccgatccgaggtatgtggtcctagcttcacttacgcacattcattgtggataaccatgtggacacctcacttatacacatagtcacccacctcttcaaccccgatttgacacactaactgtatctgatatgattacagtatcataactgtacacatcatagttacagtatcgactcggtaaggaggtcgtttcatgaacggcgaccattcactggcagtgcacgcattggtctaccttgaccatcgcgccacacacctgcccagtcagatcctggccgagaacatatgtaccaatgcggcgcgcgtgcgcaaagtaatgcgaccgctcgcctcagccggactcatcgccactaaagagggtgctgaaggcgggtacgctctggcccggcccgccgccgaaatcactttgcgcgcggtagcggaagccaccggcaccacttttgtgaaagtgaactggacaccgggcgacgtacacgaggactgtctggtgtcatcttcaatgggcgcagtgatgaacgacatctatgccgggctcaaccgcacttgcctcgaacaactcgaacacaccaccatccacgacatcaccgaacagatattcagcgagcgcaaaggctaataatcccgcgcgtttcccctagccagcatcagtcgataacgcttcggcagtcaaagaagaaaacagacgccgcacggcacacaacacatcagcacaacgcactcttatcactcgaatacgtaaggaagtaaccatgtccatcagcacacccaatgccatcagcacacccaacacctcccccactatcaccaccgacgccctgatcattggattcggcaagggcggcaaaaccttggctgccaagctcagtgcagccggccgcaaggtcgtcgtcgccgaggcaagcgccgacatgtacggcggcacctgcatcaatatcggatgcttgccgtccaagtcactgattttgtccgccgaacaggcgcggcgggatggcgcgaacagtactcccgaaacccgcgaagcagcgttcgaggctgctatcaaggagaagcgccgcgtcacttcgatgctgcgcgacaagaactatcacaagctcgccgaccaagacaacatcaccgtaatcaccggccgcgctcacttcaccggccctcatagcgtggaaatcgccaccgctgagggcccggtcgccgtgaccgccagcaagatcttcatcaataccggtgccacgccgcgcattccggatattcccggtatccacactacgcccggcgtctacaccagcactggactgatggatctcgacgatatgccgcagcgactggtgattatcggttcaggattcattggacttgagtttgcctcgatgtttgccgatttcggcacggcggttaccgtgctgcagcacaatgccgagttcctgccgcgcgaggatgcggatgtggcggccgcgattcgcgcacagttggaagcgcagggcgtcaagttcctgttcaacgcggataccaaggccatcgcgcctgctgctgacggcggcgtcaggttgtccgttgcggtgaagggtatgactcgcggcgcatcgcaagcttgcgattccacccccgccggcaccgggaacgctcataccgatatcaccggcgccaccgacactacaacaaccaccagccccactagcaacccgaccgatcacgccacgatgtcacacgttcaaacgaaaccatcagacgatggcgagccgcggttcgccgagccggctgaagcccgattctgcctgaccaccgacgcggtactggtggccaccggacgtacgccgaacgtcgagggactgcatcttgaggcagctggcgtggagctcaccgaacgcggtgccgtgaaagtcgacgagcttctgcgcaccacagcagccgacatttgggctctgggcgatgtgaacggcggcccgcagcacacgtacatttcgctggatgactatcgcgtggtgtggtcgcagctcaatggttccgaccgtccgcacacggtgaaggaccgcaagcatgtgccgtcgagcacattcctcgccacgccttactcgcgcgtgggattgaatgagcgcgaggcgaaggcggctggattggattatgtggtcaagcgattgccggtggccgctgtgccgaaggcccaggtaatgcggcgaccggatggtctgatgaaggcgattgtggaacgcaatactggccgcattctgggtgcgatgctgctttccgtcgagtcgcacgaggtgatcaatatcgtcaagttggcgatggatcttgacgcgccggccagcacgttgcgcgatatggtgttcacgcatccgacgattgccgaggcactgaacgacttgttcgcgtagtttgttcgcatagcacgcccgcgcagcatgacccgcgtagcgcagcccgcaacagactcccctaatgcgcgcgaaggtcctcatcgacgtaaaccgatgaggaccttcgcgctgtcgtcatgatccgtacgtgacagcaatcacgtccgaaccagccgttacttcaagccgagcttacggtccagaatgtcggaggcatccaatcctaagcggcgtcggatgaaccagccaagaccgagcggcaggccgggagccaaggccatgccgcctggaccgagtgccacggttttggagttgcctgcgataagcatggtgcccttggatgcggccgtggaggtcgaaccatcgctgtccgcctctggtttgaggatttcgatgttgccgtcactggttttgtacagtcccttattctcattccagataccggatgcgccattgttgccggcctcacccgcagagaggaaatgtcttgtttttcttgtgagcgctcacctattcacgcgcgatggcatgtttttcaagcaaagtcaataggtgtgatgttattcacactcttcactacgttgttttgcctcgcactgggcaaccccacttcagcaagagattgcacagcttgcgttagggtggagaacatgactatcacagtatccacagatgggtccgcattagggaatccaaacgggccaatgggctgggcctgggccgatcatgagcagaacgccggcggcaagcccggccataagcacgacgaccatggttatgatgcgggcggcgcgaccaacggcaccaatcagattggtgagctgtgcgcagtgctggaagctttgcgagcgcacccgggccctgagccattgctcatcgaatcggattcgcagtacgccatcaattgctcgaccaagtgggtcaaaggctggaagaagaacggctggaaaaattcgcagaaaaagcctgtgaagaacaaagagcttattcaggcgatcgaccgtgagatctcacaacgccctggcccggtggatttccgatgggtcaaaggtcacgccggcaacgaaggcaatgagctggtcgatgaactggcacgcacctatgcgggcgattgccgttcgggtgcgcgcgacggctatctaccgattgaaggctggcagtcgctgctgggctccgaatacgcacatggcaccgatgtgcctccagacgtgcaattggtattggacggcaaagcggatgcggcaagtttgcgcaagccggctgcggcgacggatcagacggatgccgcaaggccggagaccaagtcttcgtcacccttagcggcacaatcaacgcaacctgtacaatcaacgcaacctgtaccccccgcaaagcccagcgggctgacggtatccggtacgctgaccttctcccccgcgccgaaaacgagcccgtatttcaacgggcagccgatgccgatcaaaggcagcatcgaaatcgaaggctatgtggacggcgacggcaacctgaccatcaccaacgcaccattcgtacgacactgacacccaaacacacgaatatgtaccgtaatcggacacgatgacacaaaatcgctcattcgcgttaggataggagataaggcttcacgccgttgatccatgcggcggaggcaaggatggcaaaggagaaaccatggataaggcacagcaggatgcgctgaagaaggcggccggcatcgaagccgccaagctcgttgaaaacggcatgatcgcaggcctcggcactggttcgaccgtgaagttcctggtggacgagctcggccgccgtcatcaggaggaaggtcttgagttcactggcgtaaccacgtctcgccgcacgcaggtccaggctgaaagctacggcatcaagatcgtggacatcgacgacgtggaccacatcgacgtgaccattgacggcgccgacgaagtcgacaagaacttcaacggtatcaagggcggtggcgctgctctgctgtgggagaagatcgtggccaccaactccaaccagatcgtgtggattgtggacgagtccaaggttgtggacaccatcggcaagttcccgctgccggtcgaggtcattccgttcggtgccggccaagtcatcaagaagttcgaggcccgcggctacaagccggtgcttcgtcttgacgccgacggcaaggaagtgcgcaccgacgagaacaacttcgtggtggacctgcacctggagcgcatcgatcacccgcaggagctggccgaagacctcatcaacacggtcggcgtggtggagcacggcctgttcctcaacatggtcgacaaggtcatcgtcggcgacccgaacggcccgcgcgtgatgaccaacgccaacaagtgatcgtctcacaccactaagcttttccaagcccgcatctgcacatcgcaggtgcgggctttactgttgcccgaacaaggcaaagagccaagcaaaagagaaaccccgcgaccataacgatcacggggtttctaatgccttgattgcaggtaagactacttacgctggtggcgggtcttacgcagcagtttgcggtgcttcttcttgctcatccgcttgcggcgcttcttgatgacagaacccatctgaagcctccatttcgattaatcgtaaaagttgcaactcgcaccataatacacgtgttgccagacagagggaaccagtatgttgccgatagtccgcatatgccctgaacgcagttggggcatccacatcagcaatgtggatgccccaacgttcataagtttgtgcagcagctgacagccgatactagatgctacatcgggaacttctggtagaagcgatcgaccgcttccttggtgccggtagcttggaagaccacggtatcgttctgccagatggcaacggcgttcttgctgttggaggcatcggccttcaccacgtacgcgcccgtgacgttgccggaaaccttgacgttgccggatgccgactcatcgccggtctgcgcagcgaccaacgcatcgtactgggtcttggcattgtccgccgacgaccactgcgcggcgaccagcgtgacatccttggcggcatcaccagtggagtaggtcagagtgtactcctcgagcggcgacgcggaattccacgtcgtggaggcatccgccttggtacgcgcgtaattcagcacgctgcccggcatggccttcaacagctcactggcatcatccggcaaagctgtggcgtcgatggtcggcttggtcggctcggatgattcggttttctgctggctgttttgggtggtagtggaggtgccatcattcttctggatggcccaacccggccacacaaaggccgaaagcactgccaggataatcacaacagctgcggcaaccaccactgcaatcaacttgccatgggattgcgtggtcgaggagttctcactattagtcatgccccgattctctcacagccgcgtgacgctaggcggccgtaattttagtcgttgtgcgcaagccgcgtgaaactcttgtgaacggtaaaaatttaccgtccgctggtgtttgggttagggtgagaccatggcgaaatcaagtgtgcagtatgtatgttccgaatgcggttggaacgggccgaagtggtacggccgttgccccgagtgtggtcagtggggcacggtcgaggaatttcacgaggctcggccggcggcaggctctcgcacggccgctcccggccgaacatcacgcacgcagtcggttacggttgccaacaacgccagatctgcagcccgtccgattaccgaagtgggcacggaaagcgtcgagcggctcggtaccgggttttccgaattcgaccgtgtgctcggcggtggcgtggtgccgggttcagtaacgctgatagcgggcgaaccgggtatcggcaagtcgacattgctgttgcagacggccggcaatatcgcgcgcgttgtggcgggagacagtacgttccgaggggcaggtcagcggtctgcccaacagtcgggccgggcgcagggcaacgcatcgaacacggtgccgatgcggggcaacgcatcatcaacacacgccaacaccgtgctgtacatttccggcgaggaatcacaggcgcaggttcgtttgcgcgcttcccgcatcaatgcggtggagccgaacttgttactggcctccaccaccgacctgtccacagtattggggctgatcgaacagaacaagccggccttggccattgtggattcggcgcagaccatcgtctcgcaggaggtcgatggcatttccggcggttcgactcaggtgcgcgaagtggcaagcgcgctgatagataccgctaagacacttgacattccagtatttctggttggtcatgtgaccaaggatggttcgattgcaggcccgcgcacattggagcatctggtcgatgtggtctgccaattcgaaggcgacagcgagactgcgctgagaatgctgcgagcggtgaagaatcgttttggcccgaccgatgaagtcggctgtttcgacatgagcggtgaaggcatcgaagaggtcaccgatcccgccggattgttcctgtctggagacggccctgatgcggccaacgcggcacccgtggaaggcacctgcgtgacgttcacattggatgggcatcgcagtctgcctatcgaagtacaggctctggtcaccacgtcggtgctgcccacaccccgtcgtgcggtcaatggcgtggaccccagccgtatcgccatgctggtcgcggtgctctaccgtcacagcaagctcaacctgctgtccaacgacctgtatatctccactattgccgggggccaggccaaggagcccggttccgacttggcgatagtggcggcactggcgagcgccgccacgtcaaaacccattgcgcgagccacgtgcgccattggtgagatttccctgaccggtcaggtgcgcccggtaccgcgtatggaatatcgccttcgcgaggccgcacgcctcggcttcaccacggcggtcattccgccactgcgcaagccggtgcatgtcgagggacttcagctggtggagtccaacacattgtccgacgcattagacgccttgggagtgcgtaaatagccctgagatatgcctcaggcggtaagacgcttggtctcctcgacgttgcgcttgagttcgtcgacgagttggtcggggccatcaaacttgacctgcgggcgcaggaagccgacgaattcgacgcgaaccttgtggtcgtacaggtcgatccattcttcagtgatgcagtaggcctccaccacacgttcgttgagccctgttttctcgctgaaggtgggtttggtgccaatggagatggcggcgggccaacggttttcaccatctaccagccaaccggcatagacgccgtcgaccggaatgtagcctgcaatgtcggagccaagattggcggtggggaatccgatggtgcggccacgctcctcaccgtgcaccacttcgccctcgatggagtgcggagcacccagaatggcgttggcgtcctggattcggccatgagccagcaggtagcgcacattggtggagctccatgcgcgcattgccttggcctggttcttcttgctccatgcgcggcgctcggccttggtggcattggccagcgggtcgacgggctctccccattcgctcggggcttccggcttgaaatcgcgcggaatacgcacttcacccgggccacggtcatcgaccacatcaagttcgaatacaccggtggcggcggcaagattggcgatatgcttcacatcaccttctcgacccttgcccatggcggcatcctgcccaaggaccaacgtgcgcatacccagcttgccggtgagtcggccaaggaagaaaatgtatgacatagctgcgaaggccagcgtgtagtgcaccaccagcacgtggtccacgccgaactgttccatgcggtgcagtcgatcatccacactggtcaaggcttcggcatccacgttctgcaccgcgggttcttcgccatggtgcgagatgacccagccgtgcacgaatgcggggcgcggatcaaacagaatcaccacggaaaaagcatcatgctggtgcgcgagttccaccacacgcttgatcaccgcctgatgacccaagtgcatgccatcaaatgcgcccaatgtcaccacggccttcttatcgttactgaacgagggccattcaatcgaaccttcggcgtcaggggtcaggtgcgtgatatccatcagtgtgctgttccttttatccgtgcgatgttatttatgcaatatagacgttgttgtgcgcggcctgtatcaagctgcacttttcaccgcgtctactttacgcgagggggaatacggtgaccggcttggcctgatgagcgtttgcacgctcgataatcgccgccacatcatgcgtttgcggcacaatggcggcagtgggctcgctgattgtacgctcaatacggcggccgaagcgtaattcgctggcctcctcaggagtgatgtcaagcgccggcatcgcacctcgagcggcctgttccatggtaagggcatggtcaagcagccagttgcggcgctcgtcaccggcaagaccttcaggagtgtccaatacgcacttgttgcgcgtgacggtttgcccttcccgattagtgaacgtcttctgatcggtatgtgcggtgacggtatgggttcgcgtgtcaagcatcgcctcaggagcgataagtccgctggcatcgtccggcaacgcgaatcggccgactcgcgtacggcgcaaacgggtcaggtatccgccgacgccaagttctttgccgaggtcgcgggcgagcgcacggatataggtgcccgatgaacagctgatccgcacgtcaacatcaagtgcgggaatcgctcccgtgttcgcgtcttcccgcaatggttcagcggtctgctcccctgctacgaatccgctgcggatatccagcacggtgaattcgctgatggtgaccgggcggggtttgagttccacatccttgccttcgcgagccaagtcgtaggcacgctggccgttgattttgatggcggagaacgtattggggacttgttcgatatcgccggtgaaattggtggcgatggtgcgtgtgagcaggtcttgccatgaggcagttggtaacgccgttggttcgccgctctggccaccctcagtcagctgcgctgatagcgtttgccagcgggagcgggcttcgtcatcgacaagcacctcgccttcggcatcgtcggtagtggtgcgcaggccgaggcgtatggtagcctcgtaggttttgtcatgcgccacgatggcgttgagcagtcgtgtggcgtggccgaaggcgatgaccagcgtgccagtggccatggggtcaagggtgccggcgtgaccgaccttcttgatgtgcaacgcgccgcgcacggcggcgacggcgtcgaaactggtcacgccttgcggcttgtcgatgatgagcagaccgctgggggttgtatgaagcacactactcctcgtcagagtcgtcttcgaagtcgtcgctgggctcgtcgtcatgcttgtacggatcggcgtcgccggcgtactgggcggtggcgcgagcacgggcgagttcttcgtcacgcttcttggccacggcgagaatgtcttcgatctcgtgagcctcgccgggcacttcatcgaacacgaattggagctgcggagtcagacgcaggccagccttgtggcccaccagagaacgcaggtggcccttggcctgatcgagggcctgctgggcgcgcttgcgttcgccttcctcatggccttcgtggccgagctgggtccagtagaccttggcgatttgcaaatcgttggtcacacggacttcggtgacggtgatgctggcgagtcgcttgtcatgcagttcgcgctcaatggaggaggcgacgacacgctgaatcaaggccgcaatacgtgcggcgcgcgggttggttcctgccataggaatttccttttctagacttgagccccctctgacgaggggctgccgaacgcagtgaggccaggggagagaaaatcatggaactaccatgtctctcccccagtcagcctgcggctgacagccccctcgccagagggggcttaacaatgactacttgcgctcgacttcccgcatctcgaaggtctcgatgatgtcgccgagttcaatgtcgttgaaggtgccgaggttgataccagcctcgtagccttccttgacggactgaacgtcgtccttgaagcgacgcagcgaggagatctcgaggtcgttgaccgtggccacgccgttgcgcaggatacggcacttcgtaccacgcttgacctcgccgtcctgcaccataacgccggcgatgttgccgaacttggaggagcggaagatctcgcggatctcggagtgagaggtgacgacctcttcgtattccggcttgagcatgcccttgagggatgcctcgatgtcttcgatcgcacggtagatgaccgagtagtacttgatctccacgccctcgcgctcggcgaggtccgcgacctgacggttcggacgcacgttgaaaccgatgataacggccttgtcgaccgtggccaggttgacatcattctgggtgattgcaccgacgccgcggtggatgacctggatgccgacctcgtcggatacctcgatcttcatcaaggaatcctcgagcgcctcgacagaaccggacgaatcgcccttgatgacaatattgagcatgtcgatctcggactcggcgaacttcttcttgaagtcctcgagggagacgaccttgcgacgcttggccagctgggcggcacgctcggtggcctgacgcttctcggcaatctggcgagcggcacgatcatcggaggcgaccaggaagaggtcaccggcggtgggcacggaggtcaagcccagcacctgaacaggtgtggacggaccggccgcttccatcggctgaccgttctcgtcgagcatggcacgcacgcggccgtacgaagtgccggccacgatggcatcgcccacgtggagcgtaccctgctgaaccagcacagtggccacggcaccacgacccttgtcgagtcgggcttcgacggtggcaccacgggcgtccatgtcggggttggcgcggaggtccagctcagcgtcagccgtgagcagcacggcttcgagcagcttgtcgacgtgcaggttctgcttggcggagatgtcgacgaacatggtgtcgccaccatactcttcagggaccaagccgaactcggtgagctggccgcggaccttctccgggttggcaccgggcacatcgatcttgttgacggccacgacgatcggcaccttggcggcctgagcgtggttgatggcctcaacggtctggggcatcacaccatcgtcggcggcgaccacgaggatcgcgacgtcagtgagctcggcaccacgggcacgcatggcggtgaacgcctcgtggccaggggtatcgaggaaggtgatcttgcgcggttcgccttcaaggttcacggtgacctggtaggcaccgatgcgctgggtaatgccgccggcctcacgtgcgatgacgttggtcttgcggatggtatccagcagtcgtgtcttaccgtggtcgacgtggcccatgacggtaacgaccggcgggcgaggcttgagatcctcgtcatcctgcagttcttcctcgtcaaggttgatgtcgaactgctggagcagttccttgtcttcctcttctgcggagacgagctggatgttccagccgatctcttcgcccagaatctggaaggtctcctcatccaaggactgggtggcggtagccatctgacccaggtggaagagcacggtgaccagcgcggcctggttgacgttgatcttctccgcaagatcggccagggacgcgccctgacgcagacggatggtctggccgttgccgttggggatgcgaacgccgccgatggtcggtgctttcagctcctcatactcatggcgctttgccagacggttcttacgggcctttgaagacttgccgccctgacgtccgaatgcgcctgcggcaccgccgcgaccgccgcgaccgccgccacgtgcgggaccgttgctcggtgcaccgccgccctggaagttattgccgccgccttggcccccacggaagccgccgcgtgcgccgccctgaccggcaccctgggagccgccgccctgacccggacggttgtggccccactggccgggacgcggaccgccctgaccaccttggcccggacgaccgccacggaagccgcggccctgcccctggccttggccgggacggcccggacgaccgccacgaccgttatcagcagtcggacgagccatcggatgcggacgcggaatatcacccggcgtcggggtgtgcataccctgcttgcgggagaacgggttgttgcccgggcgcgggccctgagcgtgcgggcgcggaatcgcatttgaagcggcattgccgccattggcaccggcgccgccctgagcgtgcgggcgcggagccgaagcattgccgcggttgttctgatgctgaaccggctggccattgttcggacggccctggttgttacgacgatcgttgttacggcgatcgttcgggcgactctgacgaccgttctcacggccttcgcgattatcgcgaccattctcacggttgtcgttctgaccgtggcggccgggggtcggcatgccggggcgtgcgccgccctgcggacgcggtgtcggtgcacccggagtcggagcctgctgatgtgccgaggcaggcgatgcctgacgtgcgggagcggccggagtcggtgcggaagatgaagcggaagccggggccgaaggtgcggccgggcggcgctgctgcacgggcttggaatcgcccttggcgttgtccttggcgaactctgccttcagacgccgggctaccggcggttcaatcgtagaagaagcggacttgacgaattctcccatgtccttaagcttctcaagcacggttttgctatcgacattcaaaaccttagccagttcgtatacgcgtggtttcgccactaattactcctattctgtgaccacgcgcgtgcatgggcgtggtcagttggtgatgacggcaagcctaccctgtctcatcgtgcgaccatgatcgtgttacctcgtctctggtgtgggcgatttcgcgcacactgcgccagcccacatacgccaatcaagcatactcatagcgctggatagcgtagacgcagcgagccgcgccattgctgacgcggctcgtatcaggaaataatgcgccctgaagatcattcgccttcgagcccggcggcctattcggcttccggagcagcagcctcggccgcagcctgggcggccttttcggcggcgactttcttggcatgggcctcggcggattcgatgccgatcttccagccggtcagcttggctgccagtcgtgcgttctggccttccttgccgatggccaaggacagctggtcgtcgtggatgaaggcgatggcggtcttgttcttctcgctgatcacctgcacgccggtggccacagccggggacagcgcggctgccacgaacttggccggatcgtcggagtagtcgacgatgtcgatcttctccgggccaaggttctccataacggcacgcacgcgagcgccgccggggccgatcagcgcgcccttcgggttcacgccatcggtgttggccttgaccgcgatcttggtgcgggcgccggcctcacgagcgatggccatgatggacacggcaccggagaccagttccggcacttcgcgctcgaacagcttgcggaccagctccgggtgggagcgggacaccacgatttccgggcctttgatgccacgggccacgttcaccacgtacacgcggatgcgttcgccgtggcggtaacgttcgccgggcacctgctcacggcgaggcagaatggcttcgacatcgcccatcgcgacatgcacgttggaggggtcggaagcatcctgctggatgatgccggtgatgagcttgcccttctggccggagaacgcaccgaataccttctcatcttcggcgcggcggaacagctgggtgatgacctggcgtgcggtggctgcggcgagacggccgaagtcacgcggggtgtcatcgtattcctcgcccagcttgggaacggggtaagggttgtcttcggtgggttcgaccggaatttcgtcggcggcccacacggtgaagttgccggaacgttcgtcaagctccacgcgcgcgtgcttggcggcgtgcggggtcttgaggtaggcgaggcgcagggcctctgccagcgcatcatccagggtttcggggtcgattccttgctcggcggcgagcttgtgtattcctgtcaggtccagttccatcgatccgtacctcctatgaagttatgtggcgcatggcctatgagtagtcacagttagctattagtgtatgtttccatgcagacacgcttctcttcaggacggtttacccggcgcttggcatccgtactatgcgcgagcgcgatgctgtgttcgctttcggcgtgttcgatgccgcgactggccggacgggccgaggcagaagctcaaatgaccccttgcgagaaagcgatgacgttggcgggctacgccacccatccggctgaaggcacgccgttattagagcagtatgccaccggtctggccgctcccctggcttggattgacgttgccgggtattgttcgggtcgttttgccgagggaacgttacgtgacgcgcagaccaagcaatggctggcttttctggccgataaattcgggcagtccgcgcctgaggtgacgccggcgcgtcttgatggcgtcacgtccgccaacgttgatcgatcggtattggatgcgatggccgtggccgaggatcgcgccggattcgctatcgaggtcttggccgcacgaggacagaccgctggggctacgttggcgttgagcgatatgcataagaccgccgggcagcagttggttgcgctggcgaacggcaattttgatgattccggcgcacaatccagttcttccggccaaaacgacccccgccaaaaggtctatgccatcgaccaactactggccaaccccaccaccatcgccgacaaggcaagcggccaaaccgtaccgaccgccgccgccatcgaaatggactgcgcccgcgcgcagatcaaggccgtgaccgaatcgaaatcttccaccgagagcgatacgctgctcatcctcgccgcactggccgccaagcacgcctacaccgcgttccaacttggctacccagcgactgacgccgcattgttcgagtagacacacactcctcacgaagccgatgcgaacttgttggatgctagtgggcaagtcgagttgaggcacgttccaccaatgtgaaatcggtggtgtacgtacgggccgggcctgagtatccttcgatgcggtcgataagcatgtcaacggcatgcttggcataatcatcgatatgaggatcgatggtggtcagcgccggcaccgagtactcggcttccggcacgttatcgaagccgaccacttgtacatcgtcaggtacatgcaaaccacatcgttgcaattcatgaattgcgcctaaagcaatggcatcattgagacacactacaacatccgggcatgggagcttgtctagcatagcttttgtcacgcgcataccttcacgctgattcatgctttctgccggaatcacataccgccaattcaccgataatccgcgctcttcaaatgccttcacatatccttgggcgcgtaacgcctgggtcccttccgtctgacgacgcagcactgcctcatccaccagttcaggaagaacacccatcagagcaaccgtttgggcaccttcatccaaaaatcttcctacaaccgtggaaatggattcaatgttgggcatggtgatccaatcgcttttcccgtaggccagatggtctccggtcgttacaatcggatatggctgctccagaacggccccttcatccgcgagcggcgacattacgaacagaatccatccttccgcccctaaacgataggactcgtcaacgctggcaaccaacccttcaccgtcggaaccatatgtgttgatgactacaccgtaatggcgttcttttgcgtattcaatgaccttgtcagtgaaaaaaggaacgaacggctgcgagaaatcgaagatgttgagtccaataagctttgtgccgccagatcgcattgcacgcgccgaaatattgacggtatatccaagcttacgcatcacctcttccacacggcgacgtgtatccggtctcatactgccagtgtcattcagcacattggaaaccgtcttgatggagacgttcgcctcacgcgccacgtccttgatagttacgcggtttcccattgttcgaatccatttctgcttattacatgacacaccttcaacagcgtcattatgttcttattatggtaagtcacagtcgggtcgagcatctcctcctcatatcggaatcatctacccctcaacctcagaattcagccaaggagctttcctccgttggaccccatgcaccattaggcaaatatccttctgacaatactgcaggacgatcgaacgtagaggttaaactttctggttgaagaaacgcacgcacgccatccgaacaagggactttctgaccgccggctttcaacctagctttttacatacccgtcttttctccttattcctttgttgggtatcgaattgttccagtcgatgtgaatgacggcattgtcttcctttgactggtatgccacattacattagtggcgaatccgaacctctctttctgcaatccgggcatgttgatgattgtttgggtattgcttggtggttgtacagggcacagcaaccataagagactgcgccctgtcatgcgccaccgtcactcgaatcacttcacgtgcacggcggtccaggagaccggcggcaaggtcacacgcacagtgccggtatcggcgtcggacgtgatggtggtgttggggtgcagaacgactcggttctggtcttccagcgtgttttttgccagcagatcatcctcgtgcagggtttgcgcctcgaccgcggaaagtgcgaatccttccggcagcttgatggcaaagtcattggccgcttccatggagcgattgaccacaaacacgctgatcgtaccgtcctcaccacgcacggctacggaattgatcgtcggcacttcaccgtatttgtcggtttcatacgttccggaagccagtttcggttcaagcaccgtgccgcccttggcgagctttgcggtcagcgagaacggatagaacgtggtctgacgccacgtcgggccgcccggttcggtcataatcggcgcaattacgttgaccaactgggccaggctggcggcgtgcacgcggtcggcgttcttgagcagggtaatcatcaaatcaccgaacaccacggcgtcggcggcgctgtacacatcctcgagcaggcgcggggcaaccggccaattgccgatgccttccggattcttgctcggctcttcgttgagataccagacattccattcatcgaacgagatgaacacgtcgtgcttgctcttcagccgggccttggttgcatcgatggcggcggcgacatcgttgatgaaaccgtccatatcgacgcccgaggcaaggaagctcttcatgtcacgggtgccatcaggctgaagttccggatggtagtacgcatggcaggagacgaagttgacgttgtcaaacgtcttctcaagtacggtttcttcccacttgccgaaggtgtccatcacgtggctggatgaaccacagaccaccagttcaacgttcggatcgatggcgcgcatacctgccgccaccgaggccgccaaggtgccgtaatcctcggcggacttgtgaccggtctgccacgggccatccatctcattgcccaagcaccacatcttgatgccgaacggctgatcggcaccattggcgcgacgctcctcggagagcttggtgccgccgggaatattcgcgtattccaacaggtcgagggcctcttcaagaccacgggtacccagatttacggcttccatcagctcgttgccgccggtttttccagccatttcgccatttcgtgcagaccaaactgattggtctcggtggaatgccatgccaagtccaggcgacgcggccgctcatcacgaggaccaacgccatcctcccagcgatagccggaaacgaaattgccgccaggatagcgaatcgtggtagcgccgagttccttgaccagttcgatgacgtccttgcggaaaccgtcttcatcggcttcggggtggcccggctcatagatgccgtcgtatacgcagcgacccagatgctccacgaacgacccgaacagtctgtcgttgaccggagctacttcaaagtcattatcgacgacgagtcgagattcctccagctcccccggtttattgtcgtgcgaatgctcggacatgtgctctcctttaatcgttgtcttcaataccgcaagacaacgttgtgctaaataccaaaagcaatcggcccatcttcttggttcacctgttttgcggcatcgccaatcagcggtgaatgtgcgttctggatatttaatacaaccttgtacttctgttgatatcgataatacgatggttgtacttagtacgcaagtcccgctgagtacaacgttatccttttcgctattttccacccgacacgccgtatacgatacagcacaggagcgaatacggacgttcgtatcaaaaacaaaaagggttccgggacaaacccggaaccctaaaggcggataaggcgagattcgaactcgcggaggctttcacctcacacgctttcgaggcgtgctccttagaccgctcggacacttatccatgctgccaaaatggcaacttgttcattatgccacattctgccgacctggcaaatcggagtttcgctgagctcgattcggcgtgggataatgcgattttgtgtgagattgcgatgggtcagacgatgagccgattaacagtccgaattggtcaactgcgaaaatccgaattcttcaactaccaaaatccgaatattggtggtggtagaagcggtgacggggccactctgcattgagtggtctctccctcggtcagccttacggctgacagctcgaacgcaattaaggacagctttccagctgccattttatttgctcactgtcgttcgccttcgcctaaaaacgcctccggcgttttcttcacggctcagctcatcagagggggcttggaattttatttatgccacctgttcgtggacggaggcgttgacccattgggactgctggacgttgtatccagagaagatgccgatgtcgagcatgcagtcgcggtaatcgcggccgtgggcgatggtgatgtagctgtcgtccaccaatcggttatgcgtgggatccagtccgacccatcggccatcctgatacacctcgacccaagcatgggtcgcgccctctcccccaagcaaaccggcaatgtagcgcgcggtcaatcccacatgccggcacacggacagcatcacgtgcgcataatcctggcatacgcccttgcgctgagccaaggcctgttcggcggtggtgcgaatcgtggtggaaccgggcgtatacacaaacgccttgtagacctcatccatcacttcggcggcctgctgcaccggagtggcgtcggaaggcagcgccgccaagcgttcgcggcatacggcaatcatcgcctccacgttcgggccgggaatggtgagcgctgaattgaatcggtacagcggtttataggcttccttatggatatgcgcattgtccacgaaggcgatgccggtcaccgagtagctgaatatgtcgtgcggctcagggatgaatccggtcatcaccacggagtcaaaggagtcgatggtggtttcgagttcggtttcgggctgaatcttcacttccacgtcaatcacctgttggcgagggccagtggagggaatacagcgaagctggaacctgtgatcggtgaccggtgcgctgaaggacagcctcatctcatagtcgaacacgagttttttcacaacgtctcctgcacttgcacacgagccggcaaccggcatattctcgggataacgacactacagccatggctgaggtatggtccgtgcgctcacagcccacgcatatattccggcaatctgctgatatgcacaggccggcactcgggcgcacggttttttcgccataccaccatagcatttgaacccgtcagggtgtcaggtcgggatcagggacgcttggcatccatgttcatggagctcagtgagcccatgtctttgatggccagcgcgctgacacggccggagtagtcgtcaaggtacttcttcagcaggtcggcgacttcctgatatccgcgagacggcagctgaccgaccagccagctcagtccgtcggcgaagcagctgggcagcggcatgccgtccaaggtcatcgaataggcggcgagcttcttgagcggcgcttccagctcctccatcgtcaggccgaagcgcgtgtacaggtcgatgcgttccagatatttgccgatgaagatgaacgccttcagcgtggggtcgaccggcgaattctcgatgccgccccagaaggcgagcatgtcatcggtaatatcgcgctgcttgtagatgtcctcggcatcggccgcgtatttggcggcatcggtgatattggtcatcgccaactccacgtactgcagcagacgcgagctcaattccgggcgcagaatcacggcgttgttgaatgcggaggttacggccgaccgcaccgaatcaggattggacccgtcatacaggaagctgttcacgaacccgtcgaagtcctcgaaatcttcgggcaggtcgagtgcgtgagcgaacggacggaaggcgtccacatcagtgtccatcacacgatcgtagaacgggaagaactggttcagcgtggtgaaggcgcgctcggtgtaccggcccagccaatacaggttgtctgccttggaagcggtgaccagagacaacgagtggcggcgggactggttcagcaggttcaccacctgcgtttcggcaccgtattcatgctccacgccggattcgggtgccaacacccacgtatccttgaatccgccaccctgcgacgagttgacaatcatctggccaggcaccgacgagtatcgagtcaagcccgaataccacacgtgcgtattcttgccggtgaccacgaaggcacgcaaatcgcacttgcgcggcgacatctcgccggtcttcgggtccaccacatcgatatcacggaactgaatcacctcttgggcaatgaatcgacgcggctcctccttgatccggttggcgagctcctcacgtgcggcggcatccagcgacgaaccaaacaccacgccgtaaccgccggcttcggccacatccttgatgaccagctcgcccatccgattcaggacttccttgcggtcggcctcgaacatcggcatgtacgtgggcgcgttgttgagaatcggttcctcgccgagatagtacttgatcatctgcggcacgaagtagtagatggccttgtcatcggccgcgccgttgcccggcgcgttgacgatggccacgttgcccgcgcggtaggcggacaggataccgggcacaccgatcaccgaatcaggattgaaggcgaacgggtcgaggaattcgtcggacaggcggcggtagaccacgcccacacggtggcgtttgccggcgtagtcgaggaagtagaccttgttgtccaccacttcgaggtcctcggggaaggccaacgccgcaccggttttctccgccagataggcgtgctcgaagaacgcggaattgtagcggccgggagtcagtaccacggcgatgccctcggtggagacaaagtccatggctttgcgcaacaggcgcgggtattcgcgattatcgcgaatacgaacgtcgcggaacaggcgcggggagatgcggcgctcgatgtcgcgcacgaacagcgggtagctggcacccgagggaatacgcaggttgtcttccagcacccaccatcgtccgtcctcgccttggaccaggtcctcgccggcgatgtgagcaaaaatgccgccgggaggggtcacgccgttgacctgcgggaagtagccggccgaggtgtatacgtattcctccggcaccacgccgtcatggatgatggccttgtcggagtagatgtccttcagataggcgttcagggcgttgacgcgctgcttcaagcccttctccaattcgtcgtattcgtcggattcgataatgcgcggcacagggtcgtacgggaacagccggtcatggtattcgccgttcttgtagatgccgaaacgcacaccgttgcgggacagctctcgattgatcgcttcgcggcggtttaccagttcatgggccagtctgcgtgctgcggattcgatcatcgtgcctgctccttgctgtggcggcttctgtggcttcaagcggttaggcgtgttgagcgcacgctgacgccgcaagccgtaaccgggtttgatggtttcaacctaaggcgggcccgtttcaacaaacgcgcgagaatgttacaggcaggtcacttcgccggccgcgtgcatcttgacgaccgcactcgtctcgccgaccgcacgcatcttgccgaccgcacgcatcttgccgaccgcactcatctcgccgaccacactcgttacaatgaatggctatgacacgactgcgcattgacttggcctacgacggcggcggattctatggctgggccaaacagcccaatcttcgtacggtgcaaggcaccattgaagatgcgctgcacaaggtgctgcgggtgccggccgatgacgcggccgaaccgttacgcttgacggtggctggacgcaccgacaccggtgtgcacgcctcccaccaagtggcgcatctggatgtatccgatgaggtactgaatcgctgcgtaggtcacatgaccattccggtcaccgaggcgctgactcgcagactcaaggctgtgctgcctccggacatcgtcattcatggcattgccgtagctccggtcggcttcgatgccaggttctccgcattggagcgcacttatgtgtatcgggtcgccgatcgttcgtctgaggtcgacccgcgcctgcgtggatgcgtacttaccgtggatgaagcgctggatctggagcttatgaaccgcgcagcctcattgaccatcggcctgcacgattttggttccttcgccactccgaatccgggaggcactacgatccgtgaagtcaagaccgcctattggcggcgggtgccgatcactcccctagtaccggatgagatggcatcgcatgaagcatatcggactccgtcgctggagtccggcctggtagtgttcacgattgtggcggacgcctttgcccgcaatatggtgcgctccctggtcggctcatgcatcaaagttggttcgggacgcaaatcactggagtggtttgccggcaaaatggccgagccagtacgtgaaggctcaagcgggccgattgcgccgcagggcctgactttggagcatatcgcatatcccgccgatgatcagctggccgcaagagccgaggccattcgggccgtacgtacgttgtagattctatgaaaacaacgcaaaagggctggaacccaaacggattccagccctttcagctagcttagcgaaacgctattcagctcactcggccttctcggcgtcagcggcttcctcagcgggagcctcagcctcagcggcggcggtctcctcgaccggagcctcaacagcctcagcagcctcagtggcctcagcctcaacggccggagcttcttcttcggcaaccttggcggcggcttcagcttccttcacaacagccttcttggcaaccggctcggtgacgagctcgatcacagcggccggagcggcatcgccaacgcgcggagcgatcttgacgatacgggtgtagccaccttcacgctgctccatctgctcggcaatctgggtgaacaggatgtgcaccacggacttgttgcggatgacgcgcatcacgcgacggcgggagtgcagatcaccacgcttggcgaaggtgatcaggcgctctgccagcggacgaaggcgcttggccttcggcagcgtggtggtgatgcggccgttctggaacaggctggtcgccatgtttgccagcatgaggcgctcgtgtgcggggctggaagccagacgcgggcccttcttaggtgtaggcattgggtttactccttatatgtccgttcttcaggcaagcaggtgggcatatgcccgaacatctgcttgcctagtgaacgaacgattggtcaaagaggcagatcactcgtcttccggcgagaagaacgtgccaccttcgagattattggtatcgaaggccatcggcgaggacttgaggctcaggcccaaggtctgcagcttctccttgacctcatcgattgacttcataccgaaattgcggatgtcgagcaggtcctgctcggtgtgggagacaagctcaccgatggtgtggatgccctcgcgcttgaggcagttgtaagaacgctgcgtcaggttgaggtcctcaatcggaacggccatctcggggttggtctcctcggccaccggggccggaccgacctcgacgccttcagcctgggcgttgagctcacggcacaggccgaagagctccaccaaggtggaaccggcggaagccaccgcgtcacgcggggagatggcgggcttggtctccacgtccaggatgagcttgtcgaagtccgtgcgctgttccacacgggtggcctcgaccttgtagctcaccttgagtaccggggagtagatggaatcaaccggaatacggccgatctcatcgttgtcctgcttgttcatctgggcaggaacatagccacggccacgctcgacagtgaactcgatctcgagttcgccatcgtcggcgagggtagcgatgtgctgctccgggttggcaatggtgacgccggccggcggggtgatgtccccagccacggcttcgcccttgccgctcttgcgcagatacatgaccacaggctcgtcgtattcgctggtgagcacgatgcccttgatgttcagcaggatctcggtgacgtcttcctggacacccggcagagtggtgaactcatgcagggcaccggaaatacgcacggaggtcacggcagcacccgggatggagctcagcagcgtgcgacgcagcgagttgccgagcgtgtagccgaagccaggctcgagcggctcgatggtgaagcgggagcgctgcggattcagagattcctcggtaagagtcggacgctgtgcaataagcactgtggttatcctttcagcttgaactcggtggtgcactcaccggtcaggcggttttggatggatttggtattgctgagtgctcagacgcgacgacgcttcggaggacgaacgccgttgtgggcttgcggggtgacgtcggtgatggaaccaacctcgaggcccgcagactgcagggaacggatggcggtttcacgaccggaacccgggcccttgacgaacacgtcgaccttcttgacgccgtgttccatcgccttgcgggcggcggactcggcagccataccagcggcgtacggcgtggacttacgggagcccttgaagccgacatcgccaccggacgcccaggacaccacggcgccggacggatcggtgatcgaaatgatcgtgttgttgaaagtggacttgatgtgagcctggccgaccgggaccgacttgcggtcgcgacgacggggcttacgagcggcttgcttaggcgctgccattgaccctcgtttcctagtaacgaactttgttgttgacgttcgggcgatgggatgaaaatcatcccgtggcccgaatcatgccaccgactacttggtggccttcttctttccggcgaccgtgcgcttcgggcccttgcgggtacgagcattggtcttggtgcgctggccgcgcacaggaagtcccttacggtgacgctggccttggtagcagttgatctgaatcttgcgacgaatatctgcatcgacttcacgacgcaggtcaccctcgatcttgtagttggcttcgaggtagtcacgcagcgtaatcagctgctcgtcggtgagatccttgacgcggatgtccggactaataccggtcgcggcaagcgtttccttggcacgagtgcgacccacaccgaaaatgtaggtgagggcgatctcgatgcgcttctcattggggatgtcgactccggcaagacgtgccattgcgattccttcttgttgccgtaggtcttgcacccgctcgcccggttacccggcacgggcctacgtacccgtggttcagtgtcgttcccttgcgggaagcactgtgagagagtgccttatttacttagtgccgctggagaatctgctctcagccctgacgctgcttgtggcgcgggttgacgcagatcaccatgacgcggccgtgacggcggatcacgcggcagttttcgcagatcctcttcacgctagggctgaccttcatggttatccttttcttgtgtacctttacttgtaacggtacgtaatgcgtccgcggttcaggtcgtaagggctcatttcgagcacgacacgatcctgcggcagaatacgaatgtagttcttacgcattttgccggaaatcgtggcgagcacgatgtgcttgttttcgagttcaacgcggaacatcgcgttaggcagtgcttccacgacctgtccttcgacttcaatcacaccgtcttttgccatgtgcctctagtcctattccgttggatgattactatggcatatccgaagacacaccaactgtcaactatatacgcacatacccctgtacgaacactcggcgtgtcgcacaggggtatggaaacgttgatgtggtatttcggcatcactccggcttgttgcccgggctgccgaacctactactcgaggtggctgatgatacggccgctgatctcgtcgatgtcgccgacgccgttgaccacgacgagcaggccacgggcctcgtagatgtcgagcagcggagcggtttccttctcataggtctccaggcgcttggcgatggcctccggagtgtcgtcagcgcggccctgctcggcggcgcgcttcttcatacgctccagcagcacgtcgcgggcggcttcgagggccaccacgtggtcgagcggagtgtcgaggtcggcgagcatctcgtcgagagcggtgacctgggcggcgttacgcgggtagccgtcgaggatccagccgttcttgcagtcttccttggccagacgatccttgacgatcttgttggtcagggagtccggaaccagctcgcccttgtcggtgtagctcatcgcctcaaggccgagttcggtcttgttcttgatgttgtagcggaagatgtcgccggtggagatggtggggatgttgaagtgttcggcgagcagagcagcctgggtgcccttgcccacgccctgggggcccatgatgagcagacgcatggtggtctccttttatgtcggttattaatacggttttggctcccttggttaagggagccattgagttatatgcggaagaaagattgctccgtcgtggaacagtccactggactgtttcactcctcgcgcggccgcctgcccattgcgggcggccgctgtcaagcgggcgtcagccctctttgtggtccacgttttcgaacaggaagccggtgtactggaactgttcggtctgggccttggcctggcgcagggtgtcgaggcccacgcccgcgataatcaggatcgtggtgccaccgaacggcagcttggcgttgaggccgagggccatgatcagcacggtcgggatcagggccacgaacagcaggtagacggcgccgacggtgttgagtcggttcatcacgtaggtcaggtagcggctggtggcgttgccggcgcggatgccggggatgaagccgccgtactgcttcatgttgtccgcggtctcgtccgggttgaacgtgatcgaggtgtagaagaagcagaagaacacgatcatcagcgcgtacagggcgatgtaccacacggatgtggtgttcgccaggttggcgttgatccacttgacccacgactggtcggacttgccgaactgggcgatcagggtcgggatggcgaggatcgaggaggcgaagatcggcgggatgacgccggacatgttgatcttcagcggcaagtaggtggaggagccgccgtacatcttacggccgatcatgcggcgcgtgtactggaccggcacgcggcgctggcacagttcgacgaagtcgacgaagatgaggatgaccacgagcacgcccacgacgatgccgaacttcagccagtcgccatcggtgccgtcggtgccgtagccgatctcccacagctgcggcaggaagccggagcagatggacatgaagatcaagatggacatgccctggccgatgcccttgtcggtcacgagctcggccatccacatgatcaggccggtgccgccggtcatgatgaggaccatgaccacgaggttgaacacggaaccgtccgggatgacctggtcgcactggtagttgaacagggcgccggagcgggcggtgaccaggatggtggtggactggagcacggccaggccgatggtcaggtaacgggtgtactgggtgagcttggcctcgccggactggccctccttatgcagggcctcgaagcgggggatgaccacgcgcagcagctgcaccacgatggacgcggtgatgtacggcatgacgcccagcgcgaagatagacagctggagcatggcgccacccgagaagaggttcaccagtccgatgaagttctcctgggaggcgctgccgatagtggccatgcacttgttcaccacgttgtagtccacgccaggggtcggaatgaacgaaccgatgcggtagacgatgatgatgaacaggacgaagagaatcttcttcctcaactctttggttttcagggcctggattagtgtcctcacctagatttcctcccaatagcgcgccaatcgcgcgaaatacacaaactaacgaacgagcatagtctaaagtgcctacttcggccacttcatgtctcgcgaatgttacctgaattatgctccgtcgtactgaacggggggaagcatactcaaaacgatcattgtgttgagactgcttctctgcactcagaacaacaattttttagaaaagggaacccccgtccacctattggcgggcggggggttgtacagcctattgcgctccccgtaggactaatcagtcctcggaaacggaaccgccggcggcctcgatcttggacttggcggaagccgaaaccttaacacccttgagggtgaaagccacggtggtctcgccgtcgcccagaaccttcaccggagcgttgtcacgaacagcgcccttggcgatcaggtcggccacagcaacctcgccgccctcggggaagagctccacgagacgagcgatgttgatgacctggaactcgaccttgaacgggttcttgaagccacgaagcttcggcaggcgcatgtacagcggcagctggccgccttcaaagcccggacgcacgtggttgcgcttcgtctggcccttggcgccacgaccggcggtcttacccttggagccttcaccgcggcccacacgggtgcggtccttcttggcacccggggcgggcttcaggtcgtgcatctgcaggatttcgttatctgccataatcagtcaacctcctcaacggtgaccaggtgacgcacggcgttcaccagaccacggttggccggggtgtcctcgcggacaacggtcttaccgatcttgttgaggccgagggtcttgacggtggcgcgctgagccggggtacggttcacgatgccgtggtgcagggtaatcttcaggttcttagccatgagtatcactcaccatccttctcttcggcggccttagcggcagcagcctcttcgcgagccttgcgagcctcggcaatgccggcggcgcgggcgcgcagcagagcatcgggagcgacctcgtcgagcgccaggccacgacgggcggcgatctcctcgggctcttcgagctgcttgagggcgtcgacggtagcgcgcaccacgttaacggcggtggcggagcccatcgacttggtcaggacgtcggtgatgcctgcgcattccatgacggcgcgcacggagccaccggcgattacaccggtacccggggcggccggacgcagcaggacggtgccagcagcgtcgtgaccctgaaccgggtgggtgatggtgccgcggacgcgaggcacagagaacatgtgcttcttggcgtccagctggcccttggcgatggcggccgggacttcacgggacttgccgtagccgacccccacggtgccgttgccgtcgccgaccacaaccagtgcggcgaagctgaaggtacggccacccttgtgggtcttggacacacggttgatggtcaccacgcgatcgagcagctcgtcgccgtggttttcttcacgacggttacgacgctcgccacgacggccttcaccgcgctggccacgacgacccttgcggtcctcgttgttggattcggtcgccacagtgttctgagtttcttcagccacttgggtttccttcgtttcgttgtcgctcacagtgcaagacctccctcgcgggcgccatcagcaacggctgcgacgcgaccggtgtacttgttgccaccgcggtcgaacacgactgcggtgatgccggcagccttggccttctcggcgatcagctcgccgaccttcttggcggcctcagtcttggtgccttcgaagccggcgaagtcggcctgaagagtggaggcagacaccagggtaatgcccttggtatcgtcgaccacctgagcaaccatgtgacggttggagcgggtgaccaccaggcgcggacgctcgggggtaccggagatgcgcttgcggatacgcgcgtgacggcgcttgagagctaccttcttgccttttccgagaatagcaacgctcatatcacttaccagcctttccagccttgcgcaggatgcgttcatcggagtacttgatgcccttgcccttgtagggttccggagcgcgcagcttgcggatgttggcggcaacctggcccacgacctgcttgtcggtgccttcgacaaccacgtggttggcgtcggtcaccttcagggtgatgccttcgggcgggttgacggtgatggtgtgggagtagccgaggaagaactcgatgccctggcccttggcgacggcgcggtaaccggtgccgacgatctcaagagtcttggagtagccatcgtgaacacccttgaccatgccggccatgatggaacgagccagaccgtgcttggcacgggtcggacgcaggtcatcagcggcggtcaggacaatctcgttgccttcaacggcagcggtgatgccttccggaaccacgtaggagtcagaacccttagcgcccttggcggagaagttctggccttcaatcttgacttcaacgccagcagggatggcgatggggagcttaccaatatgcgatgccatgtttcagctctcctttctcaccacacgaaggcgacaatttcgccgccaatgcctcggtcgaggcattccttctgagtcagcagtcccgaagaagtcgagatgatggcgatacccaggccaccgagcggcatcggcagggagtcggacttcgcgtaacgacgaaggcccggcttggagatgcgcttgataccctgaatggaacgctcaccgttcggaccgtacttgagggtgacctcaagagtctggccgaccttggcttccttagcggtgaagtccttgatgtagccttcacgcttcaggatctcggcgatgttcgccttgaacttggagtacggcatatccacggtttcgtgcttggccgcgctcgcattacgcagacgcgtaagcatgtctgcgatcggatctgtcattgtcatttgggcttgttgccctttctcgctatggtttccgccgccctcacgcttcttctagaagcgttcgggccgcggaccttcagcgtcgatgtttaccaactggacttcgtaacgccgggcagttcaccgcggtgagccttctcacgaaggcagatgcggcacaggccgaacttgcggtagacggagtggggacgaccgcagacctggcagcgcgtgtaagcgcggaccttgaacttcggcttgccggccgccttgttcttaagagcggtttttgccatatcagttctccttgaaggggaagccgaggtgcttcagcaacgcgtaagcttccttgtcgtccttggtggaggtcaccacagtgatgtccataccgcgcacgtgatcgatcgaatcaggatcgatctcgtggaacatggactgctcggtgagaccaaagttgtagttgccctggccatcgaactggtggccgttgatgccgcggaagtcgcggatacggggcagcgcgagggtcagcagacggtccaggaactcccacatgcggtcgccacgcagggtgacgtacgcaccgatggcctggccttcacgcaggtggaactgcgcaacggacttcttggccttggtgatcttcggcttctggccggtgatcagggtgaggtccttgacggcaccttcgatgagcttggagtcgcgggcagcggcaccaacacccatggagacgacgaccttctggacacgggcaacctgcatcgggttggagtacttgaactccttctcgagctcaggaatgatctgctcgttgtacttgaccttcaagcgcggggtggccggcgcttcgacagtagtatcggtcatgccagctcctttccggacttcttggcgacgcgcacgcgcacggtcttcaccttgccgtcacgcgcctcttccttaacggtgatgccaacgcgggtcggctgcttggtctccgggtcgatgaccatcacgttggagcgatggatcggagcctcagtggagacgatgccagcctgctggccctgctgcgttgcacgcacgtgcttcttgacgatctgcacgccttcgacgattagtcgatcgttggagagcacctgcttgacggtgccttccttgccgcggtccttgccgcggatgaccttgaccaggtcgccgctcttgatcttggctgccatgtcagatcacctccggggcgagggacacgatcttcatgaacttgtgctcgcgcagttcacgaccgaccggtccgaagatacgagtgcccttcggttcacggccggagccgagaatgacggcggcgttctcgtcgaacttgatgtaggaaccatccgcacggcgggattccttgacggtacggacgacaacggccttaaccacgtcgcccttcttgaccgacccgccaggaatggcgtccttgacggaggcgacgatcacgtcgccgatgccggcatagcgtcgcttcgatccgccgagcacgcggatggcgaggagttccttcgcacccgtgttgtcggcgacatgaagccgcgtttcctgctgaatcattgattctccttagccgagctggttctccccatttaccggggcatcgtggttgcccataatgccccggtaaatggcgagccttgccgaactttacttacttggcgcgctcgataatggattcgagacgccagcgcttggtcttgctcagaggccgagtttccataatactcacgaggtcgccaatgtgggcgtcgttgtgttcatcatgggccttgaccttgctggtggaacgaacgaccttgccgtacagcgggtgggtcgaacgctgctcgagctcgacggtaatcgtcttgtccatcttgtcggacacgacgtagccgcggcgaaccttacggaagttacgctcttcagccataatcacttctccttggattcggtagcggccggctcctggctgatgccaagctcacgctcgcgaagcacggtgtacatgcgggcgatgtcgctcttgacagccttgagacgggcggtgttctcgagctgaccggtggcgtgctggaagcgcaggttgaacagctcttccttggacttcttcaagaagccttcgatttccgcgttggtcttctcgttgagattcttgatggagtaatcagcggtaccgactgccatcagatatcaccaccttcacgtgcgataatgcggcacttcatcgggagcttgtcgatagcgcggcggagggcttccttagcgacgtcctcggacacaccaccgatttcgaacatcacgcgaccagggcgcacgttcgcaatccagaactccggggcacccttaccggaacccattcgggcaccgagcgggtgcttggtcagcggacgatccgggaagatcgtgatccacacgcggccaccacgcttgatgtagcgggtcatggcgatacgcgcggcttcgatctgacggttggtcacgtaggccggggcgagggactggatggcgaaatcaccgaagttgatctcgttgccgcccttggacatgccagaacgcacagggcggtgctgcttgcggtacttagtcctcttggggataagcattcttgctcactccttcgtttctgcagccggagcggcctcggcgggagcctcagccttgggggcttcggcggcctgcggggcggcggaacggttgccacggcgcgggcggcgatcgccaccacgacggcccggacggttgttctgctgagcctgctgctcttcgaactcggattcggtcatgtcgcccttgtagatccagaccttgacgccgatacggccgtacgtggtcttggcctcgaagaagccgtaatcgatgagggcgcggagggtctgcagcggaacgcggccctcacggtagaactcggaacggctcatttccgcaccgccgaggcggccggagagcttgatgcggatacccttggcaccggcgcgcatggcgtcctgctgggccttacgcatggcacgacggaaggtgacgcggttggtcagctgctcagcgatgccctgagcgacgagctgggcgtccagcgcggcgttcttgacttcgaagatgttgagctggacctgcttgccggtcagcttctcgagcttggcgcggacgcgctcagcctcggcgccacgacgaccgatcacgatgcccggacgggcggtgtgaatgtcgacgcgaacgcggtcgcgggtgcgctcgatgacgatgcgggacacgccagcgcgctcgaggtccttgctcatctccttgcggatctgatcatcctcaagcacgaagtcgcggtagcgttcgccggccttgttggagtcggagaaccacttggagcggtggttctcagtgatgcccagacggtagccaaacggattgatcttctgacccatctttagcgggctccttccttgttagccacgacgaccgtgatgtgggaggtgcgcttgttgatgcgagcagcgcggccctgggcacgagcgcggaagcgcttgagggtcacaccttcgtcaacgtaggtctccttgatgtacaggtcgttctcgcggaacggctcgccggccttgtcggccttcacacgagcgttggcgatggcgctctccagggtcttgcggaccggcagggccgcagcctgaggggcgaacttcaaaatggtgacggcttcggtcgccttcttgccgcggatgaggtcgaccatgcggcgagccttgcgcggcgtcacgcggacgtgacgagcgattgctttagcttccatgttctattccttatccttagcgacgggccttcttgtcgtccttcacgtgacccttgaaggtcttcgtgggggcgaactcacccagcttgtgaccaaccatggcctcggtgacgaacaccgggacatgcttgcgaccatcatgaacggcgaaggtgtgtccgatgaaatcaggggtgatcatcgaacgacgagaccacgtcttgatgacgttcttggtgcccttctcgttctgctcgtcgactttcttctgcaagtgggcgtcgacgaaggggcccttcttgatgctacgagtcatcttctcgatactcccttacttgcggttcttgccggacggacggcgacgaacaatcatcttgttcgaagccttcttcggacgacgagtacgaacctcgcccttgccccacggggagaccggcggcttaccaccgcgggtacgaccgccgtgcgggtggtcgaccgggttcatggactcaccacgggtgatcggacggcggccgatccagcgggcgcggccagccttgccgagctgaatgttggcgtggtcctcgttaccgacctcgccgacggtagcgcggcagcgcgcgtcgacgttgcggatttcgccggacggcatacgcagctgagcgtaggcgccatccttggcgacgagctgaacggcagcaccagcggaacgagcgatcttagcgccgcccagcgggcggagctcgatggcatgaaccacggtaccggtcgggatgttcttcagcggcaggttgttgcccggcttgatatcagcctgagcaccggtctcgatgacgtcgccctgcttgatgcccttcggcgcgatgatgtagcgcttctcgccatctgcgaagtgcaggagggcgatacgggcggagcggttcggatcgtactcgatctcggcaaccttggcgggcacgccgtccttgtcccaacgcttgaaatcgatgagacggtactgacgcttgtggccgccgccgcgatgacgggaggtgatacggccgtaagagttacgaccgccggtcttggacttcttgcgaaccagcgacttctcaggcgtagaacgagtcagctcggagaaatccgagacggacgcgttgcggcggcctgcggtcgtcggcttataaacgcggatagccataatgtagttcttcctttaacttttctcggctaaccttcagttaccaaagatgtcgatcgtctggccctcggcgacggtcacgatcgcacgcttctgggaagcgcgctggccgaaaccggtgcgagtgcgctgcttcttgccagcgcggttgagggtgttgacgttcgtcaccttgaccttgaagatctcttcgattgcctgcttgatctgcaccttgttcgcatccggagccaccacgaaggtgtactggccacggtcggaagcggcgtagctcttctcggagacgacgggcttaagaatcacgtcgtgagcgggcttgtgaatagcgaccatctaaatcaggcctccttcggctcggtcttggcagccacgaaagcctcgaaggcttccttggtgaagaccacgtactgcgaggtaatcacgtcgtacgtgttgagctgatcgacgaaaatcgggtgaacggtcgggatgttgcgcacggagagccactcgttgatgttgtcgcgagtgaagacgaccgtggtgaacttgtccgcggtaatcggggccagagcggcgacagcggccttggtggacggctcggtgataccgaactccaccacggcaacgcgaccggcgttggcgcgatcggacagggcgtagcgcagagctgcggccttcatcttcttgggggtgcgctgagagtagtcacgcggctgcgggccgaacacggtgccgccgtggtaccactgcggtgcacggatggagccctgacgagcacgaccggtgcccttctgcttccacggcttcttgccgccgccggaaaccatgccacgagtcttggtggcgtgggtgccctgacgagcagcagcgagctgagcggtgacaacctggtggatcagcgggatgtgagcctggacatcctcggcggaaacgccgaagagagcctcaggagcttcaacggtgccggtggcctggcccttggcgtcggtgacgttcagagtaacgtttgccatggtttatcaggctcccttcacagccgagcggacgagaacgatgccgcccttggggccaggaatggcgcccttgatggcgaggatgccgttctcgacatcagcggagacgacggtcaggttctgggtagtggcggtcacatgacccatgcggccggccatacgcttgcccttgagaatacggctcggagtggcgcatgcgcccacagaaccgggacggcgctcgttcttgtgagaaccgtgagtacggcggtaggacttgaagccccaacgcttgatggtaccggcgaagcccttacccttggtggtgccggtcacgtcgacctcagcaccctcttcgaacaggtcagcggccagttcctggccggcctcgaactgatcgacgtcgtcggtgcgcacctcgacgaggtggcgacgcggggtgacaccggccttagcaaagtggccagccagcggcttggtcaccttggtgggatcgatggcgccgtagccgagctggacagccttgtagccgtcagattcctcggtcttcacagcggtcaccacgttggtggacacgtcgacaagagtgacgggcacgaagaagccgttctcgtcccacacctgggacatgccgagcttcttgcccagcagagccttgcgattagacataatgcttcctcctcccttacagcttgatttcgatgttgacgtccgcaggcagatcgatgtgcatcagggagtccacggccttgggggtcgggtccacgatgtcgatgaggcgcttgtgagtgcgcatctcgaagtgctcgcgagaatccttgtacttgtgaggagaacggataacacagaagacgttcttctcggtcggcagcggaacggggccaacaacagttgcgcccgcgttcgtcaccgtttcgacgatcttcttcgccgattggtcgatgacctcgtggtcataggacttaagcctgatgcggattttctgtcccgccattgccgtccgccctttctagcgatgttcgttgtactgtttaccaacctgcttctagggcaccggcgcgcatggcctcccttggacatacgtcctctggcggtcatccgacatcagtgcgcggtttccggctgtcacttcacttgaagtggctcccggcccgcgctcgcttttttaattccaatttgcgagcccaaatcaggcaacttgtttattcaagcattgaggtgggacagtggagttcgcgcgtgtcgcgctcatgccgttcgtattacctcgcggcatagccgctcggcgtctgttcgattgtcgcaatgcaggtctcacatctttcttattgagaaccattcgctgcgatatcatgacagatatgacttcccgccgcaagactcttaaacgcgattggttcgacaaccaacctggcgcatgggtaatggttatgctgcccgctgtggctggcttctttatcggcgggcctaatcttgatacgctttggctattggcgacgtgggccgtgtgctattgcgtgcagttcagcgccgcgcactggttcaaagcacacttttcacgccgttatctgccgccgatgctcacttatgccgtagcgctcatcgtcatcggcttgccattcctgattacgcataccggcatactgcgttgggctcccttatatatagtgctggttgcgctgtcgatgctgtcctcgtggctgaggaaggagcgctcgctgtggggcaatgccgtgtcggtgattgccgcgtcggccatggccacggtgatcgcgtcgtttggcagcactgttgagacggcatgtgttatgcccatcaacgcagcacatgcctcgtgcgcagccgctgatgtcaccgccgcacgcaccgcgattcggaatatgccagatttgagccagatattcgaccttcacgcctggtggcccgcgggttcattgcccgtgagcgggctgattgccaccgtgctgtttgcgctgacgcagtatgggtcggttttggtggtcaaaaccatgatccgggaacgcgggaagtgttcatacgtggcggcttcgtgggtatggcatgtggcgctattgctgctagccgccgtgccgtctggacgcagtccgtatctgattgcgatgactgtgctgctgttggcccgcgccgttgcgttgccggtggttacacggcgcacaaccttgaagcccgtggtgaccggcattaccgaggcgtttgccagctttattgcttttggctgcattattgcggcgatttagcgacgcttcagcgattccatggggtggtaattacctcatggggcggtaattggcccatggggcggacggtaaaattttaccttccgcagaatagagccgttttcgtacaccgccccatgggggttttcaccgccccatgggcaagttaccgccccatgagtgggttaccaccccatggaggtgtacctgctggctgagggagcaccacatatgcaaaggagcccggcccctgtaatggggtcgggctccttgtgtcgcgctatgcagccactaagctgcaacaccgcggttggtggctactgatggtgccaccaaccacaaaccgcctgcaatcaacgctcggaggcttcctcagtggcggcctcaccctcgcgctcgatgcgcagcttgtggccttccgcctgggagacaccgtagtaagcaccgacggcgatgtccttcatgtcgttgatcagcgggatgcgcgggttggccggggtacactggtcctcgtaggcgcgcatgccgatctgatcgagcacggaccagaagtagtcctcgtccacaccgcaatcctggaagctcttgttcatgccgagcttgttgtcacggtagtcctcgacggccttcgccaggttctccacggcttcggccggggtcttgccggtgtcgatgccgaggttgcgggcgatatcctggtagcgttccggggcgatgtacttgttgtacttcggccaagaagtgggctcctcaggaatctggccgttgtaacgaatcacgtacggcagcaggatggagttggtacggccgtgggcgatgtggcacagggcaccgatggtgtgggccatgccgtggcacatgccgaggaacgcggagccgaatgccatgccggccatggtggcggcgttgtgcatcttctcctgagcgttggtcttggccaggccgggctcgccattgacggactcagccaggttgtcccagatgagcttggccgcgtgcagggccatgccgtcggtgaagtcgttcgcgtacacggacacgtaggcttccatcgagtgggtcagggcgtcgaagccggcgtcggaggccagcttgcgcggctgggtgcgagccagcaccgggtccacgatggccacggacggggtcagcgcgtagtcggtgatcgggtacttgtagccggtcttgtgatcggtgatcacggcgaacggggtgacctcggaaccggtgccggaggaggtcgggatgcacaccagcttggccttcttgcccagcggcgggatcttgaaggcgcgcttacggatatcgaagaacttctcgcgcacgtcggagaaggcgatttccgggtgctcgtagagcagccacataatcttggaggcatccatcggggagccgccgccaaccgcgatgatcgtgtccggctcgaactcctcgcgcatcatctcagcgcccttttcgacggtctcgacggagggctccggctcgacgtagtcgatgatgcggaaggtcacacggttggagcgggcgcgcagctggtcgatgatcttgtcaacaatgccgagctgctccatgaccttatcgcacacgatgacggccttctcgatgccgtacatgtcgcgcaggtacttgatggcgttcggctcgaagtaggtcttggccgggatcttgaaccactgcatgttgttgttcctccgagcaatgcgcttgatgttaacgagattcacggcctgcacgttgccggacaccgagttgccgccgtaggagccgcagcccagggtcagcgacggggcgatggcgttgtagatgtcgccgatgccgccaagggaggaaggctggttccagatgatgcggcaggcgtgcatacggacgccgtactcacgcacgagctcctggttgttggtgtggatggcggcggtgtggccggcacccagcttgagcatcttctcgcacatctcgaaggcctgctccttgttgtcggccttgagcacggcctgcaccggagcgagcttctcgtgggtcagaggctcgtcgtcggagacttccttgcactcggcggccagaatggtggcgtcggacggaatctcgaagccagcagccttggcgatgaactgcggggacttgcctggcaccgcggagttcagcacgggcttgacgccggaaccggcagtgcagccgaacatgtactgttccagcttggccttctcttcggcgttgacgaagtaggccttacggaccttgagctccttgatgagctggtcgtagacgtccttgtgggcgatgatggcctgctcggtggcgcagatcatgccgtaatcgaagtgcttggagagcaccagatcgttggcggcgcgcacgatgtcaacatcggtgtcaacgtaggccggggcgttgccggcacccacgccgagggcgggcttgccggaggagtaagcggccttgaccatgcccggaccaccggtggcgaggatcgtggccacgcccggatgcttcatcagggcgcctgtggcctggatggacgggtgctcgatccactggatacagttctcgggagcaccggcttcgatggcggcgtcgcgcacaatcttggcggcctcgacggagcacttctgcgcgccggggtggaagccgaagacgatcgggcaacgggtcttcagggcgatgagggacttgaagatggcggtggaggtcgggttggtgaccggggtgacgccggcgaccacgccgacgggctcggcgacctcatcgatgcccatcacatcgtcttcgcggatgatgccgacggtcttctggccggccaagtagttggtgacgtgctcgcaggcgaagatgttcttggtggccttgtcttccacgagaccacggccggtctcgtcgacagccatcttggcgagaacgaggtgcttgttcagagcggcgatggaggccttggcgacgatacgatcaacttgcttctggtcgaggttctcgaattcgacgagagccttcttggcgcgggcaaccagcgcgtcaacttcggcctcagctgcggcctgcttctcttctggagtcggcttggtagcttcgaccttcttctttgcttctgccacttggggtcctcctcgatcttcttggggtatatggcaaagttctgggccatcgcctcgtcacctcagttgcaccagcgggataccgcctcagtaaccgaaaatgaccggtgatgcgttgtcacattgcatatgtgacctgaggcacaatatactgaacggtccggcgcgacgcatacgcacaaaatcgacggcgtttcacgtgcgatattgaacagtttttgttacgagttgtgcgaaatatcgaacaaatcctcactctatccggcgatttggtactttttgttcactttttaccgaaaatcacatgcctgcaaacaacacaatccgagaacttttttaaagtaagttttcaaaagcaatcattttctccacatttctagaaagttggtttaaaaaagtacccaaaatcgcctacaaatatacgattgttgcctcataacctccgcgtcgaggcacatgaaagccactttcataaagtaaacttgcatatatctcatcgcacaaaggggtaaacatgagggcaatgccatcgaccgcagtgaaagcgcacaaccgcagtgccatggcccagtatctgtatggccatagccatgtcaccaagcaggaactggaacgcgaactcggcctcagcctgcccaccatcacccaaaatctacacgcactagaagatgacggactcatccgcaaaggcgaactgcaggattccaccggcgggcgcaaggcgcaaaattatgagttcaatcccgatcatcgcactgccatcggggtagtgatgcggtccaacgaactgcgcctgtgcgcgattaacctgtacggcaacgtcatcgaaaaacgcaacgatgccctgccttaccgcaacaccaacgtttactaccagcgtatcggcggcatcatcaacaacttcgccgccgacgtcgaaaagaagcacggcaaggtgctcggcgtctcgttcgccatccaaggcatcctctcccccgacgccaccaccatcatcttcggcaccattatgggcaacactgggctcacgctcgaaaccatcagccaatcggtccattacccgtgcatgatgatccacgattccgatgcctcagccatggccgaactctggttcgactccacgctcaccgatgcggtgtgcgtctatctggagcgacgcccgggcggcgcggtgatcgcggggggcaaactgtatcaaggcccgaaccagtgcaacggcgccatcgaacacatgacgctggtgccgggcggccgcgaatgctactgcggccagcgcggttgcatggacacctactgctcgccggagaccttgcccgaggattacgaaagcattcccggcttcttcagcgtgcttgagcagggcgaacggcatcatcgcgagcgcatggatgagtggctggattacgtggcgcaggccatcgtcaacgcgcgatccatcatcgcgggcgacgtgattgtcggcggtgaagcagcccagcatcttgaagacagcgacatcgaggatctgaagacgcgcgtcatcgcacgcagcccgttcggcaccgaccatttcaatctgcgcaagagctactgcgccgaagatcagaacatcatcggtgccgcgttgcggttcgccgagaattatctcgacggcatctgcggtgctgcggaacgcggcaggaaatcaagggcttccaccaaaagtgacaacacgtctacaatggaggtatgaaaaacccaccgttgcatcgttacgccactcgcccagggctgtacttcactgacgacggtggggctgacgtcgttgttcgttccgaaactgccgatcaggtttggctgtgtgtactggagcccattgatgagcccagcgctttcttccaagacgccatccgcctgttcgaggacccgaatatctcctttatccagcagattcatgagttcccggtatgcacacgcattatcgaacatttgtatctgcgcgagaccttgttccgcatgaccgggccgaactacggcctgtggtacgtgcacctgcccaaagcatgggacggcatgcgttatggctaccgcgtggacggcgcatgggacccgaaacacggcgtgcgcttcaatccatacaaattcctgcttgacccgtatggcaagggcatcgacggctccatggagctcacccccgccgccttctcctatgaatgcgatgtcgtggaccgcaaggtaatcggctcggcatacggtgccatgagcaccgtagactcgctcggccatatgccggtgtccgtggccatcgacgatcgcgatacccataagcatgagggcgacccgcagcacccgcatgtgccgtggcgcaaaaccgtcatctatgagatgcacgtcaaaggcttcaccgccaacgcaccgtggctgcccgaatcattgcgcggcacgtacgccggactcgcacaccccaccacgctcgcctatctgcagggtctaggcatcacatccatcgaactgctgccgattatggccaagcaggacgagctcttcctgcaagaacacagccgcaagaactactggggctactccaccctcagctacttcgcccccgaaccctcctacgccactaaagccgcccaggagaagggcgcggccgccgtgcgccaagaagtcatagacatggtgcgcgcactgcacgaggccggcttcgaagtcatcatggacgtggtctacaaccacacatgcgaaggcggcgtcgaaggcccgacggtctgctggcgcggcctcgacgacctggcctactatcgccatcaaaaatccaataccggccgactcgaagacaccaccggttgcggcaatacgctggacttcaccaacacgcatgtggtcacctttgccatcgactcattacgatactgggccaagcgtatcggcatagacggtttccgcttcgaccttggcgtcacgctggcccgcctggaaggcgaattcacccatcatcacccgttcctctacgccctgcgttccgatctgctgctgggcaacctgaagctcattatggagccgtgggatctgggcaacctcggctggcgcaccggccaattctccgtgccgttcgccgaatggaatgaccgcttccgcgatacggcccgcaccttctggcttgaggatgtggacggcggctccgatttcgggcgtatcagtttgcaggagatgtccacgcgactctgcggctcggccgatctgttcgccaccgaaccagggcgtggcgctccggcctccatcaatttcgtgtcctgccacgacggtttcacgctgacggacctcaccagataccgctccaagcacaatgaagccaacggcgaaaacaataatgatggctcgtcggtgaaccattccgccaatttcggcgtcgaaggcgtcaccgatgatccagacgtcattgcggcacgcgaacaggcggccatgaacatgatcggcatgctgctgctctcgctgggtacgccgatgatgctcgccggcgacgaattccgcaacacgcaggacggcaacaacaacgcctactgccaagacaacgacatcacgtggctgaagtgggattggatgtattccaccaacaagacgcgcgaaatgcgccgcttggaaaccgtgtctcgactggtggcgctgcgtaaatcactggacctgtatcaccacgaggatttcttcacccgactgacccagatcggcctactcaagccctcaagccgcgtgcagtggttcctgcccgacggtaccacgccgatggagcgtgactggttcgatctgggcgtacgtagcttcaccatgcgattgctgtccaacagtgaggtggacgtgtgcattgtggtcaacggcaccgctgacgaccgcacattccgcctgccgccagacacccactggacgcctaaatggtgctcggccgaaatcaacggccgccgagccgggcatggcactcaggtcgaggaatgcgatttgaacggtgacaccaccgtctggacgcagcatgtaccggacgccagcgagacagtactcaagatggtcgaagaagtggccatgcagcgtacggaatcctcgactgagaatgaagcggataccatcaaattcgcgatgccagtaacagatcacgccgcaaacggcacctcgtccgcgcctcgggatgaggtatcagctgatatgcccgatgcccctgtggatgatacaccggacactcccgtcgacgacaatgtctggaccatgccggcgctgagcatcacgctgatgaagcaggtgtgagtcacactcaagacatcgcgacacaaacacaaaggctctccgcggaattccgcggagagcctttgtatgctcggtacaggacaagcgaaattaacgcttggagaactgcggggcgcgacgtgccttgtgcagaccagccttcttgcgctccacgacgcgagcgtcgcgggtcaggaagccagccttcttcagggcggcgcggttggcatcacgatcgatggcgttcagagcgcgggcaacgccgaggcggatggcgccggcctggccggtggtgccgccgccgtcaacgaggacgatagcgtcgaacttgccttcgagcttgagcagaacgatcggggagttgacctcacgctgcagcagcttggaggggaagtactcctccagagtgcggccgttgatggtccacttgccgtcacccggaaccagacggacacgggcgacagcctccttgcggcgaccggtgccgtagcccggctcaatcgcggaggtgccggtgccagcgccagcgttggtctcggtggtgtagttggtgagctcctcttcggtctcgacaacctgggagtcgttggtgttttcagccatgattcttatctcctctcaggtttcacttggcctgctgcgagacctgggcgatctcgaagacctggggcttctgcggggtgtgcgggtgctcggcgccacggaagatacgcaggcggtcgagctgcaccttggccagacgattcttcggcagcatgcccttgacagcgttcttgatgatgcgctcggggttcttctcgagcagctcggcgtaggagtcacgacgcagaccaccaggacggccggagtgcgagtagagttccttgcccatcttgttgccagtcagagcaatcttgtcggcattgatgatgatcacgtggttgccggaatcggcgtgcggagcgtaggtcggcttgttcttgccgcgcagcaggattgcagcctgggtggcgagacggccgagcaccacgtcggtggcgtcgatgacgtaccagtcatgagtcagatcagctggcttcggagtgaaagttttcactggattaccttttctatattgtgttccgggtctcagctgcttggtgtggcttggtcagggccgcatccaagaggcgtcgaacctcattatccgtgggctccctgaaagtcctcgatggcgagtgggatagcgctttgaaggaccccttagggaaacacaacaatccactagtatatcgccgggcttgacatagggcaactggggacactccattgggtttatggcttctcttcccctatttatggtttctctcccacccacttcggctaaccgactcacctacggtgaggcaattccctgccttctctcagctatcgcttctttcaggcctcgtctacggacagtccactggactgtccgcttaacgactcggctcgtcagagggaggtaaagcgggtcaggaattgaagatttgggcgaagcgttgggcaccgggggtgtcgaagagggtttcgagcggtaccacgttgcccttggcgtcggccagtgggatgcgccagttcgggtattcgttgttggtgcccggctggttctgcgcacgcttctcccccaccgcgtcggtgatcgaggcggcgagcagcttgcacggcgaacccttcagtgcgtggtacagcgcgtcgacgatatccgcctcgtgatcctcacgatgttcggcaaagtcggcatcaagataaccctgctcgaccagcatggccagcatcgcatcctgctcggccttggcggaggcttcgaattcctcggccgggccggtcagcaagcccagacgctcacgaatcttgacgtgctcgtattccaggtaaccggcggccggcggcaaatcatgcgtattcacggaggccaatgcatacggacgccactgggagggggcgcggaacacgccgtcgcactgctcgaaccattcaacggcgcaaccgagaataccgtggctcgacagggaatcggccacatggtccggcaccacgccgaggtcctcacctacgaccacgccgccggcgcgagaggcctcgatggccagaacgcccagcatgatgtctgagtcgtagtacacgtaagcgccatccatagccgaacggttctcgggaatccaccacaggcggaacagaccaaggatgtgatcgatgcgcaccgcaccggcacgggcgaacatgccatgcaccatattgcggtaggcctcgtagccggtggtctccagattgatcgggctcagcggcggctggctccagttctggccttgctggttgaacatgtccggcggtgcgccgaccgtggctcccttggcgaagcgctcgggattccaccacacgtcagcgccggaggggtgcacgccgacggccatatcggacatgatgccgatatgcatgccggcgtccttggctgcctgttgggcggaggacagctgctcggcggcaatccattccagccagcggtagaagtccaaagtgtccgggtactgcttgcgcagattggcgatttccggggagttgcgattgaacttgcgctcccagttgctctcctcgccgttgggcgccccccacttgtcgtagcacaggcaccacgtggcatacgcctccaagtcggaaccacagtccgccttgaattggtcgaatacgctttggcgttcggcggtacggccggccttgaagataatccacagggcgtgcatcttgctgcgccacatggcgtcacggtcgatgagctgggaatcaccgttcagcggttcggtgtcggcatgcagtccgtcgacggcattcttgtcgccctcgctgagcgtggcatattcggcgatcgcctcaggacggatgtacgtgaagttgatcaggcgacggcttaccggcagatacggcgacggggtgagcggggacaccggctcggcggcatgcaccggattaatgagcacgaagtcggcaccggtcttctgcttggcgtccaccagcatggtcttcagatcctcgtaatcgcccacgccccaggagttggaggagcgaatcgagtacagctgggccatccagccccacagactgccgcccttcatcgggtcaagcagatcgacgcgatcaggtgcactgatcaaagtggcgtcttgcacacggtcggcgaccttgacgtgcagcgtatggtaaccaatcggcagatcggcgggaatgaccacagccgcattcgaaatgaacgtaccatccaagtcgtaggcctgggatccatctccaggaccaacttcaatggtgccttgatatggctcgccattctccagcgtgatgctcgccgaaggcacgtccagaataccggtgttcaccagcacccggtcctcgctaccggcgatatgcagcacggtgggtgccaccaatcgggcgtaacgctcgttcagaatgcgtcggatggcgatgagttgggcgctctcgctggaggcgtcgatgcccagcgctgccagcacctcgatcaggacgtcatcgtctatctcgtggtagtcatggctcatgcccaaataactcgtgccgacaccgaccaacttggccagtcgaatcaacggacgggccagacgctcttcactctcggtaatctcactcatagccccagtctaacgccgtttgattgcgccacaccgtaagaaaaatgccatgattccgccaaattatgtactttttaccctcacatagtgagatgtgagcgctcacaatggtggacagggggtgattgccggccaaatttgcgcggcaaaacacagcaatagtgtgcttagcggcggctttccacggcgtgccgcacctcagccgaggggtcgttggccaatttggcaagcatcgcttcggacgtattggggttcagtgccacggcacggcggaccatcgaagaaagcaccgccggtgctccctcttcggattcggtgccaagtacgcccaagaaatccaatgtctccgcatccgcagtggggtcctgcgcaccctcaagccgcatcttccagctggtgcgcttgtttttcaacgccgtatcccggaccgcaggcaccgggtccttggtcagacggccgaccagccaattcttgtcgtccccgttggcggccacggcttgacgcacggacggttcggggtcttcggagagtttgaccaatacgttcgggaacggcatggtgtcggcgaggaacacacgatcggccaccggggtgtgcgggttgccggccacagcctccaaaagtgcggtggcgcgggagaacgccgcctgatcggcacggtcaggcaacggccgacgggcgaattcggacagttcggccgggtcggtggaatggcgcagacgctcgtatgtagcggtcagcggttcgaaatccaccggagctgcggactcggctgcggactgcgcgccttggtcctgctgctgggcgtccgtgtcggttgcagtctcggccgcggcctcggttgcggcctcggtgggctgggtctgctggctggtggtgttctcgtcggtcatgatgcccagcttagtcatacaggcgtcacgcgagcggaaccggaatgttgaccatgtcaatcggagccggcaccacagcggcattgaacgcttcccgcacacgctcctcgaatcgcgcgcaatcatcctgcggcaccaccgcggtcaactcgacgttcaccgcatacgattcatcctcctgactgccaccaagctgcgccaggatctgctggaatcgggccaactgcgggtattcgaggcgaacccggtatcgcttggcggtcatgatgcgggcggcgcgggcggctttcatcgccaatgatgcggcggatgagtacgcgcggaccagcccaccggagcccagcagaataccaccgaaatatctggtgacggcaaccacgcaatcggtggtgcccgactgcttgagtacgtcgagaatcggcttgccggcggtaccggacggctcgccgtcatcgctcatgcgttcggacagtcgcccatccgcgcctccgcacacggcggcatacgccacgtgtcgggctttcggatgctgctcacggatcgcagccacgaacgcgagcgcctcgtcgagcgtatcgacatgggcggcgtcgccgataaattcggactttttttcgacgagcgaatcgtgggcaggatcgtcgggcgtgttgagaatcgtctgcatgagcgtgttccggtggtcgactggctgggtgttcgattgagcgcgaggctaggcagggctatcagcgttcggagacgacgacgttatagtcttcgccggcgaagtaggcggtcaggcaggcgatcatctggcgggtgagctccttgaacgcgccgtcggcacgccagccgacgtgcggggtcaggacgatgccgggcacatggcagatggcgtcgtcggcggtcagcggctcatggtcgaacacgtcgagtgcggcgggaacatcgcccttttgcagtcgggcaagcagcgcaccggattcgatgacttcggagcgggcggtgttgatgaacagggtgccgggcttcacatgcgcaaggttctcggcggtgacgatgccgcgcgtggcgttgttcagcggcagatggacggagatgacgtcgctggtttcgatgagcttgttgagatcgtcgaccggagtggcaccggagcgttcgaaatgctcgggcggcacatgcgaattccatgcggcgacctccatgccgagggcgcgggcgatgccggccacggtggagccgatgccgcccagtccgatgatgcccatgcgacggccggcgagttgcagtccatcgccgctggtccacgcccagttgccggccttgacgtccttatcgagttggccaacgcggcggatgagctcgaacagaagggcgaaggtgtgctcggccacggcgtgatcgccataatgttcggcgttgcagacgcggatcttcagctcgcgcgccttatcgagattgaggtagctggcgacgccggtaccgcagaacacgatgcacttgacgtgcccctgcccgctgatggtgcgcagcagatcgtccgaaatgtggtagccgcccaccagcagggcgtcggcatccttcagacgctcggctatggtcgcctcgtcggacgtgaattcctcgaacatacgcacgcgggcaacgtcgtggagcgcggggaactgggccttgatgggctcgatcatcgagtcaagcacggacggcatcacgacgaggggcagatcggtgcgttcgctttgggtttcgtaaatctcggtcatgggctccacattaggaggccggcgggaaaagcgtcaccttgcggcttcccctccttgagaccaagccgagcaactattgctttgccgcctgctcctgcgtgatgttccattccttgacgacgttctggtccgcgcccatcgaatagatgacatcccagatgcgttggcgtatctgagcgtcgtaggcttcgtcccaacatgtgcctatgggatggtcgctggatatcgggcaccattggtagttgccttgatgcacgttggcggtgggcacccaatcgatgcggttgacgcgccacgaccccttgacgcccttcttgccggcgaactggatgcgtgcggtcacaccctgattgttgaccaaggtttccggcgtgttcgccgactcggtgacggcgttgcccagaccgtagataatccacgtgccgttatagttctcgatgggctgcgcacaatggcaaccggcaccgtaaataacgtcgaaggcaccagtgtcggcaagctcatgggcttccgaaatctgccaggaatcggcgtaatcaaggtattcctgcaccgagtgcatggcgatggccaccacatcggcaccttgctcgcgggccttgttggccttgtctaccgcgcgctggatgtcgctgtcgtgattcgggtcgccgtcttcgcgcagacgatccacctgccagtcctcgtcggcggtcatgccgttgagggagaccgtgccggtgaccagacccagcttgccgccgccggtcggggaatcgatgaccaacggtttggtggagtcggcttcggttttgtacgagccggtctgggcgatgccattggcctcaagcgtgccccacagacgggcgatgccatccgccccctgatcccaggaatggttggtggcgtgtgtgcaggcgttgtatcccacgttgcgggcggcatccgccacttccggcggaatgttgaagatcgggtacgcggcatatgggccgccgcgctgggcgatcggggtttcgaattcgcacacggcgatgtccgaagcctgaatgtactgcttcatcggcgcgaacagcgggtcgaagttgaaggcggtgccatccgtggcgttggggttcgggccttggaaatggctccacaatccctcatggaacaacaaatcgccgttaaccagcatggcgatgcagtccgtatccgggcaatccggtgaattgccgtgatgttcggtcaccggtttgggcgtgttcttcgctttattcaacgcgacgtccgacactccggcgtgtgcggggccattgccgtccgtgcgatgggttgcgaaccatgcgccgatgcccagcgcaacggcgagcacgatcacgaacacgataatcagcgccgcacggttggttcgtgtcgagttggagcgatgttgcccctgcccagcgatatggctcatctttgcccgcccttcggaactcttcttctctctctagggtaccgcccatctcggtcaagtactgcggggagggaggcgatgggcaagcgattggacaagcaatatataaaccggttaatcttcaatcaccattcacgaacaccacgcaaaagtctcacttagtggacatttttctttcgtcgctcggacttttcccgacgtgccgcactcgttcgcccactaaaatggcggtttggaggcggacggacaatggcgtacctccgactccgcttaccacaagcggagaccgcccgtcctcggttatttcaggagttacttaacccggagtttccggaaaacaaaaaagttccgagctttcacccggaaccttaatcggcggagtcagagggattcgaaccctcgagccgtttacacgactaacaccttagcagggtgcccctatcggccactcaggcatgactccacgttacgcaataatgcgcaacagcaaattactgtaccacgtcctgcggatacggcgtgccgaacgacacattattgaacgtccgcgggtgcggcgtcgccggagaacgtaacgataaccgcgcaaatcaccaacgccacaccgacgatttcaccaacgctgggaatctcgccgaacgccagtcccacggccaccgccatggcgggattgatggattgcattaccgaaaatgcgccggatgtggtgcgtcgcagcgtgatctgctccaccacatagggaatgaacgaggccatcagggaaatcacaaacagcagagccagcagcttcagcgagccgccgggctcaagcgcccacgtggcatcggccttggggtgaaccacatgagccacagccggcacgccaaggaacagggactggaccagccagccgatggtcacggcgatgcacagattatccagcgaattgccgccagccgccacgcgccggccggtgatgatatacatgccccacatcgacccgccgatcaaaatcgcaatcagaccatacaaaaacgtgccattgccggacggattggccaatgatatgccagctaacagcaccacaccgaccgccgcgataccgataccgacccgctcgcgccagcttttgccggtaatcaccgccaccgaaagcggtcccaaaaattcgatagacacggcaatgcccatatccatattgctgatggccacataaaacagggtattcatcagcaccagcgagcagccgagcagtacgaccagcccccagctgcgggcgtcgcggtgaaacagttgcgctcgcttcgccttgttccagggcctgcgccacagcagcaacagcaccgccatgaatcccacgcgataccacaccgagtacagcggatcgagctgggtgaacgcaagtttggcgacggccgtagccaaataaatcaccagtgcctcaccaatcacgataagaaccacgggaacacggttgaggataccgaccactgccttcttcatgaggtttacgctactcggagagccgggacagcgcgcattgacttggaaggcgttacggacagtgacgcaatgtggacgattccgtggaatcgcacccaccatgcgaaacagccgcacagtgcgtaaacccttggaattccggcgatattcggcattatgacaatgagcgccgcgtcatgcgcgccacatagtgagcatgacctcgttcggcattcctacaatggtggcatgagcaccgcaccgagacttgaggccgccaaacgcgattggggccacgacgagaccggatgcaccgtgctgcatatcgacatggatgccttctatgcctcattggaggtggcgcgcaaccccgggctcaaaggcaagccggtaatcatcggcaccgggccgcgcgcggtggtgtccgccgcgagctacgaagcccggaaatacggcatcaattcggcgatgccggccgcgcgcgcccatcggttgtgcccgaacggcatttttctgccagtggatatggcgtattaccgcatgatgtcgcaccgaatcatgcatgaggtgtttttgaccgtcaccgaccggttcgagcaggtttcggtggacgagggctatatggatgtgtccgccgcactgctggagtgggggcggccgagcgcgatcggcgcgtggattcgcgctcaggtggccgagcgcttccacgtgacgtgttcagtgggtatcgcctgtaacaaactggtgtccaaaatggcctcgaccaatgccaagccggacggcatgctgctgattcccgcggcccgctcggccgaattcgtgcagatgatgccattgcgtggtattccgggaatcgggccgtctttggagaagcggcttaatgcttggggcgtgcattcggtggctgaattggctcagctggatgaggctgcattgactcgtgccactggctccccggctgcggcacgtggattatgggcggcctcgcacgggttggattcccgcgaaattaccacggtacgcgaggagaaatccattgggtccgaggaaaccttggccgaggatacacgcgatatgcgcgtggtgtgtgggctactgcgttcggcctgcgacgaagtaaccagcacgctgcggcgcaaggggctggtggcgcgcacgctgacggtgaagttgcggttcgccgacctgagctatcagacccggtcttttacgatggagcggccgaccgatacggccggcgtgctgtacccggaatgcgtgcggcagctgaaagtcatgctggggctaccggcctcggcggagtctgccactcccctgcccaaaactattcgcttggccggtatgagcacgtcttcgctcagtaaggcggcggctacggccgtgcagccttcactggatgacatgctcgaagaggccgacaatgcccgcggccagacctcacaggcgcgtttgcatgatgccgaggccgcactggacgctgtgcgccgcaaattcggcaacaaggccgcccagtttggggcgtgaacggctcaacgccacttacgatctcattacgccgtgagacgttcgcaggcggaacggatggcctcgtcggtggcggtggcggagaaacgcaggtaggcgggagcgccgtagaattcgccggggctggggatgatgccgatcttggcgagctcggccatatcggcccagcagtcgccggacttggccttgacccatacgtacagcgcgccggagggcatttgtgccgaatagccatatgccttcagtgcgtcaaccagcgcggataggcggcgacggtaacgcctccattgctcgtgcacagcggctgtgtccttcaggcctgcggccatggcggcctgcactgggccagggataatctggccgatctgcttgcggtattcggccatttccttgaccagccggtaatcgccggcaattagagccgtacggtagccggccatgttggactgcttggacagcgagtagagcaccaggatgccagctgccgaaccttcacacacatgtggattcagggcacatggcgtggcggagagactgaatgcggtatcggaggcgggctcgttggattcggccaccggtgcggcaggcacagacgcagcagatgcagacgcggcaggcgcagaggacgcggctgtattgcggcgcaccgaacgccagtccattaacgcatagcattcgtcggagagcaccacggcaccgatgcgacgggcagcagccacgatgtcggtcagccagtcagcggagatgacctcgccggagggattacacggcgagttgatccagatggccttgacgttcggaatattcacccaggaatcgacgtcggtcacatcatcgactttgaccacggtggcgccggcaagttgggtaccgatttcgtaagtcgggtaggagacagccggttggacgaccacatcgccttcgccaaggtgcagcaggctggccatcagcgccacggcctccttggaacccacggtgggtacggcggcagcgttgatggatttcagatccaccccgcgcagttcgcggaaccatgtatcgatagcggccttaaggtcggcggtgccggcggtgaccgggtatccatgggcgttgggggcgtctgcgccggcaaccagcgcctgctggacactgctcggcaccgggtccacaggcgagcctacggacaggtcgatcatgccacccggcacggttttggcggtggctttgaagccggcgatacgagaccagtcgtatggcgacgaatatgcgtggaagcccatgagaacccctttcttggacggtatgttcctaagatacgacgaaccctcggccgtgatagaccgagggttcaatccgaactatgcgctgtgtgcagcgcttatccgcaaatcagcttactggttctgcggcggcagcgcggcgacctgttccgggtctttgccgattggaccattggcggaagcgccgcccaaatcgccgacttcagcgaagaagttgacagcggcatccttgtaccaagcccactcgtccggcagatcatcctcatagaagatggcctcggtgggacacaccggttcgcatgcaccgcagtcgacgcactcgttggggttgatgtacagcgagcgggaaccctcgtaaatgcagtcgacggggcactcgtccacgcaagccttgtccttgacatccacgcaaggctgagcgattacatatggcatggaatcctccttaacaaatactgatacaagggtacgcgcctgttgggacgctcctcgctctcagccgttaacggccttatcggtttcggcggacagcgtttcggtcaggtcgcccttgccgaggcgcgcatgccagtagccgtagccgaagtagatggcgaagccgaccacgagccacaccacgaaacgaatccaggtgagcacggacaggttgagcatcaaccagaagttggccacggcgatgaggatcggaatccacgggctgccgggcatcttgaaggcgcgcggcaggtcggggcgcttcttgcgcataatcgggatggagatggccaccagcgtgaaggcggacagggtgccgatgttgaccatgtcggagagcacgccgatgtcgaagaaggcggccacgagcgccaccaccgcgccgacgacgatctgcagagcggccggagtgccatgcttgccggtcttggacaggccgcgcggcagcagaccatcgcggctcatggcgaagacgatacgggtcaggccgagcaacagcaccataaccacggtggccaggcccagcacgatgccgaagctgatgatcttggcggcccagtcggcgcccaccagttcgaaggcggtggccagcgaggggctgtcttgcttggcgagatcggcataggagaccatgccggtggtcaccacggccacgagcatgtacatgacaatgatgagcagcatgcccacgccgatgccgagcggcacgttcttgtgcgggttcttggtctcctcagaggcggtggccaccacgtcgaatccgatgaacgcgaagaacacgagcgccgcgcccgagaggatgccaggaacgccgtacacggatggggtcatgccggtggcgaactgccacaacggctgggtcatcacgccggtgacggcggaggagccttccacggtggaggccggctggctcggcggaatgaacggggtgaagttggaggccttgacgtagaagaagccgacgatcaccacaaagaacacgatggcgatcttgagcacggtcatagcaccgtccacgcgggcgccgatcttggtgccgaatacgagcagcgtggtaaagaacgccacgatgataatcggggcgatatcgatgtggaaggagccgaacgtcaggttggtgttggcgttccagcccatcaggcgcatgaaatcgttgaggtatacgccccaatatttggaaatcacggagccggccatcagcatttccaggatcagatcccagccgatgatccaggccatgatctcgccgaccgtggtgtaggtgaaggtgtaggcggagccggccaccggaatcatcgaagcgaattcggcgtagcacatcacggctgcgccgcacacgatgccggcgatcaggaagctgatgatcacggccgggccggcgtggaaggcggcggcctgcgcgcccaccgagaagatgccggcgcccacggctacggccacacccatgattgacagatcccaccaagtcaggttgcgcttgagcttgcggccctcttcaccggtttcggcaatggtctgttcgacggatttcgtacggaacagttgcatagtgctcttcttttttctctgttgtttgcgcaccaaatgcgcacaataccgacaatcgagtatagaagagcccgcgtgtcttgtctattaataagacttagagtccgcaatatatgggattaataacccgctccatcaatcaatagcgcgattacagcacaccgacgcagaccggttcgggcaccaagtccactccgaacgcgctcttgactgcctgctgaaccgcgcgcgccaaagctgcgatatcggccgcgctcgctcccccacgattggtcaaagccagcgtgtgttgcgtggatagactggccggcgcgtccgcatcgaccttatatcccttatggcagccggcatggtcgatgagccaggcggcggacgtcttggtgccgggagtgccgtccggcagagtcgcgtcgaacttcggcgcatcttcgggcagggccgccgcttggtcggcggtcagaatcggattcataaagaacgagccgcagctgtggcgattgtagtcgggagcaggcagaccgtcatcgccaacgggaatgccggcggcctcattgaggaaggccagacgctccagatcggtcaggatattggcctcgcgcttggcggtggccatgtcgggcaaggcgtagcgagtggggtcctcgagcatgcccttggcggcacgtactgcgagcacggctttgcgaatgtcggcggtggccatacggtcgcccacttcgacgccaagcgctttggcaagctgtccgtaacctaccgtgccttcggccgagtgggtcagggcaaaggtgacggaaagcaccacgtaacgtggcgtcgggaagaatcggtcggccggctggccggggccggcgtacatgctggccttcagtgcggagtatcgatagccgaatcgaagatcagcgggtgtgaggtcgcgcgttgttttggtgtctcgatcccagacttccaccgattcgaccgaagtggcgacttcctgcccgtaggcaccgatgttctgcaccacggaagcgccgactgtgccgggaatgccggacagtccctcgacgccctcgagcccgagctctacggtgaaggccacgaaatcatcccaattggcaccggcctcggcattgacatgcacggtgcgatcctcgccctctgccggtgcagcctcgtccggcacagtgatgaggcgtcgggcgtctcgaaccaccacgccgtcaaaaggcttatcggaaacaagcaggttggagccgccaccgacgacgaccaagggcaggcctttggaatcggcttcctccacggcttcgatgagtcccacgcgcgtggtcggctcgatgaaatgggcgatggggccgcccacgcccatggtggtgatgtctgcaaagcttgtcatggcttactatcttagtggcgcaggtgcgatatcgaggcaatcatcggctgaaacggcagaacgcccgcgtctgaacgaaggtggcgcgggatttctgccgttttggcggcccgaaacgacagaacgcccgcgaggggttcgttcagacgcgggatttctgccgtttctcacgcgatgcggatactgattccgcaccctgccactcgcctccggaggcaatacgcaaaaacccggccgaatgggccgggttttgtaaagctgtgatacttgcgatcaacgagtctcgcggtgcacggtctgcttgccgcagcgcgggcagaacttcttgagctcaagacggtcgggcgtgttacgacggttcttagtcgtaatgtagttacgctccttgcactcggtgcaggccagcgtgatgcccggacggatgtcggcgctcttagccattgtcattcacctctgtgttcttaggtatagtgcgcgcccaccggttagcgggcgcgatttgtagcgaggaagaggctcgaactcttgaccttacgattatgagtcgtacgctctagccagctgagctaccccgccagagagccccgagtgagaattggactcacgacctcttccttaccaaggaagtgctctaccactgagctatcggggcgtggcggatagtggattcgaaccactgaagcacgaagcggctgatttacagtcagctccctttgaccgcttgggaaatccgccagtctgtttcccgccgcggtgtttgacctcaacaggcaacttggctatataatcacatattttccaagtacgcaaatcgacctctacgtgaaccttgttttaccgcggaattctgcggttttatcggcgtgtctcacaacgtggtttcagggtccgcttcggccctgcaaacagccccgaccaaggctgcaccccgcacttctaccaatcatttttcttatatggtgttccagaaccttgcaatggcgcggttttcgagtggcgtcgcctgcttgcggcggcacagcgcatgccggcatgctgggcgcatggcttctaatcttgtacatcacggacaatcattcgacgaccagccgctcggattcggcacgctggccattcacctcggcaacggggtcgacgccggaaccggcgcgatccgtcgccccatcacgctggcgaacacctacgcgctgccctacgacgcctcggccttggcgattgccaagcatctcgaatcgctggatgtggtgcgtttcgtggcgtaccccggtctggaatcgcacccgcaccacgaggtggcggtcagccagctggcccgcccggactccgggttcggcggcgtgctgtcgttcggcctcgacaccaatcatgacgggcacaaccggttcgtttccaagctcaatgtgattacgtcggccgtctcgctcggccatgacgaatcgctgatcgtgttcctcggcgaggatgacgagcgccagtacctgtacccgcctgagttccaccgcggcttcttccgtctggccgtgggtctggaggatacggacgatttgattcgcgacatcgatcacgcgctggtggaggccggattcgaggtgtgagaccgcaccgcgcgcatgatttcggcctcttccgccctgctgccgccgtcagtgagtcacaagatggctcggtgacgacgatggcagggctttttacgtcggcacggggacaatacctggcggtctgccgacgatgacggcacttatcgtcggcagaccgccagtttttggaccgtcgccgacacaaaacgccgatttgccgtcggcaatggtccaaaaactggccctataacgacaccaacgcggctcagcatcagcacatcgccatttcgtggcccactgccgacgctggcctcatgccacggcactcagcgtcggtagagagacaaccattggcacagcgacgacaccacgaacctgcgacacggaaaaaaacaacataccgtcgacctactgccgtcttgtgcaaaatgtcttaagccgctcggccaagtcgccaactgagcctcttccatagggaccccaatccgttacccagtgtagatgcggtgcaacgccgaactcaactacgttgcgcgcatgcacctttatgcatagcaggcatggctgggcgtttggtgggagcagctttcggctcccctctctgagggggagcccctttccgcctagcaagagaaaaccccgactatccgcgggaacagtcggggttgttgaagttcgctaggcgactaatcagccgaggatggcgagaatgtcgcgggcgccgacgatgaggtagtcctcaccctcgtaatggacttcggtgccgccgtacttggagtacagcaccttgtcgccgaccttgacatccatcgggatgcgctcgcccttgtcgtcacgacggcccgggccaacggccaggacttcaccctgctgaggcttctccttggcattgtccggaatgtacagaccggaagcggtctgggtctgggcctcggcctgcttgacgatgatcttgtcttccaacggtgtgagcttaatcgacactgtgggtcacctcgtatctacttgtagttcgataatgccgcgccagaacgcctcaagaggctgacgatcacttgcgttgtccctttgcgctaggacacatcgtagcgcgattattagcactctgccaactcgagtgctaacgctgtgagagaaaatcgtcgaatcgcaacgctcagttgccgcggcgggcaagaatggagtccaggcctgcgcccaacgaatcggtggtcgccgctggcgcttcgacgtcggcacgctcctcggattcgtggaatgcggctcgctgggcggcgtttgcagcctcgtcatcggcgtccgtatcggcatcatcgcgctgctccggctcagtgtctacagcgtttccggcgctgacagccttggcgtcgtccgcggccttgacggctcgggcctcgtcaatcaacttttccgccactgcgggttcgacaggttccgccttggacacctgacgggtcgacttgatctccaagctttccggagcgttgtcggcgttatgttccccacccaaagtgaaggagatgagatcctgcgaggtggacatatcgaagacgtccagtgctcgggcagggcgtacgctgaccagttccgacgtggcatcggcagcggcagcggcatcgtcgcgctcatcgcgctcgtcacgcaccgtaagcgatggttcaactcgaggggcgacggacttgtccgactcaatcgacttgtctgtgcgaacggaggcatcaggtgtggcggaagattcgctggtttcggcagcggacttacggtcggcggattcatcgaccatagcagacggctcggcggcaggcttatcggcggcggactgtgcaatatcagacttctcagactgtttggcgtgctcttccgcggcctgatatgcggcggcggactgacgcaacgccttggccttggcctgctcaatctcggcatcgcgtaacgcgcggcgaatctgccgctgttccatgacctcggtggcagcatcctcaatctgctcggcaggcttctcggcaggcgcagttacggccgcaaccggttcggccttgttcacacgcttgctgtccttggactcggcagacggtttcttggaccagcccgtaccgctatgagcccgctcgtagcggaccaccttgcgctcccattgccgggcctggcgtgaggcattggctcccagcaccagcaccagcagcaacagcacgaacggaataagagcaagcagcggactgaaatgcagggggaacgatacggcaaacaccaacacggttatggcaagcaggcatacggcgagaatctgccggcggcggatggccgcgcggcgcagttcccgcacatgggcgatgtgctcagatgtcagcctcgctgacggtgttgatgctggcattgctgcccctttcgccttatgcggcttgatgtctccgaatcgtctgccgttctctgcatcaacgatatgcagggaaggcgaataacgatcctgccggtgctcgtccacacgtttcatgccgttggccgtacgtacgggcagccatacaacgataataatcgccacaatcaccagcacgacgacagtgctcagtgactcataacccatagagtcaaggataggagacgtgccgacgaactggggctttccgtccgggcgtgtcggagcggaattcttccggtcgacgcttatctggaaccggcggcggcgagtctagcggcgaacccttgccccatatcttcagccaacagcgcaaacgttacgtggtcacgccactggccattgacatacatataccgctcgcgcagtccctcatgatgggctccgaccttacgcaccacagccaaagaacgcgcattatccggcagaatggcgatttccagccgatgcaacgcgggcccgaatggggctccgagcgcccaatcggcaagcatggccagtgccattggcgcgaatccgcggccggcgcaccgttgatcgacccaataaccaaccacgccggtacgcatggcaccatacacgatggctcccaacgaaatctggccgacgatacgcatctggtattcgatggcgaagatcacgccgacgccatgctgctcgttacggcgctgccgctgcacccattgattgaatgtgatggagccgccatgcatcgggtcaccggattcccaaggtgccagccagtcgttgttgcgccagcgcacttcgttccagccgtcctcatcatccatggtcagggggcgcaggactatcggaaaaccgggatgggtgagacgtggcgggcggatctggtggtccagcttgaacgcctctttaatcgactggaaaactgacacggcctttattgtagccatatgaaggtcttgcgccgctaccgtggccactttcgttttacgatggaaacactagattgtgcggtatgagcgaagtgggcagtggcatgaatatcggcagcgactacagcggcacagagaaaacagagaagacggataaagcgacgctgcgccaccatatactgtctcggcgcaagcgcgttccagcggaagaacgcggagcggccggtgaattgctggtgcgacggttcccagcacacatgattcaggatggtcccacagtggcggcatatgtgtcgatgggttcggaaatcgaaacccggccactgttgcgatggctgcgggctcatggctgccacgtgttggtgccaaggttggggtctgggttggaaattggctggagtgtgctggattcattggaatcattgcgctcgatggatgcagtgggtggcgcgaacaatgccggtagctgcagctctcccagcaccgtccatcacagacccgatgagccaactggcgcagttctaccgcccgaagcgttggagaaggccgatctggtcatcgctccggctttggcagtggacccgcagggcaatcgtctggggcgtggagccggctggtatgaccgggccttggctcgccgcaagcccgcatgtcccctgattgcggtgtgctggccgtgggaggtgttggacattgatttgccggccgaaccacatgatgtgccggccgacggagtgctgacgccggagggataccggcggcttagctcatcgggcctgttgagctggccggccggccaagatactcggcgcaagccagactgaccaaccagccacgcacactggccgatggaaccagagtggcaacagcaagctggctagtaagaccgtaacgccaatgtgtcagggcggcgactaggatatgaacggttgcgtggcatggcgtttgggccatccgcgagaaatatgactttgttggaggaatccgttgcctacctatcattaccgttgcaagaactgcggctatgacttcaccgaacagcagtcgttcaatgacgacccgattaccgtgtgccccaagtgctcgcaggagcaggtgcgcaaggtgtattccgccgtgccgattgagttcaagggtcacggcttctaccgcaccgacaaatccggcaagtaaggtctgtacacccgcttttcctctgtaaacgacggtgtcgacggcggtatgccgcggatattggcactacgggcactgtctgttgcacgggtttgaagcgttgtggataacttggcaagctagaaccacataggtcgatttggcttgcgcttacgaaaaacttcaggtcaccatggttgcatggtgaccttttcgtttattaagccgcctgcgcgcggctcattgcggcgacggcgcatggcggatgccttgcgccgactcactgctgcgttgtgcgtgggactcgcagtgctgtttgggcttgaagccgtattggccgtggtggagaccgagccgatggtggtggccgcccgctcgattcgacggggtgacattattctggccgccgacgttcagttggctgatatgccggtatctgcggcaggcccgtcttggacaggcaatattgaggatgtggtgggcaaggtagcgcaaatcgatatcgaagcagccgatcccatttccacgcatatggccagagatgcgcccgtagcaccgaccggcactacggtgattgaagtccgcttggccagtagcgtcgacgatgtattggccggcgatcaggtgagactggtttccgccgtcggttgcgaaggtgctgattgcacgctggccgagaacgccacggtgatgaatgtcggcaaaccggatgcgactggcgcattgggaggcaacgaccgactggtgtcgttcgcaatgccgccggaggccgcggccaaggttatggagctgcaacaggccggagcgattatggccgttgtgcggtaggaagcggaatcggccttcggccgatactgtgttttccgcagcctgtcggctgcggaaaacacagtgttggggcgcacagagtgcgccccaactcctactcgcgctcgttaaaaacggcccaatgcggcggcagttcgccgaggatgcgtttgtcgtcgtcggattgccgttgttggtcggtctgcatgtctccgggctcgagtttgacaccgtcagcgtcaaactgctcagtgcccttcatcaccacgcgcttgtgcttgcgcggtgtgcgccgtgtagccgagtattccgccatggttattcaacctcgcgatagatctcaccgatacggctgacgatacggtcgacttccttatcggggttcacgaaggcggcgacactccagacggtcatcacattccagcccaaggaaatgagatcctgtgccgacaaacgatgacgcctacgcgtggattgcacggacataaagttcgcgtcatcggtctgcacggccaaggcaaacggcttgtccttcaatcccaccacgagcggaatcttcacgcccttgtcgaatccataatcaacagcagcgttcagtcctcgcgcgcgcaacctgtcggcgatatcgtcgaacagcacgttgccgcctgccgcatcacgcaacggaagcaccggacggtcgtcaagctgttcggcccacgtcaacatggtcttcaggaaccgaggaccggattggtgcagacgttcttcatccaaatcttcggaaccaaaggccgacacaatatccaagctgtggtccgccaatgccagggcatccagcaacagtccgcgaccgcctgtgctttcgagcggaccgaactgctgaagcagacgtccgtgcgtggttttcgcatagcacatcgacagaatcacgtcagtggcacgacctccggccacgtcacgcaaggaaaccaaccgcacatggcgcaggaatcggcccatcgccttggatttgcctgccaacgacttcaattcggcacccaagcgtgtgcggaatgcgtcggtcaacatcacgaccacaagtcgatagctggaaggaaccacggcaaaaccggcggcacgttgcgtaatcagacgcaccacttcatcaatctccggctggctggattccaccagaccagaagacataaccggcacaccgctcgcttccacacggtggaatcgcacctcaccggcagccggctcggtggccacatcatagcgaacaggaccatatccctcggattcaaggaatgcggacaggcgcggcgcacggcgagacggggcagcatccacctcgatatgaggcaacgtgtcgatcagctgcttgacgctttcgctggttaccgtcgcgcagtgggcgatcaccaccacctgctgcacgcggccgatgatggacagcaactcgatagcgggaatgtgcgcgcacgcatcgagaatcgccacatcagccagcacacccggctcggtgagtgcggcgagcgtacccggcgcggccaccagaatcggcttggccgcggccagaatctccggatgatcacggcgaatcctgctcagcgacacactggcgcgccctgccagcacggtgtgcatctggttggcttcctgagtgcgggagaacagcatgtcgcacaggcggcgcatggattcctgcgacaccatcggtccgatggagcgcacgtgctccacatcgacctgcgcaaagcggtcggatgcggcctgcagcgcggcaccatcctggttggagatgatggcggacgaacgcacaatgtcctcaaacacggtggtccaccaggccagctgcacttcgccgcgcacctgctccacgctcactcggcgagcgttgagatcggcgaccagttcgttcagtccggcagaggcgaattcctgctccagcaggcaacgctccggcaaggtgtccagtgccttgcgatcatccagcagtgctttcaggcgtgcttccaccttctcgaaatcggcggtttccagattgccaccagcgggtgtggtggaaagcacggtatccagcgcggtcatattgctgaccagcgcctcttgggtggagatgatctcgtcgagcttgctgggcagcaccggccaaccgccgtgaggcacgaactgatgccactgctccccttgcttggcgactaccttcaacgcttcgtgcaagtcctcgacctgcgcgccgacgcgcagcagatccttggcttccttgatgtggcggcggcgctcccagaatcccatcgacgtgccctcggccttgcgctggctcttcggcttggtggcctcgatcatggagctgatgtctcgctcgaaaatctccggctggaacacgtcaagcactcgtcgcagattcttcaaaaccgtaacctgacgctcccactcgcgggtggtgggaggaaccgggaatccgcaggtctgcacggtgcgtgccacctgctcacgggtggcgggcaggaagcgacgcagcaaatcgtccacgcgctggtaggcggttactgcctgttcttcagtggtgatggacgccttgtaccatgcggtgtcttccgggccgatggtgtattcgccgagctcgccggcgcgttccatcttgccgatccatgtgtcaatatcgttggcgatgctcagggcacttgactcgtcaagtcgaacgtgggtggcagggtgcgtcgggagcacggagatacgggccagattctgaatggtctcgtatgcggacacattccacttatcattgcccccgtgcaggtcgcccaagtagcgggtcaagcgcgaacgcacgcccacgagttcgtcggccaactggtcgaatcgctgggtggcgactcccggttggaatccgactgcggcaatcagctgcttatcaagcgcggcgttggcgtgttcatcggatacatccagtacctgcgccttcatctcattggcggaggccgtctggatgaacagacgcttctgctcggccacgccgggcacgtacagcacggaacgaccattcatcaggcagcgcgatgcgatggccacagcctgctccgcggtgcccttcgggaaggcgccgtcgaccacgatgctatggccattggcggcaagtgacgcggcatatcgcaccgtattgtccacatcgccgacttcgtactcagcatgcgggtctacgtcgaaaggactgtattgcggaatattggcatctttgagcgcggtgcgggcggattcgtcgccggcaagcgcgtccaacagcacattgccggtggggccgttctccagctggtcgatgaactgtcggctttcgctgatcatctgcgacgaggggtccatgaagcatccgagcacaatctggcgctcgatggcgaagtcggagatacgctccgacgcttcggacgaaatacgggcgaacatcgcggaagtttcgggagtgccactgtcatagctggcaccgtcaaacagggaatcctcatccaggaacaccccctgctcacgcaatgtattgacgaacgcgacgttcagggtcacgcgaccggtgaatcgaatggtggtcgacaagccatcatcctcgatcgtgacgctcaccgggtacaacagcaccggcagcgcgttgcccttccatgtggccacgccgaccacgagcgacaactccgccacgccggaaatcctgcgtttggcggcctggtcatccagcacgcgcccaatatggcgttcggcggccttaagcacacccgtgtcgcggaacaacgaatccaaccggacatggccggaagcgaacagctgggcgatgccggagggatgggcatgggtcatctccagcttcgcggccagttgattcacatcctcgagcggcgatggcggctgcatgctgcggtattggtcacgccagcgacggatgcgattcagaccttccgtgagattctggttctgagtctggctctgggtcatctctcgactcactttccaaccgcttcgcggtattcctgatagcccttgttgtgagacagggcttcgtcaatatcggcctcgccacgggcggcgagccaagaatacatgtcgtcgtacaggtacggattcatggcgaggaacgccagcaattcgggatgacgggcgacttcgaattgaacattgaaatcttgcgtggtttttgcctcgtcagaggtcaggccatcgacttcgactgccggctcctgtgctttcagctcgcccttggccacacgctcgaacaccgagccgggctcgaagaccggagtgtgtacgcccgcgtggagtccgatatcatatgcttcggataccgactgctgggcggtttcggcagccggctgctggtctgctacgcctgctgcggtggcttcttgatatgcttcggctgcggtccgctgctgatcgtccggtacgtcagctgccggctggtcggtttcagactgggcggttgccggctgagcggtctcaggctgggtgttttcagattgagcggcttcggcttcccgggcggcttcaggctgggcaacttcagcatgctgttcgacagtgtccgccggctgagaatcgccggcattcctggtattcggagcggactgaacgttttcggctgacttgcttgcgccagccgctgcatcggattcaacaaccgccgccgacgccactgccggctcgcttgtgctgggagcgtgcttaacaacggcatgggcgatggcatctactggaacaataccggagatcctgctgtgcttggatgcaggcgttacaatcgtcgactcaggttcggtctgctgcttcggcagtgccacggagttcatggcctgctggtttttgcgttcggtctcctgctcggcatgctgggccaacgcatccgcgaacagatcacggggtatggccggctcatcgtttttcgtcactggctgcgtgatattcagcgagccaagttcaagctcgtcgaccttgcgtcgaacattatccgcgctgaagatggcggtcggctcgccggcccgcaaatcaagaatatcgtcgacggacatatccgccgcatccggctcctgcggtgcttcgtgaaccgcatagccaaacaaatcaggcaccttgaggtcgagcggctttgccactggatcgtcgacacgaatgaagtccgcaggcacatcgccgaactgcatgcgcatgggagacgtcggcaacaggaactcggcattggccggcaagcgcaacaaatcgccattttcccgcaccacatacgatccattggtcgatccaagatcacggaccgaggccgtgccattgctttttaccgtgaacatggcgtgccgtttggacatcgatttggtttgatcggcgacgtcaaggcgggtgttgccatcatcggcaagggggcgtaacggcttacggccgatttccacgcactcccccggcttgacgctgatccggtcgacaccgttgatcttcaccgtccactcgctcaccgtgaccgccttcctggacacactatttgaccacactacgtgccattgtgtcatcttttaccggcttttggcggattactgggcacagaattgacaactttcgctcattgccagctttgtgtttccacgccggatcgcgttctccgcctcgtcctcgtcaactagtctactcagtatgcggaaaccccgcagcctgaaacacaggtgcggggttcctcgaaaagctgtgattgcggcttatgccgcacaaatcacttgagctcgacgctggcgccagcctcttccagctgagccttggccttctcggcatcttccttcttggccttctcgaggacggccttcggagcgccgtcgacaagagccttggcctcggccaggccgaggttggtgatggcgcggacagccttgatgacctggatcttcttgtcgccgacggcggagaggatgacgtcgaactcatccttctcttcctcagccggagcagcagcgccagcaacagcggcaacagcggcaaccggagcgacagcctcgacgtcgaacttctcctcgaaggccttcacgaactcggagagctcgaccagggtcatctcgccgaaggcttccagcagctcatcgttggtgtacttagccattatggcttcctttcaatcttggcggcggacgaagtggtagatccgctgcctaataaaccttattgtttaaattatcgaagcgactgattcatgccgtgagggcgtaaatcaggcagccttctcctgcttttcgcgcagggcgtcgatcgtgcgcacagccttggtaggcagagcgttgaacaggtacgcggccttggccatcgatgccttgatgtcgccggcgaattcggcaagcagctgcgggcgggacttgaggtctgccagcttcttggcgccctcggcatcgtagacagtgccgtcagcggcggcacccttgatgacaagagccttgttgtccttggcgaagtcacggatgaccttcgcagcctcgatgaagtcgcccttcacgaaggtgatggcggtcgggccggagagaatctcgtcgagaccctcaatgcccgcttccttggcggcgatgcgtgccagcgtgttctttgccacggtgtaggaagtatcgcggcctagcttttcacgcagatcggaaatctgcggaacggtaagcccgcggtactcggtcaggtagacggcgtcagcgttacggaattcttccgtaagctgagcgactaccgcttccttttcgggcctcttcatggcgttccttcctaagtcggccgttgacttggagttcggaactttcggccgggcaacaaaaaagccctgcgcacaggcagagcaatataatctcgcgaagcgaccttcgccggcccttgacgggcttatatctctcaacctgcgctggcttggcgaaccaaacttcggaaatgcactcgcgcgcacttcaaccaacggtctgtggtttacggatgattagattacggatggtcagcgacattgcagaattcgggcgtgtcgcggggcattacagcgtggcggcgtactgggctacggacgcggtgacttccttcagatagtcgagcgagcgacgccagtggccgggcacctcgatcgaatggttggcatccgggtattcgtgcacgtgcggggtgagcgcgttggcgcgggcttgatcgtagaacgggtcggcggtgccggcgcagatcagcggtgccgggccggagtatcgggagctggcggcgtgcgactggccggcctgttccgcgcggatgatcgcccttgcttcggccacgctcggggcctcggattcggcgacgatatcatcgccgacagccggcaccggaatcacccgggcggatggatcgaagtcggcgtgatgcagcaccggggtcagcagcacgaacggcagaccgtagtgtgaggccacatgtgggtaggtcatcgtcgtcagcgacttgccgatcagcaacaggcgagggccggacggggtgtcggaatcacggttcggcgagccagctgcgccatcggccagcacggtagcagaatcatcggcggcaacgccatccccggaatcaccggctttacccgcgccggactcgcgcgcggcggccacccagccgtcaatcgcctgattgaggaccggaatcaccgtggacaggtcgtcggaagcgttgcgtacgttcatgcggtcgattcgccagccggcctcgaccagagcctgggccgaccagtagagcagcggacggtcgcagttgtagccggtgccgggcatcagcagtacgcggccgtactcctgaccgggcttgacgacattcttcttccaagaggtgatgctgacttcgacggccggtttcatcgcgcgccttccttccacgggtgtgtcctgcgtgtcccctgagttgttccgaattattctggcagtcagtctactcccggacccgttcacgttgcctccacaagctataatcggccacggttctgattgggtgcgcagcgcctgacgcgcgttgggcaggccgatcagggcgagttgcaattctcgccggggccagccgcagcattatgcacgcggtgcgcagccccgcataaacccaaggaagtagagagtaaatggagaagttcttccatttgaaggaaaacggcacgaccgtctcgactgagattctggccggcctgaccacgttcttcgcgatggcttacatcatcgtcgtcaacccgcagatcctgtcgcagacgggtatgccgtggggcggcgtgttcctggccaccatcatcgcggccatcatcggcaccctggtcatgggcctgttcgccaacgtgccgtacgcccaggccgccggcatgggcctcaacgcgttcttcacctacaccgtgtgcttcggcctcggcttcagctggcagcagaccatgtgcatggtgttcctgtgcggcctgatcaacatcctcatcaccgtcaccaagatccgcaagatgatcatcctggccatcccggagtccctgcaacacgccatcggcggcggcatcggcctgttcgtggcctacgtgggcatgctgaacgtcggcctgatcaagttcactcccggcgatccgaaggccgccgccaagggcggtgccgttgcggctaccccgggtctggccaactttaacgacaaggtgctgtgggtcttcctgatcggcctcgtactggccattgtgttcaccgtgatgaaggttaagggcggcatgctgctggccatcgccatcaccaccgtaatcggcatcccgttcggcgtgaccacctggtccaactcgcagtccatcagcgagaccttctcccagctgccgcagaccttcggcgcgatcttctccgccgagggcttcccggcactgttctctgatccgaccaagctgccgctggtcatcgtgaccatcttcgccttctccatgtccgatacgttcgacaccctgggcactttcatcggcaccggccgccgcaccggcatcttctccgccgaggatgagaaggctctggagaacggccacggcttctcctccaagatggacaaggccctgttcgccgactccatcgccacctccatcggcgccatctgcggcacctcgaacaccaccacctacgtcgagtcttccgccggcatcgccgcaggcggccgaaccggcctgacctccgtggttgtggcgatctgcttcgccttgtccgcgttcctggccccggtcgtctccgccgtgccgtccgccgcaaccgccggcgtgctggtgatcgtcggctgcatgatggccgcttccctgaaggaagtcaagtgggacgacatcgccgaagccattccggcgttcttcgccgccgtgttcatggccttctcctactccatctcctacggcatcgccggaggcttcatcatgtactgcatcgtgaagacctgcaagggcaaggccaaggaggttcacccgatcatctggactgtggccgcgctgttcattctggacttcgtgtgcatggcgattctgtaacgctgattgacaacggattagcctttaaggattaatccgccgccatacggcataaaggccgggctctcacaagggcccggcctttgttgttgccacagtgatcaacgcccatgagtaccttcgatgatcatccgccattcttgatgcatgggaatagttgtcaaccgacaactaaacgtacatggcggcagcacgagtgccttattcaacatcgaaatatgcagcgcgaagaagccgaaaaaccaaaaaggcttctataccgaatgaaacggtatagaagccttttggtttgcgatcaagcccttctcacccgagagaagctagagaacgatcagtcctcgaatgccgaaccgttaagcgggaagccctacgggcttcccgtaggtgaggggagcggctatgccgcgaccgatccgtgagagggatttagtcctcgaacggatcaaagtcgcgacggacgcggcgacgcgggcgctcagtacgctcttcgcggtcggcgcggtagtcgtcgtagttgtcgtcggtggcgtagcgcgggttacggtccgagccacggccacggccacgggaaccgccacggcggtcatcacgatcgccacggtcatcgcgatcggaagagcgacggcgacgcggacgatcatcgtcacgggagtcgcgagcatcacggtcatcgcgatcgtcgaagtcacggtcggcagaacgacggcgacgcggacgatcatcatcgcgatcatcgcgatcgaagtcacggtcatcggagcgacggcgacgcggacggtcgtcgtaatcatcctcgaagtcatcggagcgacggcgacgcggacggtcgtcacgatcgtcgaagtcacggtcatcgcgatcggagcgacggccacggccgccacggcgatcgtcacggtcaccacggccacggccgccacggcggtcatcgcgatcgccacggctcgggcgggcgttgttctcctgatcctcgaaaccaggaatggccagggagatcttgccgcgatcatcgacaccctgaacgatcacctcaacggtgtcgccttccttgagcacgtcttcgacagcgtcaatacgctcgccgttggccaggttgcggatctgggagatgtgcagcaggccgtcggtgccgggggtgaggttcacgaaagcgccgaacgacgtggtcttgacgaccttgccgttgtaggtttcgccggcctcgggcacgtgcgggttggcaatctggtcgatgatggccttggccttctcagcagcctcgccaccctcggaggagatgaagacggtaccgtcatcctcgatggcaatttcagcgccggtgtcttcctgaatctggttgatcatcttgcccttcgggccgatgacttcgccgatcttctcaaccgggacggaggtggtgatgatgcgcggagcgaactcgctcatctcggccgggccgtcgatgcactcgttgatgacctcgagaatcgtggcgcgggcttccttggcctgctgcagagcggcggccaggatgtcggcggggatgccgtcgagcttggtgtcgagctgcagggcggtgatgaactcggaagtaccggccaccttgaagtccatgtcgccgaaggcatcctcggcacccagaatatcggtgagggtcttgaagatgtgcttgccatcaacgtcgccggacacgaggcccatggcgatgccggcaaccggagccttcagcggcacgccggcagccaaaaggctcagcgtggaggcgcacacggaacccatcgaagtggaaccgttggaaccgatggcctcggagacctgtcggatggcgtaggggaactcttcgcggctcggcagcaccggcacgagagccttctcggcgagggcgccgtggccgatttcgcggcgcttcggggaaccgacgcggccggtctcaccagtggagtacggcggcatctcgtagttgtgcatgtaacgcttggactgcggaccggacagcgcgtcgatctgctgctccatcttgagcatgttcagcgtggtgacgcccagaatctgggtctcgccacgctggaacagggcggaaccgtgcacgcgaggcacaatgtccacctcggcggacagggtgcggatgtcgcgcaggccacggccgtcgatgcggtagtcctcggtcaggatgcggcgacgcacaatctggcgctgcagttccttgaaggcgttaccgagttccttgtccttctcggcatcgtccatatcggtgaactcgtccgcgagcacctcgcgcacgtgctccttgatctcgtggatgcggtcctggcgcggcagcttctcggcgatggagagggcctcgtccagatccttgtgagcgatctcgtcgatgcgggcgtacagctcgtcggtgtactccgggaagagctggaattccttggtctccttggcggcgatcttcttgagctcgtcctgagcctcgcaaatcaccttgatgaacggcttggcggcctcaagaccaccggcaacgacttcctcatcgggcttggtctgaccctcgtcgtagatgaggtgccaggcgttcttgccggcaccggcctcgatcatggcgatggcaacatcaccgttctcgatcacgcggccagcgaccacaatctcgaacacggcgcgctcacgctcgctccaacgcgggaaggcaacccactggccatcaatcagcgccagacgcacaccggagaccgggccttcgaacggcagaccggaaatcatggtggaagcggaagcggcgttcagggcgatgacatcgtaagcgtcatcagggttcacggcgagcacggtctcgacgacctgcacttcgttgcgcagggtgtgcgggaacagcggacgcagcgggcggtcgatgatacggcaggcgaggatggcctcggagctcgggcggccttcacgacggaagaacgagcccgggatcttgccggcagcgtacatcttctcttcaacatcgacggtcagcgggaagaagtcgtagttctccttcgggctggaaccggcggtggtggtggacagaatcatggaatcgtcgtcgaggtaggcggccacagcgccatcggcctgctgggcgaggcggccggtctcgaagcgcagcgtgcgcttaccaaacgatccattgtcgattacggcctcaacggccttgatttcgggaccctccatagggttcctccttctttaattttctatttattcctacatactgtgttgcggtttggcgactcgcttgaaccgcaactgtcctcttcagcggacgtcacataccttgtttcgactggccccttggccgtcgttcctcgtgtcaaccccttcattcgggttctctcgtcggccttacctactggctacctgcgtgcgtaccgtttccggtttcggcgccctactggcctatcctctaaccctcttgccgttgttgccgttggctggcgatatgtaaaacgcccgagcaccatcctaggtactcgggcggaagtcttcaattatcgacgcagacccagacgctcgatgagggaacggtaacggttgatgtcaacgcgcttgaggtagtcaagcaggcgacgacggtcaccgatcatcagctgcataccacgacgggagtggtggtcgtgcttgtgctccttgaggtgctcggtcagatcagcgatacgcttgctcagcagagcaacctggacctccggagagccggtgtcaccttcatgggtcgcgtacttagcgatgatttcctgcttttcttcagccgtcagtgccacggcatcctccttatattgctgcgcggtgctaccggcccgatgccggcgcgctctctatccgcgggcgaaatacgccaagggtcaattatacaggagcaccagacaccacgaatcagaccaacgtcagcaggccgccaaacatcacaacaagcaaagcaatcgtctcaatcacaaaaaaaagataaacgacgcccaactgcgcgtcagcacattcaacggcgactcttttttaatcgtcaccaacaatcccacccacagcaccgcgaaaacggcaacgccaataccaactgaaataatgccaagattcgccgcattcgccaatgccgacgactctccgtacaccacatatgtcgcataccaaaaatcaattttcagaatgcgcaggccggcaatgagttgctccgccgccaagccaatcacaaaaaccgcgccccacaagcgccgatgggcgtcaacaaccagcagaccaaggccggaaacggcaatcagcgtcaccgtccaggcaacaaacgcggcgccgcgcggctcaagcgcgctcaaattatcaagcagccactgcgtatcgttcaccgcaatcgcacgcccccaccaatacggcaccacaatggccgcaatcaccagcagcgcataagccagccacaatgcaggatgcgagcgcttacgctcaatatcggccagcgacagcgtcgattcgggaatggacgccaccggatgcttggaaacatcgttatgtttggaaacatcgttgggcatgggcgaaacaccatcggaccgcgtatcgatttcagcctgcacctcaccgctcgcctgctggtcgaccggctgtttctccacgctggaattcaccgccatctacgtttacctcgcgttcgttgttcgacgccacacctgtctgcacaatgcgtcgtctcatgccgcgacgcccatgctaggacggtattgtatcgtgagtgcgccatacgataatgacatggcgccggacataacgccgcaatacctgattttcgctaatcgcaaccatgcttcggcggacgacataagccatacatatgttcataagggcgaaccatatccgaattactcactccgctaacatcaccacataacggcaacatagatacacagccatacttgatatcaggagaacgccgtcgattcgaaatgaaaactgccagccgcccacacaccagctcctttgtttccaaaatcgcacattctacgccgatgtcatgctccaccatgtctcacgccgcggtctcaacataacaggatgggttgtacgaatccacgttgccgagcattcgcacaacccaccattgcgacacatcactgattccgcacattcaatcgctgcaaccaacaggctgcggcgatatttcagcgcgaagagcggcgtatccgaatgacactgatgccagccagcatcagggcaattgcagacagcaccatcggtgttacggacgaaccagttgatgacagttcagatgaattatcatcagcagtagaagactgttgctggccgccatcaccggtctgatcgccgttacccgactggttaccgtcaccggtctgatcaccaccaccaggatttccgccatcaccagactgacggtcaaccgccaattgcgcgagctgcaaactcagtgcacgctgcggggcatccacctcattttgcgtggaaggatcggatgccaacgcctgctttgccttatcaagtagcgtgagcatcttatcccactcatccataggatattccgcagactgcagagagtcagcctgatcaatggccgaacgcagcttagacgtatccacagctttgccgtcagaagtcaacacgtcgctcaagtcatagtaatcaaaatcgacataaccacccgtattctccttggcgtaattgaacaagccgattcgataccccttaaagtgcgacaagctccaatcgtaagtcagcggcccctgctcgtcgccaagcttggaccattgcttaccgtccagactgtaccaatactgaatcgtcaacttaccactcgcattatccagtgtgttgtccgacttgatccacacattggtcgcatcatctggcaatgtcactgtgccgcccgatacaaaggcctcttcagcgtcacgatcaatcgtatcgtcaacgatattaccgtccgcgtccttcacgccattgtcgtagacacgcttgaccacgcccaacgttcgctgtccattttcttgacgcacagcggcataggcaaaactacgggtatatgtagcgaggcctgcggtgtctccatccttcatatgactgacatccatgtgggtttccacagacatggatccgccaaaggtacgctgcgacaaaacgttacgggcggtttcaaaatatgtcaggtcgccataagtgcctttcatatatttggccgtggcggaaaccttgtgcccattggtcaaacgcaaccagccttcacgatcagtgagagaccaatatcggttatctggattatgtccccattcccataccaaatcaagattcgaaccattgggttggtattcttcggcgaccggatattccttctcatcagcaagaccgatcagggaaatatcgtcgatgacgtaatccatgcacgtgccttccgcaccccacgcggtttcgacaatgagtttggaaccttccacattagcgtcggatgggatggagaactcacctgtgatagtagtcgtctccccacgtttcactgttcctgtggccacacgattaattgtgccgtctgcatattgaatcgccacataaaacaggtgggaagtcacagccgatgaatcgacgccgtccatctcatggtcgtatcgaatcgttgcactggcacgatatgtcacgccctgctgcaattttccatccatagattgacccgggccagcgccattgtattcgccacgattcgtcacagcaagactcgtggttccagaaagagaaccatccgtaatcgcggtaagcgtaccattccactgaggggtccacgattcagtcccgttttcgaaatcgccattgtccaccagctcgattccaatcagagaatcgtcaacctgaggaggctcctccagagtccaccaatcctgatcctgataagactgatgaggcgcgtcattatcaaaatcgtccgaattgaccagggaacgctggcgaaccagattctccaaatcagcaggcaaatcaatcagtttgtcgtaggtgtccgacgcgcttacctgattattgtccccaaacacaggccatccgtcatcaccccacgttgcaggaatcaaaccgggaatacgtccggtcggatatgtgtctcggaagaagaatccatgccaagacgtcgtgccatcaccgttgtcgacttcaacaaggctaccttgtgcgaaagcacctagataatacttttgggcttcgtatttggagccatcaagcaaatcagtggtgcgcagcagcatcaccgtacgaccgtctttgccccagtaaatcgttggagtatagaaataatcaccgattttgaaagtctgagatccttcaaatccggtaggagtctcaccaagatcatcagtgaactgttcggcagagatgatattctcatggctctccaccaccgtggttaaatcatcggacagcctatattggttgacgccggagataatccaaggactcccttgctcatcaaaatacaatgacggatcatggaatccccgattaagggcaatcttcgtccaaggaccattctcaatatcatcggtgtagtagatataagcgccattaaggttgttcgtattgaataacacgtagaagcggccattgtgatagcgcagcgacggagcccactcgccttcgccatacgagctagctccattgcgcaaggatgaagcatcgctcatagaaatgcgatcatacacgtacgtgactatccaccaattgaccagatcataggatttcataattggagatccgggactgagctccatagtggtactcaccatgtaatacacatcacgaccgtctttgttattcggatcgtccttcgacacacgaataacactgatatccggaacatccgtgttcaacatgggaatggaatacgtgccatcaccgctatcagtcgtggtgtaactgccatccgatggcgttgaagatggcgttgaatcatccgcaaagaccggcattggcgccaaaatcaacccacaagtcgacaacaccgcgatagcactagccgaaattttttgtcgtaaataattcataagtcttttaacctttcatgataagcactcaacatcgagtgcgtattccaatagcatgcccgcacaaatcagcaatgaatgacgataagacattcccgcatatggataagtgatggacattaccactgccaaaacttacgcttgaacaagtaccagttctaggtttcatgtgcggtcatcccgaggctgccgctacgggatgaccgcattaccaagaggtaactagcgcatctcgcgacgcactcgcgctacgatcacaccagtgagagccaagcaagcgacaatcacagcaccaggcaagacagaggaaccggtttgtgccaaatccacgccatcgtcattggagccgtcggcattgccatcagtggaatcatcagccagcttcagaccggcacgtgcactattcaatgcagcaagcgcatcttgaacctgctgttcagtagcggattcatcctgcaataccgcctgagccttctgcaatgcgtcagcaaacaccttccagctctcttccgtgtaatcggaagcgttcaggctggaattctcattcactgcgctctgcaaatcagacttgtccaccggagtcgaaggagtttcatcctgcgactccgtgaaagtgtacgtagtgatgtcgtacagctcatcctgagcattcgcaccaccatcggatttgaaggagaacaccacatgatgcacccctgtcacaccctcaagggtggtcgtgtaatcggcgtactcggatccatcaccggcaggaatcgaaatagaagccacaggttcggaatccggatcatcaagacgaatctcaaggatgcctccggctttgccagctgcagtcacagtcagcgaagaggcgccgttattcccgaaatcgacattcgccaaagacgtccactcaccattattaatattgctgagcttctgaccttcggaattgtctgtagtcatatcgaccacgcgcacaccagaagtcaggtcatatgcgttctgaatgccggaatcccatgcaatggtggaagctggaatgcctccatcttgatacgcgtccagattcttcaccgaagagagaccctcatatgtcattgcaatatcggcaatggaaccatcctcgttaaccgtaatcggatcgagatgagtatttcggtagccatgcgccgcgtcaagattaccgccgttcatcaattcctttgccaccgtttgcgcatggtaggtcatataccactggtcgccaagttgaaccatcgcgtgatgattgttgccgccaacaccgaaatacgtgctcggattcttcagaatctcaccctgataagtgaacggccccatcgggttgtctgaagtcatatacgcgatattgccgtaaccgaccgtgttaccatcaattacgttgtcatggctgaaattagtgcaatacgagtagtaataagtaccacctatcttggcaatcccggagtcctcaaacatggcaggtgcgtctatgacctgagcctcaccttcggtatgcagcatgtcatcggacagtttaataacgcgagccgtgttcggatgttcttcctcgcctgtcggaacaccacctccgtaatacaggtagccctgcccgtcatcatccacgaacaccgcgggatcaaacagccagaccacaccagcggattcaggagtaccgcccttaatcaacagctcaccggtttcgtccttccacggaccaacaggagaatccgaggtcagcacaccgataccgctgccgccattggcgaaatacaggaagaacttctctttaccgttgatggtcttatgagcgacggcaggagcccaggaattgctggcccaggtggccaccccctgttctccagccacacgaatgtaaccctcattacgccaattgaccatgtcatcactggacagaacattgatggtctttacttgagcgaacgaattgtccttgatctgcccagtactgtcatattcatagtcataattcaacgagccatcagcattcacagaagtgccatcacccgtagtgtagatatatacgcgtccgttgtattccatagcccacggatcggcgccataccaataatcgataatcgggtttgaatagtcgccgaaagccttggctgccgttgccgtacccgtagtcggcggcacgaatgaggaaccagaatccgaaccggttacggaaatgtcgtcgacaatgaagtcggcattgctcgtgccatacttgttttcaatcaccagcgagggactggtgaaatcaccactaccacctaacgttccagtacctgaaatttgtgtccactcacccgctttcgccgttccggtcgcaatctggtcacatccggaaccattacccgaacaaacagtgatattgaattcaccgtcttccgtggccttgacccacatacttccggtatatgtctgtcctttttccaccttgccatcaagagactggattgcaccagcatcagaggatgtacgatcagtaacgctcaaggcgccactgccaccatgcacatcatccgcagtgacggcaatggacgatgcggagctattccacaccgttccagacttccaaccattaagatcgtcttcgaatccgccgttgacgaccaattcgacgggttcatcggccgacgccgcagtcactccgatagtcgctggaaatacagcccccatgcaacacagcacggatgcagccgcagcagcaaccacacgaccggttttccttgtttgcaatatgtgaatgttataaaccattcagttccctttcctgaatgatggagggcgactccccccccccatcattttttcttcgccgcacaatcgaatcccacgttggttacgaccacatcgcggctcattgcaaagccatgccagaggaacgtccctcaagggcagccatgcaacagccattgtataaatgagcgcatttcactcgcgatcgtccttgataacaaattgataacgatatgcacaatgaaaataagttcacataaacgcaacgcaacacatcaaatatgacagtttcatatgccaattacacactttgcataacatatttcaacaaagaatggagacgtacaagcgaactcatctgatgccaccactcatcgcctataaagctggcgtgtcgcgccacaataacatcacagccgataaaacgacaccccgaagttgagcctcattcaacaatgcggccagcttagacacacaaccaacgcttcgcttcatagcaccgaacattgattccagcacagtcacgaccatcttctttgaaggcaatcgtgtttacgccccgggttctaaatagaagtgcaacaccttgtctaaggttggaagtgttcagtttctaacttaagaaggtgttgcactcatgggtcaacgatattcgcacctgtcgtccgaggagaggatcctgatcgagaagctgcattgcgaacagcatctgagcatccgtcggaccgcggagaggatcggccgggacaagtccacggtgtcacgcgagctgaggcgcggcctgtggttcgcgtccaacgagaacgggtcgtaccgtccctaccggccgaaacggctgaagaccggggcgtggacctcgggtccgttctattcggcgctggccgcgcagaggaaggcggacctgcgccggcgcggatcccgcaagccgcgtcgcatggactcggaccggcttcgcgcctgggtgctggactcgctgcgcagggggtggagcccggaactgatcgagggacggttgaaggcccggtacgccggcgacccgtcgatgcggatcagccacgagtgcctttaccagtggatctacgccaagccgcagcgggcgctggacctgcgccagtacctggcgcgcggcaggaaacgccggacgaggaaaaagggcaggaaggcgaaagggccgcgcatcccgatgcgcgtgcccatcgcggaccggcccgaggcggtcggatccaggaaggggttcggccatttcgagtcggacacggtggtcggcgccgcgccgtcgaggcgctgcgtgaacacgcaggtggagcgcaggagccgcaggctgttcgcccggctcgtcgacgacaagagcgcgtccgccacggccagggccgaatacgagatcttcaaggacatcccgccggccgcgcgcgtcgaccgcacgtgggacaacggcacggaggcgagcctgcacatgctggtggacgaggcgctgggcatgctcacgtacttcgccgacccgtacagttcctggcagcgtggcagcaacgagaacaggaacggcaggatccgccgctatctgcccaaaggaaccgggttcgaggacttggcccaggaggacctcgacgcgatcgtcggggagatcaacgacacccccatgaagctcctcggctacaaaacgcccaacgaggtatgggacgaggagatcgccaggctacaatcgaaggcagccagcccgaacacaagcgttgcgcttacaaattgaatccgggccgccgaggcattcgccgacgaactgctagaattgcaggaccaacagggggtgttgcacctctaaatagacatcgggcacacggtttgcgcggcggtgagcagtgagtggtgagtattgagcgacgtacggcgactcacgtgcgctcacacagtggtgagcaatccgccgaacaacaccacgagcagggcgatggtttcaatcacgaagtacagaatgaaactcgcccagcttttggtcagtacgttcagcggcgaggtcttccggataatcaccagcagaccaacaaacaccagggcgtatacggcgatgccgatcgccgcccccataatgcccagattcgcggcatttgccagaccggcctgcttgccgtagaccacgtacgtggaataccagaagttgagattgagcatgctgagtcccgcgatgaactgctcacaggccagcccgagcacgaacacgatcagccatggccaggacggcgagacgaccaccgccatcgccaatccgacgtacgtgatcaccacggccacccaaccgaccagtgcgataccttgcggagacactcccccgagcacggccacaatggagtcagtattattcaccgccagcgagcgaccgaaccagtatggcgcgatgatggcgcacagtacggcaagaataatcaacgcccaacgcaacggatgggagcgacggcgctcgatatcagccaaagacaaatcggtctcgggtatggaagcctcggggtgcctggaaacctcgacggtctctactttgccgcctacgatttccgtcgcctcgttaggttcttgctcgttggattcctgctccatgcaccgcctcgccgattacctgcttattgccatgtattgccatgccgattattgcgatgcctatcttagcgtgcgtgttgggcaagtacctgatgtttcctgtggtttcgcgcactgattggatacagacaggctactgctgttgcccgtctgtatccggcgacttgtccgccgctgtatccgtctgttcctcaggcaacgtattggcagcctgttccttacgccgcctgccgtgcagcagggcctcgagcatgtcgacctgacgctccagttcgtcgatacgacgtacctgctgcgaaatcagcaagtcgcgtaggtcattgttctgctctttgcgggagacggggaagatgatggcgcgacgttcgggcgatacgtggaaatcggattcgctgccggtaccagccggaagtgacgattccgccgagtcgcgccaagctctcgctgctcgcgcactctccggaatgtttggtgcgcccgcggctcccgagcggaaaagctccgaatctgaagcccccccccccagcttattttccacgccggctttggcattgccggagttcaggatttcgtcttgcgattcacgccagcgggcaaggcaacgttcgatgcgcttgtacccgattagagccggatccaatccggcttcacggaacatgcgcacgggtgaggcaccttcgttgtagtggactacacagtaacgcttgaaatcatcggtataggtgatgcgcttcgccgtggcttccgccactgccgacaacgacttcagatacttgatctcctcggggctaaaagtccctccaccactggtcatcctcatcccttacactcgttggaaggctcattgcacaccccccttgattatggggtgaatgccatagttcgggatagtaatacttataattcggacatgcctaacccctagtagggtcgtttttatccccgtttaagtggagcctgagtagtggctggacggcaactgaacgataatcggcccacgaatggggtatacaggcccatccttcacctcccctacgattgtgttcgcttggcgattgttaccgagcctgcgtgaaacgtttgttgtggtgaaacacaagttattttcgatgcccggccccattacattcaaatcaaaatgccatacattgcccataagattcggagatggtccacaagtcatccgtctgagatgccgccaatatgacaaatggccgatctgaataatcagatcggccattgttatagctgctcagttataagcagcagtcaagctcacgcgttgagagcgcgcttggtggaacgggacttgacgaacacggtcaccgcggcacccgcgatcagcagaccgatcacggagaacagcatggttccggcggcaccggtgagcggcagctgggtgatgttcttgacgttggtgacctggaaggtgcccttgttgtccttggacaggttccaggcatccttaccagcgaaggtggcagcagcatctgcggttgcaccggtagtgatcgtgaacttgccaacgaaggtgccgttgtagccagtcgggaccttcgtctcaatcacggtgtaggtggtgttgagcttaagaccgttcagagtgtacttaccctcagcgttggattgcagtgtgtccgtggcgccttcagggtaagtgccatcagcattggcggtcggcagagaatacgcaccgttagagccattgaacttaagcggagtcttcgctttgagctcgtcagcggaaagaccgctaacatcgccttcgtacacttggaactcagcaccagtcagagcagcagcgttcttgtcgactttctgccaagtcacggcaccagccttggtggtttcttccttgctgctcttcaggtcgacaacgccggcagcggcgagaacgccagtggcgttgttcacggacggcgcggcgcccgtgatagcagtgccagcgagaatcggagcattgccattccacacgagcttgtgagtgtcattatcttcgacgaccagctttccactctggtcgacaatcaagtacagaccaccctcagcgaaggtgaaggtctgggtcttgccaccgttagaagccgtcggggtaatgtccgtgacagccagatccttaagcgcgttcacaaaagcggtggtctgcgcggcggtcagggtagtgttgcccagccaggcccactcgttcagggaatcacccttggtctggtcgttgtaaccagcagcagcgaaagcagcatccactgcctcaccggagaccaaaccctccagctcaacgccagtgttgccatcagacacatacttggcgagctcaacgtacttgaacatgcgcaggttagcctgcaggtcagcggtgtcaaccggcttggtgtagaactggtttgcatccgtggcgttgactgtgatagtcgtgctggagatgttggcctcagccgcgttggcggtggtggcgccgaaggccatgccaccgagcagggtggccgcagcagcgacacccgcgaaaagcttcctcaacttcatgagaaaccctctcttccttattgtgattgattttcttgcaatcgcggaggctgcagacccacagcagggcctccgtgatccgcaaatccttattgttttttcggggagggaagccttcatcgactcccctcagtccgccttcggcggccagctcccctcagcgagaggagccaaaaccacctcaagtttcttgaaatcagaccagctgacgcttacgccacaccgtgtagcccgcagcagccaacagggccatcaggcccacgccaccgccgaacaccatccagtcacgaccagtcgtgccaccggtcagcggcagactggagatagccacatacttgttcgtgaactgtgccgactccgtattcgttcggtcggaatcgttctcgccgtactcgtaagagacaacggcatccgtcctggagaccgtgaccttgacggtcaccttatcgttgtcatacttccaaccggcagcaggcttttcggtgtcctccgaagcctcgaacgtgtagaccaaattgtcagcaccggtcggaaccctgaacttcaggtccccattgccgaagccaaccgtcgcgctcgcgccgctagcagtcaattcgtccttggacacagtcgtagtcagtccattgttggccaagccggtaacgtcagcgcacttaccagcattcgcatccgtgctatccacgcacttcaggttgaagccgaagtccgaattagcagcatgtccctgcacaaccttcgtcaccttgacatccgaagcgggcaaggtcacgtaagaaggcgtgttggttaccgtgaaggcaccggattgtgcggtcaaaccttgtagcttgaggtcagtcttatcaaccttggagtcatagccttcaaccttgacctcggaaaccgagtatgtgtgcccctcagggccggcaggcaccgtgaactcgtgagtccagttgccggcggcattcagagttgctgaaccgttggcataatcctcgccgtcctgcttgagctggacctgcacggaatcattcgcgtgattctcgttgtcgtcggaccaggtcttcgtcaccgtaatcttggagaccggaagggtgatggtcggcttctgcgggtaggcggcggtctgcggatcgctcgtcgtcgtgccgccctgcgaggaggtcaccacggtcttgtagtcgacagtggcgctggagttgtcgttcgtgtagaagttgttgtcgccggaggcattggcatcgtccttgtggttcttaacagcctcgtcgaacgcagcctgcgtcggcttgacattgaagctcaccgtgtaggtgacgccgtcctcaagcgtgtcgtcgttggacatgaccggccaagacacggtgccatcagccgcaaccgtcgcctccggggcgtcatcccacgccgtgatctggccgttccgggtcttcgtgtacgtgaagcccgcgggctctccattctcggaggcgctgtcggagctcacgacccagctggacagcctgtcgtgaatcgtcacgtcggcatactcagccgtcttggtgatctcctgataaatggactcgaagatgttgttcagctggccggcatccgtggcggccttgtagtagctgctggtctcggcgcggtcaccgaggttggcgttccaagactttccccacaaatgctcactgctcgttgcagtggcatccgggtagttgctggagatgccgtgcatgtacttgttcaggttgctcgaggtgtcgccggggttggcaccgctgacgacgccgatcgagtagatggtcgtcccggcgtccttcaggctcttcgccttgttcaccgcggtggcggcgacggtggggtcaaacccgctgccgtggttcggctcgccgtcggtgaagaagatgacgaccttcttcgcgttggcgcgaggctgatacgttagcgccgcctgggcgcggttgaaggcgtagtcggcggaggtcgcgccggacgcgctcaggccgttaaccgtgctcgtcagtccggagacgtcgtacgtcaggttgctgacgatctgcgtgtagttgtaggaggaccagccttcgcggtaaaagtcattgccgacgctggtcttctcggtgccggcgaacttcaccagggcgatgcggttccgctggctctggtcggtaatcttcgcgttctctgcagccgtcgcattgatgaatttattgaccgcggtcttgagcgagtcaatcttcgtaggctggttccaaccgctagcgatcttttcggccatcgaaccggacacatccaacaccagcacgatgtcgagtggctggttcgtcacgatctcgcccgtacccgcgctcttcgcaccggtgacgttcaacgccaccgtgtacgtgccgtcttcattggcggtaacggtcttctcgcgggccggagcagacaacgtcggatcatccggcacgccgtttgttccctcggtggaaagaggagcaggcgcgctggcggccgccttctcatcggtggtctgcgattgtgtcgtggaggcattcccatcgtccgccatggcggtcgcgctcacgccggcgacgccgccaagcatcgctacggcggccacgacggccactagccgtttgccactcctgcccgctgcggcccctaccgctgcgaaccattctgcaattctcttcataaccttgcctgtctcttacgatcacgtacgccaaaacccggcgttacgcttataaggcgttacggtattaagcaaaaagcacgaatgcgtgcacccgggtagagggaattttttacccgacactgaaaagaaccttggaatttttgaaaagtggcaccctcgtcatccaccctgcgataacgcacttttcttctcgacggggcgtgccggtcccaccatctgggaactgaggcggatttgccgccgctgcgcgggggccggagttactgacgaccgtcagtatgccactgctccgcatgtgtgcagtatcacataccgctacgcatacacggagacatactacatgcaatttctgtgaacgcaaacatacgactcaccaaggccgtgttctgttgcgggcggtggtgttacgggcaatgttgtgggtagtaccctagccacaaacctatatagtggagcggatgacgggaatcgaacccgcgtaatcagtttggaagactgaggctctaccattgagctacatccgcgttaaacgtcgcttttggcgacttgagttattatacatatttcttcggggatggcaaacgcgtgtggctgcagcaggaccagcaaatctagttgatggattgcggctttgccgaggactcccctcagtcgcctacggcgacagctcccctcaaagaggggagctggaaaccgtcgaaatcacaaatggatgagctgggactcgtatggttggaggtcggcgcccatcgcattcagaatcacgaaccagcagttttcgggcagcgagtcgagcttgtcgatctggttcttgagcaggcgcacgtcgcggctggtgagcgcgccccacaggttaaccatgatggagacgttgtacagcatgtagcactcgggggcctcgggcgctattccacagaaatcgtcaccaccgcggaggcaatcgaaccatcgtggctcagggaaatatggatatgcggcatcgaccccgcaccgatagtcgagcgctgcgccgaacgcgcattccgccgctcctgcatcactgcataaggcccgttatcggaagcagaggaataagcagaggaatagcgagcgccggcagccgaattcgcgtaatcagtttggaagactgacgccgcccccttacccagagacacatgcggcacaccacgggaatcgtccaagatctcgatttcaggccacgggaaattatcaagcgtgaacggatagggggcatcgccaagataatcgcaccaggctttgaggaacgcctccttgcccgcccatttggcggccagatggacggcctccccgtcattcttctggcgcgcgcggtcggatgcctgccgcacctcacgcacggagaacagcgcacgcatgcgagaccccggctccgccaactgttcggcgaatgcggccacatccaccacgtcatgccccaaaccacaagtattcatgcttcctattgtgtaccgcttcgcgcgtaatctctacacctcatcagaattggggcctgatttccatttcagggggaaaagattcactatgctggatgacctcgcgcaataccgcaaacatcttgggctggctgcctagccgtccaaaaaaacatccgcgccccgccccgaaggtctatctccgtttcgaggggcggattttgaccgttccggaggtctacttccgtttcaaggggctggtcatcctccataccacgagtatccgcagcataacgccaacgccattccgccgtttttacgccttgtctacttgggtaacagccccttgaaacggaagtagacctccggcgaatgccaaatcagccccttgaaacgcagaaagcccactccgagggaggggctttcgtatgttctgcatatttctctcactgagtttgtgccagcgagaaagctccaggggaaactcccctcacccgcttcgcgggagctcccctcaaagaggggagccgagatccggtgcgctactggctcccatcaaccgaggggagccagaggaatcaggcctcgtagtagccgtcggcaccgaggcgggcgtccgggttgaggagcatcgccttttcgacctcgtggtggtcgtagccacggtgatcctcgcggaagcgacggttgtcgatcggctcgtagagcgcggcgcgacccatcatgccttcctcgaggtgacgctggccggcggccaggcgggcgttggcacgctcacgccaggcttccagcgcggcctcgccatcggccttggccacggccgcttcgaaggcacccggatgaaccagggccacgaagccggaaacatgtccgaagccgagcgaggtggccagaccggccttgaccgggcgaccagcggtctcgcgaccgaactcgtcctcgccaccgccgatgcgcaggggcttcctaacccagaccatgtggtcgtcgcgctggagcttcggatccacgcaatcgagcgctgcgttcgccggaatcacgccggacttgaacagctgcgtcagaccgttgacctggaagatgcaggcaccacccttggcgtggccggtaagcgtcttctgcgagatcacgaacagcgggttgccgtcggtgcggccgatggcgtgggccagcgtgttgtgcagctcggattcgttcgggtcgttggcgttggtggacgtgtcgtgcttggagaccacggcgatgtcgtcggctgagacgtcgagcttagccaggtcgtgcacgagcttggagtccttgccaccgaggccggcagccagggcaccgaggcccggagccgggatcgaggtgtgagcaccatccgcgtaggagtggatgaagccgaccacggccgcaaccggcaggccgagcttttcggcgatgtcaccgcgggtcacgaggatcgtgccgccgccctgggattccaggaagccgccacggcgacgatcgttcgcgcggctgaagaagcgcgcgtcgatacccttgccatacatttcctccgagttggcggtggcgttcatgttgccgaaaccgatcacggattccacgccgatgtcgtcgatcgcaccggtgaccacgaagtcggccttgccgagggcgatcttgtcgacgccttcttcaagggagacggccgcggtggcgcaggcggagaccggctgaatcatgttgccgtagccgccgatgtaggactgcatcacgtgagccgcgaccacgttcggcagggcttcctgcaggatgtcggtcgggatctcgtggttgaggaagcggtcgaggtacagcttgcgcatcgacatcatgccaccgaagccggtgccctgggtcgaagccaccagcgaggggtggatggactcgaggatttcggccggggtgaagccggcgcccaggtaggcgtccacagtggtgacgatgttccacagggcgatcttgtcgacgtcgccgaccatcgaggcgggaatgccccatcgggtcgggtcgaagcccttcgggaactggccgccgactgtgcgggtcatggtggcgcggcgcggcacgcggatcatcgagccggcgtggcgggtcacgttccattcgccggattcctcatccggggcgatggtggtgtgagcctcgtccagcttgacgtattcggtggcgacttcgcgggtgggcacagagaaggtgacgtcgtggtcgaggaagacctcggcttcctcttcgtcagcaccgtccttgtagtcgttgcccatgccttcctcgaacgggcggatgccggagcgggccacgacctcgtcgtggtagcgctcggcgatgtcctcttcgggcacgaggttgccgtcggtgtcgtaccagccgggcttcgggctgtcggcccaagtcagcaggcccatgttccacgcaagttcgagcactgcgccggcgctcaggtcgacggtgccgtccgagtggatgccgagttcggcctgggcgcgcgtacgaccggagccccacgggcccagctcaccgacggaaacgatgacgatttcgtcttccggcttggcagtgacgttggtccaatcgttcaagtcgaccggggcctgcttggtgacgatcggtgtgggcagcgccttgatttgctgcccacgcgaggagtcggacagtccagtggaccgtccggcgacggagccatccgtttcctgagacgaggccgcagcagcttccttctcggcgtcggccatggcctccgcacgcagggccttgatgtcgatgggctcggagccgaggccaccggtcaggtccacatcgagcggggccttgagggcctgctcgcgcgattcggcagtgcacaggtcgagcagcttggccgcaatctgtgcggtggagtaggtgcggatgccgtgacgttcaacgacggcgaccagcgggtcgttaccgcccatcaggccggtgccacgcacccagccgatcttcgggtgagcgaaggtgacgcggctcgaccacaccttttcagcgcgggcacggttgacgatggcgtcaaaggcgctcttgacttcgccgtaggcaccgtcgccgccgaatacgccgcggttcggggaaccgggcagcaccacgtggagcttgtgctgcacgttggtgtcggcaccgatgtggctgaagccggcgatggcgcgttccacgccccacagcatcagtcgggcctgcgattcgaacaggtcgccggagtcggcgagcgtgccatggaccggcggagcggcgaacgggaagaacagggtcggctcccacgcgggcttcagaatcgtggtggtagcaccggaggtcttcttctgctcgtggcccacccagtcgaccagtgcgtcgacgtcgcggtagctggagaggttggccggaaccagccacagcttggcgttgccggtagcgtgctcgcggtaggcctgcttagcccaagccttaatggacggcttgaagctgtgcgaggtggccaccacagtggcaccgcctgcgagcaggccttcgaccacctgagcggcaatcgagttcgggctcacgccggtgacgatggcgatatcattcgcgtaacgggaggcgttcttgttggacgcaacctgttcgagggcctcggagccggccttctggaagacggccttgagttcttcgctctccgactcgttggcgaaccactgggcttcggcggcgatggtcttgccaaggccgatgaagctgccgttcagggcggcgggatcgttgtcgtagtaggcgcgggcgaggtcttcgcgggcggaagcccaccgatcatcgaagaggatggccttgttggcgtcgaagcgcggagcgacctgcttgggccagtcggagccaagttcggcttcaaccgcggccacgacggcggcgttctcgtcctcggattcttccggagccggagcggccacgccgagctcgttcagcacgaagcgggcggtggcggcgagcacgccgttggaaccggtgaccttctcggcgaaggcgtcgagcgcggcggaatcgaccacagcgccaccagcggcaccaccggcggacggcagggccacggcaacacccttgagctgggcgacgacctcaacggccgcatcaatcagcttgtcggcttccggcttgttctgcacggcggcggtgggcagcttagccaggtcgccgccacgggagctggcaccctcgcgagtgtcgagcagcagtgtggcgagcacgctggccacccaaccttcaccgagctgccatacgttggtcacgcggtcgcggatgtactgctgcttgacgccggcggcaccgaacagcgagcgcaggcggtcgcgcagcgcctcggagagcacggcaccgaacggcttgtagttcggggcggccttgttgacgatttgggcgagcttgtcgagcgtcgcttcagcagcaccgtccacgctggcgactcccagctcggagctgatgtccatgagcagctggttgcggcgagaagagacaccgttggtcagggtgtcggtggtgtcgttgctgccgatctggtcgagacgcaccttggcggagtaggccatgagcacgccgatggcatcggaagccttgaagggcaggtcggcgacggcggcaccggacggtgcgccagccgcggcctgccctgattgcaggccgcgcgaggagtcggacagtccagtggactgtccggcgacggagccatccgttgtctgagcagcctcagtcacggcatttgccggagcggcaccggaaccgagcttggcaacggcggaaccaccggcaggagcggtttcgaccggggccgaggccgcagcctcttccggctcatcgtcgggaaccagcgaatcggtgtcggtcatgtagacgcggccttcatcgcggccgacgttgtagacgaccgtatcgttgccggcgaactcgggcagatgcagggtcttggcaccgaggttggccagggtcggggcgttgccgaggccgacttcgacgtattcttccacgccgaggccgccctgttcgcgctgaccgaagagcagcgcctgggtttcaatccaacgcaccggggaggcgaactgccaggagagcagttcggtcaagagcagacggccgagcttctggtcgtcatcggcgtaggaatcccacacggccgggtcgtcgagcgcggccttgatacgctcggacggcacgacttcgaggatcttggcggcgaattccttggtcatctcgaacggggtggccaccaggttcgggatgtagcggtccaccagacggccacggtagtcgatgtaagcgggaagcagcgcgtcgagcttgtcgcggaattccggcacgcccttgcgcagcagtgtggagtggaacggcacatcgatgccgggcaccagcatgaacgcgggcttgccaccgaatgcggccacgcggcgggcggaatcggccttcagagccttgagtccggcgatcgtaccggcgatggcgtactgctggccggcgaggttgtagttcacgatctccaggaattcgccggacgccttggccacggattccacgtattccttgacgtgcgcgtcgtccacaccgaactggttcgggcgcagggcacccatgcggtagttggagcgaccctgtgcgtcacgctcgatgaggtggtgcatggtggaaccacggtggaacacgagctccagcacggtttccagcggaatcacgtcggcgaacgcggacagcgcgttgtattcgccgagcgagtggccggcgaagtaggcgggccagatgtcggcgccggcttcgcgcagacgagcggtctgggcgaaggccacggtggcgagcgccacctgcgtgaactgcgtcaggttgagcaggccttcggggtggcgataggtcacgccgttggcggtgagctccttcgggttatcgcgcacgaggcccaggatcgagaagccgagcttggagcgggtgagcttgtcggcgcgctcccacacgtcgcgggcggcggcggacttggcacgctcgtccagaaccatgccctgcttctggatgccctggccggggtagacgaaggcggcgcgcggcgcgcggaccagtgcggtgccgcgggagacgagctggccgtcgatacggcaggtgacttcgagggtcatgccgccgtggcgcaccttgccgacgcgctcgacggagatttcgacggtgtcgtcaagctgaaccatgccgtacatgttgtaggtccagccggcaatctcgtagtgggcacccttctcgtccagcgcctgcacggcgtgctgggcggtggcggacagccacatgccgtgcacaagcggagcggccaaaccggagatgcgagcgccacgagtggaggtgtggatcgggttgaagtcgccggaagtgcgggcgaaggcggtcatgtcgtgtggggcgacgaccttcacgcggcgcagcagacggcgcggcgtgggcgcgatctcctcgtgctcggcgtcgccgaactcgggggcgtctgccggcaaagcatcggagtagacgcggccgcgaatcgcgaaacgctcggtttcgcgggcaagcagcgtgccgtcggcagcggtgtgggtcacgtggatggtgaccacgcggccggaggcggactcgaagtaatcctcagcccaagacttcagggtgatggtttcaccggtgtgcttaagcaggtcctcctcgttcacctcaagttcgatgaggtggtcgaggtggacggcgttgagcaggccttcaatcaccgggtagcccttgacgtacacggagccgagcgccgtgtaaatcgccggccaggccgggccgaccagcgcatcgggagcgatgcggctgggctgcagggtcgtcggcagagcggcgccggtggccgcttcgtggtcgaagccgaggttggcggagagggtgtaggcggcggtggcggtagcaaacggacgctcgtcagaggtcttgccgtcaagctgcggcatctcggtgagcttgtcgccggtgatggcggtgttgccgatgcctgcggtggcggcgagcatcgcgtagacgtccggaatcaggcgttcgcggtccacgaccggcacacggccgggctcggtgccttccacgatgagcgggatgacgatatcgcgcacggcgtgcttggaggtgccgccgtccgggtcgttgtcccagtaggtgtcgaggtggatgtccagatcgtacttgccggccgcggcgtcaaacgcgcggatctcgtagtactggtcgcccagggcggtgccgtaggcggggttgtcggtgatgtggccgacccaggagatgttcggggacttgcggatgaagtcctcggcgctggtggcctcgccgagtgcggcgaaatcgtcgttctcagcggcatcggcggcctgctgttcgtcctgcacgcgcttgatggcggcggtttcgaagcggccgaggatgtcggcgatcggctcgtcgatggtggtgatgccggccacggagatcgggccggggatggcacgcacggaatcggcggagtagcgctggtcttcggactgccagagctggtcctgaccccaccaacgcagcaggtcgttgtcgatgacgggcacgaacggcatgggcttggggtattcgcgcacgagcaccgggaaccaagccacgtcggccggaaccaccttaagttcggcggtctgcgggtaggccagtgcgagcttttcgagtgcgggggccggatcggcgagaatgtcgtcgtgggtcagcaggtcagcggcagctgcctcttcagcagaaacgccatcagcggcgaacagcttggaggtgaattcgccggagtccgtgtcgttcacacgggcttcgatgcgctgcagcaggtgctggaagcggtcggcgtaagtcgggtcggcccacgggaaggcgagttcggcgaagcgctgcgcccactcaaggtaggtcatggaggccaggtctccgaagtaaggcttggcggtcttgttcagggcttcgatgatttccttgcggcgggagtcgagctcttcggggtgcttcatgacgcgcacgagcagacggccgcattcggcggagtcgttctcgagctcgtaaatgtcggcgtgcaggtggctcaggccggaggacatgccgccgacggacttgccggacggcacccagtgggcggcctgcggggcgaacacgtcgtcggacttggcgtcggccggaatgccgggcgtcttgacgagcagctgcttgacttcggggctggtgtgagcctccttggcggtcatcgcggcggtaccgataagcacaccgtcgaccggcatgtcgggcaggccgtaggcgtgggcccactggccggaaatgtagtcggcagcgcgttcaggggtgccgatgccgccgccggcgaccagcacgaggttgtcgcaggcgcgcacttcggcgtaggtggcggcaagcaggtcatccagcgcttcccagctgtggtggccgccggcttcaccgccctcaacctgaaccatgatggtggtgggggccacggccttggcgatacgcacaacctggcgaatctggtcaacggtgccgggcttgaagctcacgtacggcaggccgtcagcctgcaggttcttgatgagctccacggcttcgtccagctcagggatgccggcggagacgaccacgccgtcgatcggcgcgccggatgtgcgcttcttgggcacgatgcgggaggagccgaactgcaggttccacaggtaacggtccatgaacatcgcgttgaattcgaccgtgcggccttcctccagctcgtcttcgagggcagcgatgtggcggtcgaatacttcggcggtcacctggccgccgccggcgagctcggcccagtagccggcgttggccgctgcggccacgatttccggttccacggtggtgggggtcatgccgggcagcagcaccggcggcttgccggtgagcttggagaacttggtgaccagcttggcgccggccggggtgttgatgacgcgcggggcgaacgccttccagttctgggtgcgctcaggctcgctttccagcatggagagcgtggagcgctcggccagcgtggtggcttcgaccacgccgatgccggtgccctgcaccacgttgccgatcagcttgccgagcgtgttgccggggccgaggtccacgatccacagcttggacgggtcggcgtcgtcgaacagcgccttgacgcgggcgttccagtccacgtggttcaggagcacttcctcggcgagtgcacgggtgcgcttctggtcgaagccgcaggcgccggcccaggccacggtctgttcgacggcgtcggccatgagcggcgagtggaagggcagggtgacctcaaggtattcgagggtcgggttgaacacggtgccgccgtggagcttctgctcgcgcagcttggcctgatgctggtgttcgcgctcggcttcgagggcgaaagcggccaggtcttccgggtagccggacagcacgtggtggttgtcggagttggtgacggcgatggagatcgggccgcgagcgttgttgacgcgggccaccagagcctcaacctgttcgcgggtggcgcccttgacggagagcatcgggctggcttcgccgtacttggggttcaggcccagttcgcgcacgcggcgggttccggcggcgccgatcagggcggccacggccagaatctcgttgagggtcttgccggcggcctcgatggagccggcggcctcgatggcgcgggtcatgtgcacggcgagcacgccctgggagtggccgagcacggcgagcggcttggcctgggccacgctgtagccgaggtgttcgaggtcgagcagggcgccgagctgggtcagtgccacgccttccacggacgcggtggcgtcggctgcggcgccgaggcgtgccgggttcggggcgaagccgaacaggtcgaccggacggccggtggtggccagcaggtcggcggcgaccggggtgagcagtcggccggctgcggcgacgtggccgcgcagggcctcgtcaaggctgggatcggtggtctggtctgccagggctaccggccacggggtggactggccggcgaaggcgagcgcatggggctcggtggctaggcgattgaggaagaaggtggtcattgctttccttacttgtgtttggttgacgtcttcaaaaatcagaggggctggttgccgtggtgtttggtggtgcgcttgacgcgccgcttggtggcgagcgtggccagcgattcgacaatcacctcacgggtctgttcggggtcgatcatgccgtcgatctgcccgatttccagtgacaggttcgcgttgacggtgctggtctcgtactccttgatgtacttggcccgcagcgcatcgacgtcctgtccggaggccttggccttggccaggtcgtggcggtggatgatgttcaccgcgccggccgcgccgagcaccgcgatctgggaggagggccacgcgaagttcaggtccgcgccgatggccttggatcccatcacgatgtacgcgccgccgaacgccttgcgcaacaccacggtcaccatcggtacctgtgcgttggcgtaggcgtagatcaccttggcgccgcggcggatgatgccggcgtgttcctggtcggagccgggcttgtagccgggcacatccacgagggtgaccacgggcaggttgaacgcgtcgcacaggcgtacgaatcgggcgactttctcggacgagtcgacgtccaggatgccggcgagcacgttcggctggttcgccacgatgccaaccggcttgccgtcgatgcaggcgaagccgacgagcgcggaggcgccgaacagttcctgcacctgcacgaattcgccgtaatcgacgatgcaacgaatcacttcgagcatgtcgtagggctgacgttcgttggtgggcacgatggtggcaagtcgcttggcggtctcgcgttcggcgcgggtgacggcgtaggcgtagaccggcggcttgctttcgctgttggacggcaggtaggcgagcacggtgcgcgcatagtcgatggcgtcggattcgtcctcgccgaggtagtgggccacgccggacacccggttgtgcacttcgccgccgccgaggtcggccatggagatggtctcgccggtcgaggccttgaccacgtccggtccggtgacgaacatgttcgagttctcacgggtcatgatgatgaggtccgtcagggccgggcagtagacggcaccgccggcgcaggggccgagaatcaggctcagctggggcacgaagccgctggcctcgcaagtcttgcggaagatgcggccgtactgggtcagggcggccacgccctcctggatgcgggcgccgccggagtccacgatggccacgatcggcactttgaggtcgatggccatgtccatcagtcggcagatcttctcgccttcggcggtgccgagggtgccgcccttgacggagaagtcctgggcgtagacggccactttgcggccgtagacctggccgaagccggtgatgacggccgcaccggcgttgccgccggcgatattgccgccctggaagcggccgatctcctcgaacgtgccggtgtcgaagagcaggtcgaggcgttcgcgcgcggttttcttgcctttggcgtgctgcttgtcgcgggcgcgctcttcggcggcgcgggccagttcggcggccttggccacagcggtgcgcagcggctggtgggccgaaggctgggcggcgttggcggccgaggccgcagccgcggccttcacggcctgcgaatccatgatgtcagtcattgccaccctccttcttggcgtcggtggccttatcggctccttctgacgagggagctgtcgacgcagccgcctgagggagagatcccggcgcagccgcagcagccttggccttgccggcgttcacgtccagcgtgaccagcgtgtcgccggcctccacgccgtcggccgggccaacgaaaatcttcttcacttcgccggcggccggcgcgtacacgtagttctccatcttcatggattcgagcaccaccagaaggtcgcccttggccacttgctggccttcggacacgttgatgcgcgtgaccacggcctgcatcggggaggcgatgacgccggatttggcgccgtcgttggccgcagcggcactggaggccacgttgtgcagtcccgcaccgcgcaacggctgggtgggtcgcttggcaccgcgggcgcgggccgagccggtgatgttctccacgatgtcgagtggcacggtgagcttgacgcggcggttgttcatctcgatgacgaacgtctccgacttggacttgtcgggcgcggccggggcagcggcacccggggcggcggccaaggaggccggctggccggaggcggcggaagccggtgtgcggttcaggtacgtgcgctccagccacttggtggacacggcgaacgggtggccatgctcggcggtgaagtcgtcgttgcggaagatttccttgaacagcggaatcggcgtgggcacgccttcgatcacgagctcgtcgagcacgcggcgcacacgggccacggcgtcgagacggttctgggcggtgacgatgaccttgcccatcatcgaatcgaacttcggggagatggtgtcgccctgttccacaccggtatcgatgcgcacgccggggccggccggccactggatcttctccaaggtgccggagccgggggtcaggttggtggccgggtcttcgctggtgatgcgcagttcgaagctgtggccgcgcagttcgggggcgcgggtgagctcgccaccggcggcgatattgagctgttcgcgcaccaggtcgaggccgctgacctcttcggagacggtgtgctccacctgcagacgcgggttgacttccaggaagtacactttgccgttcggggtcaccatgaattcgcaggtgcccaggcccacgtagccgaccgtggtgaacaggcggcgggagtattcctcgagcgtgctgatgatttcctcggacaggaagggcgcgggtgcctcttccacgagtttctggttgcggcgctgcagcgagcagtcacgggtggagtacacggtgaagttgccgtgcgagtcgcgcccggactgggtctcgacgtggcgtgccttgtccacgaacttctcgatgaagtattccttcagatcgccgccttgcagcgcgtcgtggttcatgtagaagcggcgcagctcctcgtcgtcatgcaccacggtgatgccgtggccgccaccgccatcagtgcgcttcatcatgatcgggtagccgtgggtgtgtgcgaagtcgagcagcgtgcgcacgtcggtcaccggttcggacaggccgggcactggcggcactttggcgcgtagggccacgcggcgggcggtaatcttgtcgcccaaatccaccagcgcggtgtggtgcgggcccacccagatggcaccggcatcctcgaccttctgcgcgaagctcggcacttcggaaaggaatccgtagccggggtgcacggcatccgcaccggtcttgtgcaggatgtcaatcagcagatcttcgttgaggtacgtgtccttgtaggtgtcgccggagagcaggtatgcctcgtcggccatgtccacatagcggctattgcgatcctgttcggagtagacagccacggtggagatacccatctccttggccgtgcgcaccacgcgaagcgcaatctcgcctcggttcgcaatcagcagttttttgacgatagaagccatagtgtcaaattgtgctctctatatggaggagagggcaagccgcgttcacacaaaagctttcacgcccttttgtaggctacgaacaaacgcgcgcgtaggttccggcaacgtaaccgttggcgcctgctatcaaaaacgttgcaaatccgccgattgcacatccttgcgcgccggctcaagaagttgacgttacggttgtgttcgtcaacttatgacaaatcgaaatcgacaattttgtaaattggtacgaaaccgcacgaaatcgaacacctctacgatggcaaccgtaagttcgggggaaggctcatctgcgggcgaacggaaggtgaccggaccggcatcggtccatcgccgcacgattcgcccgcacagggtcggattcatttgggaccgtccaccatatggacggttcggactgtcggggataccgcacgacccgccggaacctcccctcatccatcgcataccgcccgccgttcacggcgatatcacgcaacataggggtcattgatatgcagacttcacacaccaccgcatccgctgcggccaccacatcgctcgcccgtcgtatcgtcgccgcatcctggaagccggtgctgttcgccgtgctgatgtggctgtccgcggccgccggcgagattccgattccgggcacgccggtgccgatcacgctgcagacgttcgtggtgatgctcgccggtcttatgctgccgtggcgtcaggccggcgccgccgtcgccacctatctggcggccggtgcggtcggcctgccggtgttcgccggcggcacctccacgctggccctggtcggcccgagcgccggcttcctcttcggcttcctgccgggtgtggtggccatcgccctgctgcgcggcaagtccgacacttcgtccttcgcggccgccgcgcgcaccgcgggccgctacctgctggccgcgctggtcggcggcgtcgtggtggtgtacgccttcggcttcgtcatccagtccgcgctgaccggtgcgccgctcgccgccgtggccctggcctccatgggcttcgtggttggcgacgccatcaaggccgtggtggcctctctggccgccgccggcctgtccaagctcggtcgctgacctgagctactagctagctactggccggctattacagcactcccacatcggcggtgcggaccgtatggtccgtgccgtcttgtgttctcaggatcagtgaggcgtcttcgttgaggccgatggcttcgccggtcagcgtggtgccgtccgtgaagtgcgcctcgacctgacggccgcgcgcccagcacaccgccttcacctcctcgcgcaacgactcggcctggcccttcgggtcggcgatgaacttcaccaaccgctcgcggaagccctcgacctgacgttcggccaccgcatcgcgcatctcgccgaacgacggcagcccggagacatgcagctgcagcgaggtcgattgcggcgtgggcagccgacaggcgcccaaggccaggttcaggccgacgccgaacacgatgacgacgtcgtcatcggcatcagcatcagtaccggtaccggacgacggcggaatcaccagttccgagagcagcccgcccagcttgagcccgtggcagaacacgtcgttcggccatttgagttccagcgagcagtccggctggttcggcgcggcaccgtattcctcgatcatgccgttcagggcgtccagcgtgaccagtccggcgatcatctgcagccagccattgacggattcgtcggtggcgatcgcgcgcggaatgcgcacggcataggacatcgtcgagcaacggccgggctgactgacccacttgtgaccattgcgcccacggccggcggtctgccggtcggcggccaccacggccaccgccagttcgccatcctggtggtcgggcaacgtcaacgacccgtcgccaatcatctgtacggccagcgcgttggtcgaatcggtttcgtccacggcgaccacatgatctgcgacggctgtagttctgggtagctgcggcgttgcagctttcaacgcaatcatcatgggcactacgttacctcgattttggcgcgatatgcccgcgttattccatggaaaagcgcgcaaaatcaactattttcacccacatagcccatgttaacgttcacaacttcggaaattccgcattcgccgaccccacgcatgcacccggccgtcatattggcttgcgaacaacggcgatgcccggcagacatcgaatatcaaccgttgacctgtgcggctaccatatattgtcatgacgtcaccagccaccgcgaagcttgccgccgtatccagccgccagtcccacccgcatcttgcgcgcgcgggcgctgccgcgcgctggacactggccgtgctggccggcctgtggcttgcactgtgcacggcggtcggcccgctgtactgggacgaggagaacggcaccctcgcccattggaactgggccaataccgcaatattcgtcgtgtcattcctgatatatctcggaatcatcacgctgatggtgcgattcgcagcaggccagcgcatactgccgagggctatcggcgagcgactacgtcaacatcagcggaatagcgaaacatcacggcccgccgccgatcagcaggccagccaaccagccaagacccgtcgtaccgttcgcgctatcgtcacgtccaccgtcactgttctggaccgctggatcacacgcggcacgaaccggttctggaagcttatgctggtgttttttgtcggctggctctgggtgccgaccactctgctggccgcattcggtgcggacctccgctcacagatccgtgaattcagctgggcctggaaccagtggaccggcctgaaacagccctatatcggcttcttctccttcgtgccgatggacatctaccccactgcgcactacatgtggccgtccgatcccacgtatctgaccgaccagcacaatgtggtactcactgtgttctatggcgcgatggtcacgtttgcgaggcatctgaccggctcaaacgatgccggtatcgtgacgttggctgccctgcagacgctgttcgccgtgttctgctgcgctgccgccgccaatcgattcctgaaccggccttggataggaaaaacggcaacggattccgccgctcccccacaggccggaggattggctcgattcctgattctgctgttctttatggtctgcccgctggccgtgttttccactatctccatcaccaaatcgccgctgttcgcgttctcgttcgtctggtggttcagcgtctggtatgaactcgtccagacctggcaccccgccggcacccgcaaacatcctcagacccctgccatcgccacgcccgtccacttgccgcgtcacagtttcatcgcctttatcctggccacgtcggtgatgctgatttccgcgaaatatgcgtggtacatcatcgctctgcaaatcgtgctggctctgatcgccgaccgcaagcgctgggcgacttacgtcgtggcgctgctcatccccaccgtactgattcacggcggcatctccttcgccatctcctctggtgcgatcatcggcggcgatccaatcgaaagccgcggcgtacagctgcaaatgatcgcccgcgtggctcagcgcaatccggacggtatttcagacgaagccaaaaagaacctcgcgcccgtcttcaatctcgatcagatggccgacgcttactcccagcaggatgccgacccggtgaaatcctccggtattcaggccaagaaggtcagctacaagtggcgcacggtgacgcccgaggatatgaccaatttcaacaaggcatggttcgaaatcgtcaaggacaatccgatcatcgcgctggatgcgttgctggccaaatgcttcggatacttcaatgtgaacgatcagccgtacgtatcgatggattattacgtggccagcgattacgtgcagaaaaactccacatggatcaaggattacaaccatgactggcgtgagcacatcgccggcttcactcgcgtatggggcggtattcccgtgctcggctggcctacgcacggcaatttctacgtggtgatgacattgctgatcggcgcggccgaggtgattcgccgacgttggctcaccctcatgacccatattccgctgctactgctgatgggcgtgatgattaccgcgccggccaataatttcgagcggcacatgttgccggttgcgtttgtattcggattcgtggtgctgacgtattggcgagagtctttggctgaaaggcaacgccaatcagcgacgctacactagtgactatgtcagattttctcgaacttcttgctgccgacgttgccgattcgtccgcacccggcatcgccgcgaccaaccgcgtacgcaccgtgctgttcgagtgcctgttcaatcatctggccgacgaacgagtggagtccctgttcaccatcctcggcttcgagcatgacttcgattgttacgccatcgccggataccctgcccggtccgccgcacgtacggccaaggaaatcgagaaaatcgtagccgatttcggcggtgtgtgtctgaccgccaagcgcccgatcggcaacagcaccgccgtagtggcgttgattcgtccggtcggtgcggccacgccggaaatcatctgcaataccatcgacccgtcgttcgccgccgatcggccaatcgccttgggtccgcagcgtaccggtgccgatggcgcgatgcgttcgattcaggccacgctttactgtcttcaggccgcgccggctctggccgccaccgtgcagccatcgccgcgcccgttacgcaccgacgacgccctgcccgaacgtgcgttgatcggcgacgcggacgcccgtgacgaactggtccgcgtggtctacggaagcctgacagcagcaggcccggatgatccgacgctgctcaccgtctccacattcctgaagttcggcggttcgctcgagaccacggccaaggagctcaacgtacatcccaatacgatccgctaccgtttgaagcgcgccgccgaatccaccggctgggatgccaccgacccgcgcgaggcgtacgtgctgatcaccgccatcgcgctgggtcgtgtggccgaagcgcagcggaccgcagcgtagtcgggcagaagcataaccagcagaaccgtagccggcaaaggccatagctgaccgggcataaccgtccagcccgacagcctagcgggccgaatcaggctgcctgaatctcgtgtacgccatcgtgcagtaacgcggccaaggattcttgagtggctaacacttcgtccacgaatccaccggcggacaggctggcgatcacgcgaccggactcgttgtccacaatcggtacaccaacggcaccgacacccaacgtcacatcctcatccgacagtgcatatccacgttcgcgagtcaagcgaatatcctcgcgcaactgttccacactgaccagcgtgttctcgttatatgccgggaacggcgctcctgcaagatagcgttcggcatcggcatcctcgaaatacgccaaggccacgcggccggccgcgccagcatgcagaggcagcacgcggcccgggcgcaggatcagcgaatcgatggcatgaccttgcgcgcattccacgcataccaattcagtgccggagaccacactgaggaatgaggtcatgccggtttgcgcggtgatggcatgcatgaccgcaatcgcaggctgccattcggtacgagacgtgcgagcggcatcagccaatcgcagccagtccagtgataatgagtagttgccatccgtatccgttacggcccaccccacatcgaccagtccatccagcacgcggtatacggaggatcgcgggatatcacaggcgtcggcgatatctgccggagacaggccattctccgccgccaatgcgtccatcacacgactcgccttgtctaaagcgcgggtcggttcacgtttgtcttccgccatcgccgacgttccttccccccccctgacttatccctgactcatcgtattcaactgttcaggccaagataatcaccactgtatccaaggcctcgcgacacctcgcggccggcagtctgcaccaattgcaccatgtcttgagccgatgccgttgccggtttcccatctaccagacaggccagctcaggttccaaggagcgggaaaggctactcagggcgattgccgcttgaatctctccggcgtgattgaataccggtacgctgatagtcacggagccggccatggtctggccgacgtcataggtgaagccgcattcgcgtatatgacgagcctgtcccattgctgtggcacgcatcgtggagaatgtgccgccgagctcgttgttataggcatagtgttccaacagctgctcgtagcgagccgggggaagccaggccgtcagtacatgagagggagcgctcatgctcagaggcaagctattgcccaccagctgtgcatagctttgcaatgcctcacgggtgcgtgtctcgatgcacaccgtgcgcaatcgcctccgaacgaacagaccccagatgccgaactggccgcgatgggcgcggaaggtacggcgagcgatctgctgaatgtccagtctgctttcgatttggccgccgatacgtacgcaatcgatgccaagccgatactcgccacgattgatgccgcgttccgcccaaccgactgcggcgagattatccagcaaacgatacgttgagcttacgggttcaccagtacgttcgcttatggtttttgcggtgcttggccccagttccgccaatacatcaagtactgccttggatttcaccaatgcatctacgcttcggtcatcacggcttgacgccaccatgcgcgtcacctcctgacctgtttgttgatacctcagccatcttaccgggtattcagcgggttgccgcccaaaacgtactgggccccggcaggagtatcccgtcggggcccaagaggtttctggctcccctctttgagggggagccgtccgcgcggcggaccgggggaggcccgagacgctaaggcccaaggacgcgagaaacaccccgacgcgcgggtgtcctgatatggggaaagccccttggggcgtgtgctccgaggggcttcctgtacgtgtgatgcggcggcgtgctactctcccacaccctgtcgggtgcagtaccatcgccgtgccaggccttagcttccgggttcggaatgggaccgggcgtctcacctgagccatggccgccgcaaatcttctcttgtacggtcagacgctggggtctgccggcctgtggcggcctgggaaccggacagcggacgcggatatgtcgatgtttcgtcttgtggccagacaatgctcattgccgtctggtgtcgtttgcaggaggaagatgcggtccaaccgccaggggttggaatgttagtgttgcctttcgtccgttagtaccggtcggctccacccctcgcggggcttccacgtccggcctatcgaccacgtgttctgcatggggactacaggaactcgaaggttccacggaatgcttatcttggagcaggcttcccgcttagatgctttcagcggttatcccttccgaacgtagccaaccggccgtgccactggcgtgacaaccggcataccagaggttcgtccacccaggtcctctcgtactatgggcaggcctcctcagcattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgtccgtacaccggcaccggatcactagtcccgactttcgtccctgctcggaccgtcgtcctcgcagtcaagcccgcttgtgcacttgcactcgccacccgattgccaaccgggctgagcggacctttgggcgcctccgttactctttgggaggcaaccgccccagttaaactacccgccaggcactgtccctgaacaggatgactgttcgaggttagacatccaatgcgaacagagcggtatttcaccttacggctccgcgcgatctggcgaccgcgcctctcggcctcccgcctatgctacacaatccacaccgaatgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcacccgaaggctgacggatcctcttaaccttccggcaccgggcaggcgtcagtgcatatacagcggcttgcgccttcgcatgcacctgtgtttttggtaaacagtcgctaccccctggtctgtgccacccccaaaagctcccacagcaagtgtgttcaccatcgggggtctcccttaaaccgaaggaacgggagtgatttgccgagttccttgaccaggattcgctcgatcgctttggtattctctacctgaccaccagtgtcggtttggggtacgggcggctttgagcctgacgccgaagcttttctcggcagccgggatcaccggatatcgggccataaggcccccatcatcgcacctcggacccatgcgggacggatttgcctgtcccacgccctgcgtgcttgaccacggaagaccacctccgcggccggctacccttctgcgtcactcctgcgctgacctactacaaggatcggtcccaacaggccagggcatcccgcccccgaaggagcagtaagcccggacccggaggttagtactccaagcctcggttttggcggctgaaagccggtacgggaatatcgacccgttcatccattcgactacgcctgtcggcctcgccttaggacccgactcacccagggacgatgaacgtggccctggaacccttggtcatccagcggacgggatcttcacccgtctctcgctactcatgtctgcattctcactcccatgaagtccacggcgcgttcacacggccgcttcgcccctcatgggacgctctcctacccagtacaaaatactgccgcgtcttcggtggtgtgcttgagccccgctacattgtcggcgcggaaccactagaccagtgagctgttacgcactctttcaagggtggctgcttctgagccaacctcctggctgtctatgcgactccacatcctttcccacttagcacacgcttcgggaccttagacgacggtctgggctgtttccctttcgacgacgaagcttatcccccgccgactcactgccgggatacgcgtcaccggtattcggagtttggttgctgttggtacccgatacgggcccgcaagcatccagtagctctacccccgggacgtaatgacccgacgctgcacccaaatgcatttcggagagaaccagctatcacggaatttgattggcctttcacccctagccccaagtcatccccccggttttcaacccaggtgggttcggtcctccacgcggtcttacccgcgcttcaacctgctcagggctagatcatcccgcttcgggtccaggacacgcgactcaaacgccttttaagactcgccttcgctacgcataccccacacgggttatgctcgccacatgccactgactcgcagactcatttttcgataggcacgccgtcaccccacaaaagggctccgacggattgtaggcgcacggtttcagagactgtttcactcccctcccggggtacttttcacctttccctcacggtactcgttcgctatcggtcagacaggaatattcaggcttacccaacggtctgggcggattcgcacggggttccacgggacccgtgctacttgggagacgcgatcggcagaccatgcgcgttcaggtacggggccctcaccctctgcggcccggtattcaacccggttcccctgacacatggttttctgcaactgccggccggcccgtcggagccggcgcacgcgatcccgcaacaccccgcgcgcaacccccgacgggtatcacacgcgcaaggtttggccatcatccgctttcgctcgccactactcacggaatatcctttcctgcaggtactgagatgtttcacttccctgcgtaccccccggccgaagccggtaccgacccatgacggtcggtgggttcccccattcggaaatcctcggatcaaagccctgttggcggctccccgaggcatatcgcagcctcaaacgtccttcatcggtcctgtctgccaaggcatccaccatacgcccttgcaagcaacacacaccacgaaagtgcatggccgcaagattcctctagcaaattcccagacgacaaatcatcacactaaaaatgatcacaaaacgatcgaaacgaacaatagagttcgattcgaaatcaacagcaaaacaaagattcaaaaacccttgttttgctcgcgtccactatccagttctcaagccaccacgcaccgccacgccatcgcgccggcacacggccggcccccaggcacgacgggcatcgaatcgcgccaggcaaaaagcctggggtggcgatccgggagcccaaaagcgcatccataccaccccgcacccaccgcacgaccggcagggcaaagccaacgacgtcttccacaccagcaaccccgccgccatcgcaccatgcgacgcgcggggcgcacaccgtcggacgaacatccgactgaattctccgtagaaaggaggtgatccagccgcaccttccggtacggctaccttgttacgacttagtcccaatcacgagcctcaccttagacggctccatcccacaaggggttaggccaccggcttcgggtgctgcccactttcatgacttgacgggcggtgtgtacaaggcccgggaacgcattcaccgcgacgttgctgattcgcgattactagcgactccgccttcacgcagtcgagttgcagactgcgatccgaactgagaccggttttcagggatccgctccgcgtcgccgcgtcgcatcccgttgtaccggccattgtagcatgcgtgaagccctggacgtaaggggcatgatgatctgacgtcatccccaccttcctccgagttaaccccggcggtcccccgtgagttcccggcataatccgctggcaacacgaggcgagggttgcgctcgttgcgggacttaacccaacatctcacgacacgagctgacgacgaccatgcaccacctgtgaacccgccccgaagggaagccgtatctctacgaccgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttagctccgacacggaacccgtggaacgggccccacatccagcatccaccgtttacggcgtggactaccagggtatctaatcctgttcgctccccacgctttcgctcctcagcgtcagtaacggcccagagacctgccttcgccattggtgttcttcccgatatctacacattccaccgttacaccgggaattccagtctcccctaccgcactcaagcccgcccgtacccggcgcggatccaccgttaagcgatggactttcacaccggacgcgacgaaccgcctacgagccctttacgcccaataattccggataacgcttgcaccctacgtattaccgcggctgctggcacgtagttagccggtgcttattcaacgggtaaactcactcacgcttgctccccgataaaagaggtttacaacccgaaggcctccatccctcacgcggcgtcgctgcatcaggcttgcgcccattgtgcaatattccccactgctgcctcccgtaggagtctgggccgtatctcagtcccaatgtggccggtcgccctctcaggccggctacccgtcgaagccacggtgggccgttaccccgccgtcaagctgataggacgcgaccccatcccataccgcgaaagctttcccagaagaccatgcgatcaactggagcatccggcattaccacccgtttccaggagctattccggtgtatggggcaggtcggtcacgcattactcacccgttcgccactctcaccaccaagcaagcttgatggatcccgttcgacttgcatgtgttaagcacgccgccagcgttcatcctgagccagaatcgaaccctccacaaaaaaacttcatgaaaagcatccgaatagatgactctcaaaacaaaaattgacgagcacgtccttaaggaaggacgccctcaaaaaacctcacccctcatcaaaccctcccgggtacccgaccaccacgacaggcaatcaggcgaggaatgaactggcaatcattgactataaagaagtagtacaaacacgctcttgagttctcaaaccaccaccactcacccacctcgcagctccccggaggagaaccactcgctgagcggcagcaagggaataacttacacgcattcacggactcgcgcaaatcgggcgcacgaagataagcccaaatcgttgaaacgacaggcttcgctcggcgtgtcgaaatcgacgtttcgcacgtctatatcttcagtctagaactagatatcgtcgaaaattggattgaaaattttggtcgatgggcgtgtcgcgaattacctcttacggcgcatgtggtgcaccgccaattatcggaatcatcattgatccagtacaccgataagaaccattatgttcggattactatctgctcgccagtcgtgcgccaatcaaccgcctggtagcgatgcggttgccgtaccgcttgccttggcacgaccaacgaccgaatggcatcagcacattcagaaccgccggtccgatccatgcatcgcagcacagatcagtcgtggtcccacgggtatggggaggccccgttgccgtgtgggtgccggaggtgtcctgtttgtgtccgggcatgcgagaagccccgggtgtttttgtgggggtgtgtgggtttgggtcgtgagtgtttcgggtatgcgaaagccccttggggcgtgtgctccgaggggcttcctgtacgtgtgatgcggcggcgtgctactctcccacaccctgtcgggtgcagtaccatcgccgtgccaggccttagcttccgggttcggaatgggaccgggcgtctcacctgagccatggccgccgcaaatcttctcttgtacggtcagacgctggggtctgccggcctgtggcggcctgggaaccggacagcggacgcggatatgtcgatgtttcgtcttgtggccagacaatgctcattgccgtctggtgtcgtttgcaggaggaagatgcggtccaaccgccaggggttggaatgttagtgttgcctttcgtccgttagtaccggtcggctccacccctcgcggggcttccacgtccggcctatcgaccacgtgttctgcatggggactacaggaactcgaaggttccacggaatgcttatcttggagcaggcttcccgcttagatgctttcagcggttatcccttccgaacgtagccaaccggccgtgccactggcgtgacaaccggcataccagaggttcgtccacccaggtcctctcgtactatgggcaggcctcctcagcattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgtccgtacaccggcaccggatcactagtcccgactttcgtccctgctcggaccgtcgtcctcgcagtcaagcccgcttgtgcacttgcactcgccacccgattgccaaccgggctgagcggacctttgggcgcctccgttactctttgggaggcaaccgccccagttaaactacccgccaggcactgtccctgaacaggatgactgttcgaggttagacatccaatgcgaacagagcggtatttcaccttacggctccgcgcgatctggcgaccgcgcctctcggcctcccgcctatgctacacaatccacaccgaatgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcacccgaaggctgacggatcctcttaaccttccggcaccgggcaggcgtcagtgcatatacagcggcttgcgccttcgcatgcacctgtgtttttggtaaacagtcgctaccccctggtctgtgccacccccaaaagctcccacagcaagtgtgttcaccatcgggggtctcccttaaaccgaaggaacgggagtgatttgccgagttccttgaccaggattcgctcgatcgctttggtattctctacctgaccaccagtgtcggtttggggtacgggcggctttgagcctgacgccgaagcttttctcggcagccgggatcaccggatatcgggccataaggcccccatcatcgcacctcggacccatgcgggacggatttgcctgtcccacgccctgcgtgcttgaccacggaagaccacctccgcggccggctacccttctgcgtcactcctgcgctgacctactacaaggatcggtcccaacaggccagggcatcccgcccccgaaggagcagtaagcccggacccggaggttagtactccaagcctcggttttggcggctgaaagccggtacgggaatatcgacccgttcatccattcgactacgcctgtcggcctcgccttaggacccgactcacccagggacgatgaacgtggccctggaacccttggtcatccagcggacgggatcttcacccgtctctcgctactcatgtctgcattctcactcccatgaagtccacggcgcgttcacacggccgcttcgcccctcatgggacgctctcctacccagtacaaaatactgccgcgtcttcggtggtgtgcttgagccccgctacattgtcggcgcggaaccactagaccagtgagctgttacgcactctttcaagggtggctgcttctgagccaacctcctggctgtctatgcgactccacatcctttcccacttagcacacgcttcgggaccttagacgacggtctgggctgtttccctttcgacgacgaagcttatcccccgccgactcactgccgggatacgcgtcaccggtattcggagtttggttgctgttggtacccgatacgggcccgcaagcatccagtagctctacccccgggacgtaatgacccgacgctgcacccaaatgcatttcggagagaaccagctatcacggaatttgattggcctttcacccctagccccaagtcatccccccggttttcaacccaggtgggttcggtcctccacgcggtcttacccgcgcttcaacctgctcagggctagatcatcccgcttcgggtccaggacacgcgactcaaacgccttttaagactcgccttcgctacgcataccccacacgggttatgctcgccacatgccactgactcgcagactcatttttcgataggcacgccgtcaccccacaaaagggctccgacggattgtaggcgcacggtttcagagactgtttcactcccctcccggggtacttttcacctttccctcacggtactcgttcgctatcggtcagacaggaatattcaggcttacccaacggtctgggcggattcgcacggggttccacgggacccgtgctacttgggagacgcgatcggcagaccatgcgcgttcaggtacggggccctcaccctctgcggcccggtattcaacccggttcccctgacacatggttttctgcaactgccggccggcccgtcggagccggcgcacgcgatcccgcaacaccccgcgcgcaacccccgacgggtatcacacgcgcaaggtttggccatcatccgctttcgctcgccactactcacggaatatcctttcctgcaggtactgagatgtttcacttccctgcgtaccccccggccgaagccggtaccgacccatgacggtcggtgggttcccccattcggaaatcctcggatcaaagccctgttggcggctccccgaggcatatcgcagcctcaaacgtccttcatcggtcctgtctgccaaggcatccaccatacgcccttgcaagcaacacacaccacgaaagtgcatggccgcaagattcctctagcaaattcccagacgacaaatcatcacactaaaaatgatcacaaaacgatcgaaacgaacaatagagttcgattcgaaatcaacagcaaaacaaagattcaaaaacccttgttttgctcgcgtccactatccagttctcaagccaccacgcaccgccacgccatcgcgccggcacacggccggcccccaggcacgacgggcatcgaatcgcgccaggcaaaaagcctggggtggcgatccgggagcccaaaagcgcatccataccaccccgcacccaccgcacgaccggcagggcaaagccaacgacgtcttccacaccagcaaccccgccgccatcgcaccatgcgacgcgcggggcgcacaccgtcggacgaacatccgactgaattctccgtagaaaggaggtgatccagccgcaccttccggtacggctaccttgttacgacttagtcccaatcacgagcctcaccttagacggctccatcccacaaggggttaggccaccggcttcgggtgctgcccactttcatgacttgacgggcggtgtgtacaaggcccgggaacgcattcaccgcgacgttgctgattcgcgattactagcgactccgccttcacgcagtcgagttgcagactgcgatccgaactgagaccggttttcagggatccgctccgcgtcgccgcgtcgcatcccgttgtaccggccattgtagcatgcgtgaagccctggacgtaaggggcatgatgatctgacgtcatccccaccttcctccgagttaaccccggcggtcccccgtgagttcccggcataatccgctggcaacacgaggcgagggttgcgctcgttgcgggacttaacccaacatctcacgacacgagctgacgacgaccatgcaccacctgtgaacccgccccgaagggaagccgtatctctacgaccgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttagctccgacacggaacccgtggaacgggccccacatccagcatccaccgtttacggcgtggactaccagggtatctaatcctgttcgctccccacgctttcgctcctcagcgtcagtaacggcccagagacctgccttcgccattggtgttcttcccgatatctacacattccaccgttacaccgggaattccagtctcccctaccgcactcaagcccgcccgtacccggcgcggatccaccgttaagcgatggactttcacaccggacgcgacgaaccgcctacgagccctttacgcccaataattccggataacgcttgcaccctacgtattaccgcggctgctggcacgtagttagccggtgcttattcaacgggtaaactcactcacgcttgctccccgataaaagaggtttacaacccgaaggcctccatccctcacgcggcgtcgctgcatcaggcttgcgcccattgtgcaatattccccactgctgcctcccgtaggagtctgggccgtatctcagtcccaatgtggccggtcgccctctcaggccggctacccgtcgaagccacggtgggccgttaccccgccgtcaagctgataggacgcgaccccatcccataccgcgaaagctttcccagaagaccatgcgatcaactggagcatccggcattaccacccgtttccaggagctattccggtgtatggggcaggtcggtcacgcattactcacccgttcgccactctcaccaccaagcaagcttgatggatcccgttcgacttgcatgtgttaagcacgccgccagcgttcatcctgagccagaatcgaaccctccacaaaaaaacttcatgaaaagcatccgaatagatgactctcaaaacaaaaattgacgagcacgtccttaaggaaggacgccctcaaaaaacctcacccctcatcaaaccctcccgggtacccgaccaccacgacaggcaatcaggcgaggaatgaactggcaatcattgactataaagaagtagtacaaacacgctcttgagttctcaaaccaccaccacaccagccagacgggaaaccaaccagaggaaggaacccgccgcgctgagcggcaacaggtgaataacttacacgcatgtccggattcacgcaaatcaggcgcacgaagataagcccaaatcgttgaaacgacaggcttcgcccggcgtgtcgcaaacagcctatttgcgctgttctgatatcagaataatccgttttgcattgccgatgcgtaacaaattcatgtgttcatcggcgtgttgcaagaattcgattgcgtgaccatccaggttcaccttctcgcaaccggtcatcgcatatgcaaaaagggacttccctttacgggaagtccctttcagtagctattgaagctcgctagcttcaggccagggtgttcgggtcaaccggaacgcccgggttcatcgtggaggtgatggttgccttggtcaggtaacggcccttcacggtggacggcttcagacgcttgacttcgtcggccacagccttgaagttctcgtccagagcggactcatcgaagctcatcttgccgatgaggaagctcaggttgccgttcttgtcgacacggaactcgatcttgccgcccttgatgtccttgacagccttggtgacatccatggtcacggtgccggtcttggggttcggcatcaggccacgcggaccgagcacacggcccagacggccgaccttgcccatcatgtccggagtagcaaccacggcgtcgaagtcgaggaagccgccctgaacctttgcaatcaggtcgtcatcaccgacgatgtcggcgccagcctcggtagcctcggtagccttcgggccacgggcgaacacgaggaccttggcggtcttaccagtgccgtgaggcaggttgacggtaccacgcacgagctggtcggccttacgcgggtcaacgctcagacggaacacagcctcgacggtctggtcgaagttgtaggagggcatgctcttgagcagagcgatggcctcgttggcggtgtagaggttgttgcgatcgacgcgctcagcggcttcgcggtacttcttggaacgctttaccatctgtccttctccttatcagtccgtaaccgtgatgcccatcgagcgagcggtgccctcgatgatcttcatgccggcctcgatatcgcgagcagacagatcttccatcttgatctcggcgatttcgcgaacctgcgccttggtgacagagccgaccttgtgggtcagcgggttctcggtgcccttctcaacgccagcggccttcttcagcagagctgcagccggcggggtcttgagcacgaaggtgaaggaacgatcttcgtaaacggtgatctcgacagggatgacctgacccatcttgtcctgcgtctgggcattgtatgccttgcagaagtccatgatgttcacgccatgcgaacccagagccgggcccagcggcggggccgggttggccttgccagcctggatctggagcttaatcagcgccgagactttcttcttgggagccatattatggttcttctttctataacgcggttcgaatggtcgccgtcctcaggttcggctgtctgccatcatgctcggtcttgactcattatttatccgtgcatgctgtaggcaatcggcctgtggtcggtctcctcccgcaacttatattgctgtgctgtgctagcgagtctcctctccagacacaagctttcctattatgcaaatccacccggacaacacaaaaagcccgaccacgatggtcgggctctgcaaagtttgggagttaatctagcttctgaacctggtggaagccaagctccaccggcgtatcacggccgaagatggacacgagcacggtgagcttctgagtggtgggctccacgtcggaaacaacggcggccatggtggcgaaaggcccatcggtgacggtgacctgatcgccaacggcgtaggagacctcgaccctgcgcttcttggcggcggcgggcttgtcgccggcggccttgagtgcctcggaagcaatcatcggagccatcatcgccacgacttccttgcgggagagcggcgccggatccttggtcgggccaacgaagccggtcacgccttcggtctcacgaacgatacggcgggcgttctcatccggccacatacgaatcagcacgtagccaggaacacgcacgcgggtgatgaccttcttgcccttctcggtgtgcttctcgacttcttccatcggcacctcgacctggaagatctggtcttccatgccgaaggaggcgacgcgggactcgatgttggtcttcacgcgcttctcgtagccggagtaggtgtgcagcacgtaccacttgccatcaagggaacgcagggacttggagaattcgtcaacggcctgctgaccggcatcggtctcctcggcctgctcggattcgttgacttcttcctcgtcctcatccagagaaacggtctcggtctgagtggaagcaacgggagcggattcagtcgccgccggagcgtcggactcaacatctgcattgtcgacggatgcgtcagattctgcggaaaggtcagcgaccggttcgaccggggcagctgcctcatcggcagcagcttcggaagcctcgacaacaggctcctcagccgggacggcgtcgaggttctcgagattcagttcatcactcatgcgttgttattcaccttaggttgtgcggatcagccgaacacccacagcgtggccttgcctagaccgaagtccatgccagtcacgagggccatcagcagcagcacgaagatgaatacggccagagaccagaagaacagttccttggcggtaggggtcacgaccttgcgaagctcgtcgatgatctgcttgatgaacagaccgatacgcatgaagacattcggcttgactgccttttcactcttgctcgtcttagccattccgtacctcgcgtcagctgcttgattattagaaacttggcagggaaggcgggactcgaacccacaacctacggttttggagaccgttgcgctaccaattgcgccacttccctaggtgaaaatccacctcggcatgcgttccgtagagaacgcttcgccacggcgaaaccgccaagtcgttatagtaacggctccggtggattatcgcaaatcgcgtgtcgcgcgcgtggcacgcgactcttctcagttagcccattccttgaatcgacgcatgccttcggctaggtcttcgtcagccagtgcgtaggagaaacgcaggtaaccgggagcaccaaaggcctcgccggggacggcggccacgtgggcctcatccaacagtgcggcggcaaagtcagcggacgtatcggacactgtgcccttgggacccagcggcttgccaagcaaagcggtgatgtccgcaaaagcgtagaacgcgccggtcggagtcgggcagttgacgccctcgatatcgttcaaggcggtcacaatcgcacggcggcgcgcgtcgaaggccttacgcatctcgtgcacctcatccagcgggccggccacagcagccaaagcagcacgctgggagatgttggccacattggaggtcatatgaccctgcagcttggcggcggccttggccacctcaagcggagcgaccatccagccgacacgccagcccggcatcgcataggtcttggccacgccgttcagcaccagcaactgcccgcggcattccggcacggcggcaccgatgtaggtggtgtgcgcatcgtcatagttcaggtgctcgtagatctcgtcggagataacccaaatgtggtgctcgacggcccaacgaccgatcgcttccacggtttccggcttccagacggctccggtcgggttgttcggggagttgacgatgattgccttcgtatgctcggtacgggccgcttccagcgcctcaagcgagggctcgaagttcacgtcggcaccggcgaatacttcgaccggcacaccaccggcaagcttcacagcctcggggtagctggtccagtacggagcgggaatgatgacctcatcgccatcgttgagcaagatctggaaggattcatacacggcctgcttgccgccgttggtcaccacgacctgatcggcattgacctcatagccggaatcgcgcagcatcttagccgcaatcgcttcgcgcagctcgggcaggcccggcgtaggcgtgtacttgtaattcttcgggtcaaggcaggcatctgccgcagccttgaccacgtttgcgggggtcgggaaattcggttcacctgcgccgaagccgacaacgtcaagtccggcggccttcatggccttggccttggaatcgacggcgagcgtagcgctcggtgccacagtgttgatacggtcggaaagagtctgccattgcgccatagtcatggctcccatgctaaacctacagcacgaaaaatcgccagagccgcactatggtgatggaatctgtcgtgtgacagattccatcagtcacacgagcacgagattgtcgcgatgaaccagtgggtgggcgtactgggggccgaggaaacgcttgagttgggcggtgttacgcccgagcatctgcggaatttcttcggaatcgaagccggcgaggcctcgggccaggtgttcaccgctttcggcatcgatccagaccggatcgccggcggaaaaatcgccatgtacttcgagcgcgccggccgccagcagcgaggcacgcccgccgcgaatcgcctggccggcacccgcatcgaccacaatcgtgccgcgcgggtcggcggcgaagccgatccacagacggcgtgaggagccgcgggccttaaccggtgcgaacacggtgcccaccggatcgcccatcatcgcagggcccgcgttcgaggcgcaggtgagtaccgtggggatgcccgagacggccgccacgcgcgcggcctcgagtttggtgaccatgccgccggtgccgaccttggagccggagccggagacttggatgtcgcccagcgcatcaatcacgttgggcacatattccacacggcgggagccgggctgcgagggcggcgcagtgtacagcgcgtccacgtcggtcagtagcaccaaggcttcggcccgcaccaggttggccaccaacgcggagagtcgatcgttgtcgccgaagcgaatctcgttcgaggccaacgaatcgttttcgttgatgatcggcaccacgccgaggtcaagcagacggtccagcgtgcgttccacattgcggtactgggtggcacgaatcgtatcttcggcagtgatcagaatctggccgacgcgaataccgaatcgaccgaacgcagtctcgtagcgggccatcagtagcccttggccgacggctgcggtggcctgctgagtggccacgtccaccggccgcgagtcaaagcccagaggcccgaaaccggcggcgatagcaccggacgagaccagcaccacacgtccgcccatcaatcggacctgagccaaggccgcggccaacgcgtcgagcttgtccgggtcgaggtgaccgctcggctgggtcagcgagctggagccgactttcacgacaatggttccggctgcggcgatcatgcgccgcacctcggcctgactcggagtgctcatttattcctcggtttcaccatcttcgctggactcaccgtggccgaacaggctggtttcgtcatggcgatcgtcgtcaacggtcgggtcggcccagtggccggccttgcgttcggccatcatcgcgtcgcgcacggcggcacgggcgtccatcatctcgtggtattgggcacgacgttcggcgttggagcggcggtgcgtgcgcgggtccagctcttcgagacgcagatccttgcctcgggcaccgaggttggagccgtcgagcatttcggcaccagcggagatggtcggatcccaatcgaattcgaccatacgggcaccacgaccgatgcgcacttcgtcgccggggtgagcacccttgcggcgcagctcgtcctccacgcccagcttggccaagcggtcagccaggtagcccacggcctcgtcgttgtcgaagttggtctgcatgacccagcgctccggcttgacgccacgcacctcgaagaacacttcgccattgccgagttcgcggcgctcgaccgtgaactcaagcgcactgccgccctcgtcagcacgacgcggacggcggcccttggtctccaatggcttgatgaccacgcgagcctcctcttcggcctgctcgcggttggccacttcctcacgcatctcgtgcaccagcgcagacaacgcgaagttgagctcctttagaccctcgtgcgaggcagtggagatctcaaagaccttcagcccgagtttctcgaactccggacgcacgaactcagccaattccttggcctcgggcacatcgatcttgttcagaatcacgatgcgcgggcgttcgggaatcgggatggcacccaacggcagctcgagcttgtcggcgtagagcgccaactcgttttccagcgcgtggtagtcggacatcgggtcgcggtccggttcaagcgtggcgcaatcgatcacatgggcgatgatttcggtacgttcgatgtggcgcaggaactccagtcccaggcccttgccttcggaggcgcccggaatcaggcccggcacgtcggcgatggtgtatcgagagtcgccggcgataacgacgccgagattcggcaccagcgtggtgaacgggtagtcggcgatcttcggcttggcggaactcatcgccgcaatcagggacgactttccggccgaggggaaaccgaccaacgccacgtcggcgatggacttcaattccaaaatcacgtcgcgctcttcaccgagttcgccgagcagggcgaagccgggggcgcggcgggtcttgttagccagggcgatgttgccgaggccgccggcaccgccttgggcgacgacgcagcggtcgccctcgtggcgcaggtcggcgagctgcgcgccgggatgcttggctttgccctgttcgccgcgcgcctcaaagacgacggtgccgcagggcacgggcagaatcaggtcctcgcccttggagccgtccttattgtcgcccaaacccatggtgccgctgccggcgacacgatgcggcatgaaacgatagtcgagcaggctggtggcgttacggtcggccacgaacaccacggaaccaccgtcgccgccattgccaccgttcgggccggccaacggcttgtatttctcacgacggatgccggccgaaccgttgcccccatcgccgcccttgacatggacggttactcgatccacaaaatcactcatattgattaccttacaaaaaagccgcgtccttacgggcgcggcttgaaaaaagcttgacgctatatcgctcaggcgatgacgtcgacaaccttgcggtcgcgacgcacaccgaacttcacggagccatcggtgagggcgaacagcgtgtgatccttgcccatgccgacgttgtggcccgggtggaagttggtgccacgctggcgaacgatgatgttgccggccacgacggcttcgccgccgaacttcttcacgccgaggtattgcgggttagaatcgcgaccgttgcgagagctggacgcacccttcttatgtgccatgattcatggtcctttctataactcaggcaatcgccgtgatcttgacgatagtcagcttctggcgatgacccttacggcgagcaacaccagtcttgttcttgtacttctggatgctaatcttcgggcccttggcttcgtcgttcacaacctcagccttgacggacaccttggccagatcggcggcggcaagggtgaccttgtcaccatcgacaacgagggagaccgggaattccacggtatcgcccttcttagcgtcgagacggttcacgaggatgacgtcgccaacctcgaccttttcctgatggccaccggccttcacaatcgcgtacattatcgttccttttatgttttggaaagctaccttgcctaacacgcaccgagcttgcggtcagacaccgagtttcgaatctacaccaccatgcggactaaatcaaatgatttttgcccgcgtgtcaagcacgacacacctgttactcttccgccgtgttgttggcagcgacggcagcggcggcaatctgagccagtttggctttgacgtcggcgctggaaccagccggttcgggagcgggagcggtgccgcgaccgtgcttgttggttttgacgaacgggtcgccaccgcgaagcgcgtagggatcgtcgtagtcggccgaaacggtcggctgatcatgcaggatgaaaccacggcccttgcaggtcgggcattcctcggagaacgcctcgaccagaccctggccgatgcgcttgcgggtcatctgcaccaaaccgagcgaggtgacttcggccacctgatgcttggtgcggtcgcgtgccaagcattcgaccaagcggcgcagcaccagatcgcggttggcgggcatgaccatatccacatagtcgatcatcaccatgccaccgatatcgcgcaggcgcagctggcgggcgatctcttcagacgcctccaggttgcaacgcgtcaccgtttcttccaaggacttgcccttgccgataaagcggccggtgttcacgtcaatggtggtcatggcttcggtgcgatcgatgacaatcgagccgccggacggcaggtagacctgacgctccatgcccttacgcagctgggagtcgatggaccacttgtcgaacacgtccttgccttcatgctcggccgggtcccacttctccagcttgtccttcaagtcaggggccatggtgtcaaggtattcctcgatacggtcgtagaccttgtcaccttccacgatgagcttgctgaagtcgtcgttgaagatgtcgcgcaccacgcggatggccacgtcgggctcgccctgcaggagcttcgggcgcttgccgtgccagaattcctcgcgcttggcgttgatgcgctcccactggcggaccagtgattcgagatccttgacgatggcgtcttcggatgcgccctcggctgcggtacggatgatcacgcccatgtctttcggggcgatcttggagacgatgttcttcagacggctgcgttcgcgctccgaaagcttgcggctcacgccggtcatgccgccggatggcacgagcaccaggaagcggccggcgagcgtgacctgagaggtcaggcgggcacccttgtggccgatcgggtccttagtgacctgcacgagcaccgggtcgccggacttgaacgccagctcgatgcggcgcggctggccttcgagacgagcggcatcccagttgacctcgccggcgtagagcacgccgttgcgggcctggccgatgtccacaaatgcggcctccatgctgggcagcacgttctgcacgcggccaaggtagatgttgccgacggtctgtacttcctgaatgtcggagacgtaatgctcgaccagaacattgtcttccaccacggaaatctgggtgtgatgttccttctcacgcaccaccatcaggcggtccacgttctcgcggcgtgcgaggaagtcctgttccatgagctggctctggcggctgcgctcacggcggttgtcacggcggcgctgcttcttggcctcgagacgagtggagccttccacatcagtgatctcgtcgatgtactgctgcttgcgggagcgtcggaccagcggctgttcgctgttctgactctggtcgtcggtgccctcgccgttcttgccgccacgacggcggcggcgacggcgagtgacggtctgctcctcatcgtcctcatcgcgatcacggtcatgatcatcgcgatcgtcacgacggcgggaacgcgtatcttcggcatcgttctcggcggtatcgtgctcgccgttggcaccggtttcgccgcgtgagccgcgacggcggcgacggcgcgaacgggtgcgggtggcgtcggattcttcgtcgccctcctcttcggcaatcggcgagtaggcgatatcgtccagctcgaggtcttcctcaatctgctcgacttcggcggctgcacggcgctcctgggcgttcaggcggcgggagcgacgggaacggcgggagtccgaggtgtcgtcggcgtcgaaatcgtcgtgatcggcgttggtatcgccggacgcggcgtcacgggaagcgtcacggtcggcggaggcgcggccgcgatcgtcgcggcgacggctgcgcggctgggcatcgtcatcgtcgtggctgcgcgagcggcgggagcgacgagacgggcgttcgtcggcgtcaacatcgtcatcacgagtgtcagcggtatcgtgcgcatccacggcggcgggcagtaccggttcctggaagagcagggacgtcatcggcttgccgcgacgcacggcctcgtggccagagggcagggattcgaccgcgtcgaacaggcgctcatccggggtgtcctcgtgcgtatccgcaactgcacggcgagaacgacggcgaaccggccgatcctcgtcatcatcatccatatccatagacgcacggcgagagcgggagcgaaccggccgatcctcgtagtcatcatcgtcggactggcgggagcgagagcggcggcgaaccgggcggtcctcgtcgtaatcgtcatcgtccacaaccgaacggcggcgggaacgtggggcgtcatcgtcatcgaaatcatcggcactgacagtgcggcgcgaacgacgaggacgatcatcctcgctatccgagtcggccactgcggaagcggcgcggcgcgaacggcggcgggttggacgttcggcggaatcctgggaatcgctggattcatcggaatcgctggaatcggctgacttggaatcggccgcagtgccggcatcgggaagcgcgggggcttcgaacagcggggcgcgttcctgcacttgcagttccagagaagcgccggcagcaccggtgccgcggaccacgcggcggccgccacgacgacggcgaacaggttcggcgggctgggaggcggcggcaggcgcagcgttcacggctgcagccgaatcggcattggatacggttgaattatcggttccgtcgttgacgaaaccttcacggttgtcagtgggcacaatgctcctcgcggcgcgctgcatcacgacgcctatttccaggcctatacgcttgtctcacaccacgctctcaccgtggccgcacgaaaacgcgccgcgtaaaggcaacttcgtctcaagtctgtcctgcgggtggcggacaccggcgcttgcgttgtctcattctcaagagccgcaaggggatcgacgccatctcgcacgctgatggttatgcagaaccaccatcctttagtatgccacatattttgtgcgggcgtggcccggcgaggctgacgttctctcggctcccctcccccgcggtgacagctcccctcagggaggggagctagagaggtgtcagaccagccagtcggtaaggattgcggccatggcggtcaggtcggattcaggcacctgctcgtcgtgcttgtgagccagcagcggatcgccggcaccgaggttgacggccgggataccgagctgagagaagcgtgccacgtcggtccagccgagcttggccagcgggtcgcggccagtgcgctccttaaccagtcggaccagatcctgggcgagcggggcgttcaggcccgggcgcgcggaggggctttcgtccttcatttcgatgccgtagccctcgaacacgccgccggtagccacatgctcgccattgccgagttcggcaccggcgtccgcgcccatcatcagagccttggcctcggccaacgacttgtccggggcgaagcggtagttgacgtgtacgcggcattcatccggaatgacgttcgtgcctttgccgccggagatcagcgtggcgttgaggccctcgcgataatcgagcccgtccacgttcacggtggccggctcgtaggcgttgagtcggttcagaatgtcggccgccttgtggatggcgttctcccccatccatgcacgggcggagtgcgcggccacgccgtgggttacgacgtcgaagcgaatcgtaccgttgcaaccgccctcgatgccgctgttggtgggctcgccgatgatggcgaaatcgccggtgatccaatcgggatgggcctcgacgactttgcgtaggccattcttttcggcgacgacttcctcatggtcgtagaagacgtaggtgaggtcgactttcggggtggtttccggcgtgcggccgtcgagcgtggcggcgaggtagagcatcaccgcgtcggaggccttcatatcggtggcaccgcggccccacagcacgcggtcttcgggatgagcgtgggcgatttcttcgcgaatcagcgaatcgccgggctccagccactttggtgggaaattgtcgatgaccggcacagtatcgaggtgcccggccaagatcacacggctcggcttgccgaagtcggtgctggccaccactgtgtcgccgtgacggcggacggtcaggtgctcttgctcgttaaggaaggcctcgacctcgtcggtgagggggccctcgtggtcggacacggagaagttctccatgatctgggtgagcaggctgttcagctgctcggcagtggatgcggtgcggttcaattcaagcgtcatgtgaacagcgtaccgcgtgggcggcgggcccagcacactcactacatgagattttgcggccgaatacatttttatgtgccacactggggtggcgaaagggaggattatgccaggtctaatcagcgccatgcaaggcttctgcgttatcggcatcgtaatcgcggtgggatatgttgccgcacgaatgcgaatcggcgggccgtccgctcagatggtgctcaaccggttctccttcttcgtatcgagcccgtgcctgatgttcgcgattctctccaaggagccgattttcgacatcttccacccctcgattatcgtggcgttcttctccgccgtgctggtaggcgtggtgtttttggtgctcaaccgtatgttcttccacctgaatgccccggacgccaccatcggtgccctgaattcgctgtacctcaattccaataacatcggcctgccaatcgccacctacattctgggcaatccggctcttgtggcaccgattctggtcatgcagcaggccatcttcacaccggtgggcctgacagtgctggacgtgaccaccaagggcaaggtctccatcaaggaaatcgccaagcagccactgcatcagccgctgcttatcggctcgctgctgggcattgtggtctctgcgatttccgctaaaagcggctggttcccagtgccgaaattcattttcgacccgatcgacatgatcggcgattcggctgtgccaatgatcctgatggcgttcggcatgtccctgcacggcaccaagccgctacagcagaagggcgatcgcccggccatcttcacggtcgcggtcctcaagaacatcatcatgccaattatcgcgttcctgctcgcctacttcgtgatgggcttccgcggctccgagctgtacgcctgcgtggtactcgccgctctgcccaccggccagaacgtatacaactacgcggcccgctacaacgtgggtctcaccttcgcgcgcgacggcattctgatgagcaccatgaccagcccggtgtttatcgcgatcatcgcggcgctgctgtcgtgatgggtgcgcagagaagcgttctcaatagtatccgtgcgcgcaaatgcacagatatcgcacaaacgaacatttgctcatccgcatatttgcggtgatttcagcgtttctacgttcgatttgcgtatacgaaagtacgcacagttgttattgagaacgattcgctgcgcagctcggctcagtcatcagcccgataatcggtcagattcaagctggccgccacatgattggacgcgaacgcgccgatggaaaccagcgcatagcacaacacaagcccgccgaagaagctggccagcgtggccggttcggtcatcgaagcggcgaacagaggggccataagcagcatggaacagccgccggccacgatcaccacgatgttgagcggggtgagtacctcgatgaatcgcgcacggttcaaggtcttgacatcagtgccctccaacaccagcatgcgatattcgccggcctgatcgtacacgctgccggcctgcatcacaccggagctgaccgcggcaagcacagcggcgaacacgagcgtcagaatgccgccggtgccgatgtcgcgaatgaacacggtgaacgggtcgttggcgtcatcgaccacggcggccgatccgaagaatccgcagatcgacgtgatgccggcgataaacacggccaacgcaatgccggacacattgcgccaggcgcgcttagggttgtcgagaatacggcgcatggcaatcatcgtggccgcatccttggggcgcttggccttggccttggcgcgagcggtgatcacccacgtgccgataagattcaccagcgcgaagcacagcagcatgaaaccgatgatcacgccgtacatcaccgcctggccggcctgagccagcatggccgggttcttgaagacgatcatggccaccaccacgactaccacgaacagcaccatacgggtgcctgagggcaatgcggtggcggtgcgcgaggtgacacccaatggggtgattgccacgcggcgcaaggtgaccagcgacgatatcagcgccaagatggccacgcccgccaaggtgattaccagcgccagcgggccgacccatagctgttcgaaggtgaaccgctgctcctggaagggaatcagcatgactgccggcatcagggcgcaatagccggcaatgccgataagcgcgccgatcagcgcctgtccggcggcgtcaagcgcggtgagacgcaccacctgaccggtggtcgcgccggccagacgcagggcggcgagacgggcgtcgcggcgggatgcggccagtcgtgcggcggaaccggcgagcgccacgaacggcacgacgagcagcatgcaggcgaataccgccaacgccacataggcggtggagaattgggccaggctcgtcgggtcgctgatctgccgtttccacgcggccaccgtatcgggccggcaggcaccgaagtcgaacgcgcaggcgacggtatgatcggccgaagcccgccagatgaaaccgtgtacgccgccgagcacggtgaggaagatggtggtggctgcggcgaaggcgatgattgccagcatcgaggtgtggccggcgctgccgcgcaagccggggcggtgaaacagccgccagagggcgaacgtgctcatcgcgcgcctcctgcggtggtttcgctcccgccggctggagctgccgagcgtagcgaggctgagggtggttcagcgccctcgggccacccccagtcagcctgcggctgacagcccccgccagcgggggcggagttggggttggcgtctgtctggtgcagacggccgtcctgcatcattacggtacggccgcagaacgaagcgacgttggggtcgtgggtgacgacgaccacggcggaaccgttgtcccgcgcggcggccacgagaatgcccatgacctcgcggccggtggcttggtcgagcgcgccggtcggctcgtcggcgaagaccacggcaggtttgacggcgagtgcacgggcgatggcgatgcgctgcatctgtccgccgctcatctcccccggccggtgcgtggcgagcgcgcgcaatcccatgcgttccagccacaggatcgccgtgtcggtggcggtgcggtagggcatgccgtcaagcatcatcggcagggcgatgttttcgaccgccggcagttcgggcagcagctggccggactggaagacgaagccgaagtcgttgcggcgcagtttggtgcgctcggcgtcgctcatgcggctcaggtcggcaccacggaagatgacggtgccggcggtcggcttaatgatgccggcgagcgcgtgcagcaaagtggatttgccggagccggacgggcccatcacggctaccgtctcgccctcccggagcgtgaagttcacgtggttcagggcgagcgtgtgcatggtcggcatggcgaagccgggctgggatggctgggatggctggccggcctgaatggcacccggtccggccgcagcgggattcgccgacgcataaccggctcccgtgccggctggtatcacgccggtgacgccgtgcccggcctgtgcgcgggccatgctggcggtgtagtccatgaccaggtcatgggcctcgatgaccggggcccactgctgggtgtgcgatgccggctgctggaactgttggggttgctgagactgctgaggctgagccgccggtcccggcgccggctgaggctgctgcaattgcgatgctgctgtattcatactcccgagcgtacggagcgaacgcccagccgaccatcgggctgcggtatgaacctttctggattaccggcccgctcctcatccgcaaggattagagatacgcaaatgattaatgaccggcaaccactattcggtgccggtcattatgagcattgcattcaggcgctacgcgcattattgcgcggtagccaactcgtccaggcgggcggcgaagcggggccagtcggtcttcatagcggtgaggagcttgcggttgggcacgtcgtcaatcgggacccagcagatttccatgctttcgtcgtcgtttgccttgggctcgacggtgtggccgggcttttcaaaggcaaacacggtggtgtaggcccacgggccatggtcctcgcggtaggagccgaccacctcgatgtcttcgggggtgatgttggcttcctcgtagctttcgcgcagcgcgccttcgatggacgattcgccgtccgcagtggcaccgccggggataccccacgtgccaccttcggcgctccacgcggcacggtgctgcatgaccacgtgagtcaccttgccgctcgccgagtcgcggcgagccagcagaatgccggacgcaccgttggtgccccaatgcttgcggccgcaggcgcagtccacccagccatcgccgggctggtgtacgttttcgaccggcggcagaatgccagcgtgctggttgcccgatgccttgctttccggttccagttcaccacggccgacattccacaggtcagtccacgtgatgcccagttcgccggccagatgccgggccagcggcaagctgaggccgatgatgccgtgcggatcgccctcaatactgtcgatgaacgcaccaccgaagccttccagcgtgaacgatccggcgacttccagcggctcgccagtggcaatgtaccgttcgacgtcggcatcggtgaattcgccgaaatggactttggcgtggcttgcgccgcgcacggtacgcccggtcgcgaaatcgatcaggcagtggccggtccacagttcgccggtcgcgccgctcatgcgcttcagtcgttcgcgggccacggcttcgctgtgcggcttgccgtagcattcgccgcccaagaggaacatcgaatcacagccgagaatcagcgggccgactgtcgcctcggtcagtcccggctgtccggcaatagcggtggcgatgggttcggtgatggtcggcatgtcgatgccggagaagtcgcgcgtggtggcgacttccgccttggaatagtcgatgggctggccagcggcggctttgcgcaggtcttcgacgacggcttcgcgttccgaatccttgatttccttggccttgagcgggtaggcaatcacgcgatcgccggttgcggcggcggcagtattggccacatcgcgatacgcacggtgaacggcctcggccttggctacggcaagaatcatcacacgctgcttgatgctcaaatcgtcgacggtgacaccttcctcacgggcggccgcttccagcgcagcaggctcatccacgtgcgagacgcgaattgtggggcagatacccgccgaatacagcacgtcacggcgaggcttggacttggaagcaagaattagcggaatggacatgacttaagtccttatgctcccgctggcgggagctgtcgaacgaagtgagactgagggtggtctctgccggtatggcggaccaccctcagaccgcctgcggcggccagctcccgccagcgggagccttctcctcgacttagcgacgctcgatttcgacgccggcggtgttgatgggcaggtgaagcacacgccagtggccggaagcaagctgctccgatgcgatctggtcgatggcttcgcgggcgttgccgtaatgcagcacgagcacgcaggggccggcaccggagactgcggcggcatagcccttggagcggaagagcgcaatgagctcggtggacggcggcatcagggcaccgcgatacggctggtgcagtttgtcctgcgtggcggtgaacagcagcgcgttggactgggcctgagcggccgcaagctcgtcggcgaacgccgattcacgggttccgccagagcaagcgcacgtatcggcatcctgagccggggcagcggcgacgccggacttgccctgctgggcggcctgagccagcaccacgggattcatcgcagcgggcagcagacccacgcgagacacgttgtagacggcgtccttgtatggcagttccctaggcagcgcctgacgggccttctcagtggacagctcatagtcgggcacgaacacggcggcggtgatggacgggtccaccgggtagttgacggcgtggaatccgccgtgcagcggttcaccaccaggaacggcgaccgagccgacgccttctgcggtttcgaagtcccaagagacggtcaggccaccgaacacagccggggccacattgtccgggtgtccttcaatctgggcggccatatcgaagacggccggacggttgaggtcaccggtctgggcgaaggccgcggcggcggcgatgccggccacgatggcctcggcggaagagcccatgccacgagcctgagggatgttgttggtcgcttccagcgtgaagccgagtcggccgaggccgaacgtggcacaggcacggcggaaggtggagaccacgaggtgggtttcgtcgcgtgggagggtgtcggcaccctcgccgtggatgatcacgtgggcaatgccgtcgttcgggtcgtcgttgagcgtgaaagtgagctcgtcatggtagtcgagcgccagacccacggtatcgaagccggagccgaggttggcggacgtggcgggcacgcgcacgtgaacgctattgcagattgggttcatggttgttccttaaaaaggagctccccttgtcaggggagcttgggtattcagctttcaactcacgggcagccgttcgaccgcctcatcagagggagcctagacggtgtcagtccagcacgcgcaggatggacgggtcaccggtgacgaagtcgagcgcctgcacggccttgacggtgttgcgcagggtttcctcgtcggtcaggtgggtcacgatgcgcagctgctggatctcgccgtcgtagccggggtcggtcatggtgggcttcagatcctggttcacaccgttgatggagacaccgttcttggcgaactcggcggcgatggcggccagcacgcccggcttgtcgtggatcaggaagcgcacggcgaatgcagccttggaggcggtaatcggagccttcggcagattcttgtacagcgggatggacgggccggtgcagccagcagcaatgtggcgggcttcggtcaccacgtcgcccacgacggcggaggcggtcggagcgccgccggcgccacggccatagaacatgaggtcgtcggcggcctcggccttgacgaacacggcgttgaaggagccgtgcacggaggccagcgggtggttctcgtcgatcagggccgggtagacgcgggcggagacgccggcctcgccgttctcgaccacggcgagcagcttgatgaccttgtgctcggcggtggcggcggcgatgtcgtcggcggtgatcttggtgatgccttcgacggacacgtcgtcgatggtcacggaggtgtggaagccgagggtggccatgatggcggccttgttggcagcatcgtagccttcgatgtcgccggtcgggtcggcttcggcgtagcccttggcctgggcgtccttgagcacgtcgtcgaactggagacccttggtggtcatctcgtcgagaatgtagttggtggtgccgttgacgatgccgagcatgctggtcaccttgtcgccgaccagggactcgcgcagcgggcgcaggaacggaatcgcaccacctacagcggcctcgaagtagatgtcgacgcccttggcctcggcggcggagtagatctccgggccgtacttggccagcagcgccttgttggcggtgaccacggaagcaccggattcgatggcggcaagcacgaacttgcgggccacggtggtgccgccgatgagctcgatgacgatgtccgagttggtggccacgctcaaagtatcggtggtgacgatggactggtcgatccacgggaacttctcggtttccttcgggtcgaggcaggcgacgccggtcagttcgatcgggcggccgatacgagcggacagttcgtccttctgctcgacaatcaggcgggcggtctgggagccgacggtgccggcaccaagcaggcctacgcgaatcggggtttcgctgttgtgagccaattcagggtccttccaaaaagttttctatatcccacgcctattttacggattatttccgacagcagaccgaaagtactcatcaagctgacggcccttttcgtattatgacggttttggccgcacattacagactgtcaggcgctcgcctctgcacgtggatcactcgctgacgtcgaggttgagtaggtcgtctacggtctggcggcggagcatgacgtgcgcaccggactcgctgacagcaaccaccgccggaatcagcgcttggttgtagttgctggccatggtgcggccgtatgcgccggtaaccggcacggcgagaatgtcaccgcgcttcaaatcggcgggcaactgcacctcgtgaaccacgatgtcgccggattcgcagtgcataccgcacacacgggcaagcatcgtttcagcggaaccggtgcgattcgccagacgcgcggtgtagtcggcaccgtagagtgccgggcgaatgttgtcggacatgccgccatccacagacacatacacgcgctcggcaatcgggttgccgtcactgtctttggcatcggacaagtgcacgtgcttgatggtgcccacgcggtacagggttacgccggcgggcgccacgatgtagcggccgggctcgaagctgatggccggggcgggcatgccgagcgcacggttggtgctgttgaccgcatccgccaagcgagtgagttccacgtcaatgtccattgaatcttcgccatcggtgtaggccacggagtagccgccgccgaggtcgatttcgggcaggatgtaggcgtcggtggcccacagggtcttgcgcagcagcatcatgcgcttggccgcgtgaatgaaggcgtccgcatcgtggatgttggagccgatgtgcgagtgggctccgaccagttcgagtacgtcctggttggcgaggatggtcttgagcacggcgatggacggaccgtccgcaatggcttccatcgcggcggccagcgccttgtctgtgtcggagacttcctcgtggctcaggtcgtacgggtacttgacgtcgtagtgcagctcgcgctctgatttctcggtcttttccgcgccattttccggggaatgcgtcgcagagatacgcgcgttggtagcggcaggcgtcacgtctttgaggtcgttcagcacgtcgagcacggcggcgtcggccccggcggccagcagcggcacgccgaacttctggtcctcgtgagcagtggagatgtactcgtggccgccggcgtggacaccgacggtgacgcgcagcatcacacgggcgcgtttgccgagcttgcgggcgatggcagcaacgcgctccggctcgtcgggctcgtcgatcacgattttggcgaagccctgttcgatggccagcgcgatttcctcatcggacttgttgttgccgtgcagcaccagacgacgtccgggaacgccagcggcgagggcgattttcatctcgcccatcgtgcaagtgtccacaaacatgccggcctcggtgaccaatcgcacgacttctttggacaagaacgccttgccggcaaagctcacgtgcgtagtggaggtgttgaatgcttcggcggcagcgcgcacgaagtgcctagcacatgcgactacttcatcagtgtcgatgagatagagcggcgagccgaactcgtcaagcagcgattcggcggtacgaccatgaaattcgatggagccttcggcattcacagccgtagcggccggccaaattggagaaataggcataatcacatcttttcgggggcggtgacgccgaggaggtcgaggccgttggcgatgacctgctggacggcgtcattgagcttcaggcgggcggcggcacgggccggctccgggttcttggcaatctccaaggccttgcgagcctcgtcgtcgccacgggtttccggatcggtcagggccatcggcaccacgcgctctacgttgtaccacttgtgataggtggcggccagttcttcgaggtaacgggccaccttgtgcggctggcggtcgtcggccgcagtggcgagcacgctcgggaattgggcgagggcggcgagcacttcgccgtcggcctcggtgtcgagcagggccaggtcggcaccctcgtagctgatgccggcagcggctgcgttgcggtccacgttcttggagcgggcgtgcgcgtactgcacgtagtacaccgggttgtcgttggtgtgcgaggcgagcagggccaagtcgatgtcgaagttctggttgtaatcggagcgggccagcgagtagcgggcggcgtccacgccgaccacggagaccaggtcgtcgatggtcacgacgttgccggcgcgcttggacatgcgcacgggcttgccgtccttcatcacgttgaccagctggccgatgagaatctgcatgttcttgccgggctcatcgccgaaggccgcgcacatggccatcatgcggccgatgtagccgtggtggtccgcgccaagcatgtagatggccacgtcggccgagttttcggcgcgatggcgcttgtcccagtagtaggcgatgtcggcggcgaagtaggcgaactcaccattggacttgatgatcacacggtccttgtcgtcgccgtgcttggtggattcaaaccaagtggcgccgtccttgtcgaagatgtcgccgcgggacttgagctcttcgatggcggcgtcgaccttgccgtcggcgtacaggctgttttcatggaaccagacgtcgaagttcacgcggaagtccttcatggacttctgaatctcgtcgaacatcatcggtacggcgcgcttgcggaattcctcgcgcacttcggtatcggcctcgccgagcggttcaccgtcatcgttcaggccctgatcctggtgggccagtgcggtcaggtccacgccgtcggactcggcttcggcctgaacacgggcggcgatctcgttgatgtaggcacccttgtagccgtcgcacggggtttcggtctggtagccggcctcacccaagttattggcctcggcccaagcggcgaccagcgacttggcgaagcggttgatctgctcgccgtggtcgttgaagtagtattcgcgcaccaccttggcgccgttggcctcgagcacgcgggccatggcatcgccgacggcagcccaacgggtgccgccgatgtgaatcggaccggtggggttggcggagacgaactcgagattcagggtctggccgcccagatggtcgttgcggccgtattcgttgaccttgttgagatgcttgtcggcgtcggtcacggcaccggcggcgagtacggtgtccaccacggcggcggccgaggcggagtcaagcgtgatgttgatgaagccggggcctgccacctcgaccttggcaatgccgtcggcttcagcgagcgcggcggcgaacggctcggccagatcgcgcggcttcatgccggccttcttggccagctgcatggcgatgttggaggcccagtcgccatgcgcacggtccttcgggcgcatcacggcgagcttgtcgacgggcggaatcagctcgtcggtcaacgcgccggcctggccggcggcgacgaggttgtgggcaatgctggaaatcagttcacttaaggcttcaggactcattcttctaaggatactgagaacggcgacacttgcgccctggtatgcctatatgctgcccctgctggcgggggcaagcacacagccgaaagataccaagcgaaaaagggtaggcgacaatcgccggaatcgttggaggctcgccgaaaccgctatacataccgtcggtcggtatctatagtgatctgcaacatcaagcacagtagggaggccaccatggcacgtaacgctcaccccgaggtgacgcgcacccgcatcctcgacgccgcacaacggctgttcatggcccagggctatgagcacacctccatccagaacatcgtggacgagctcggcgacctctccaaaggcgcgatctaccatcacttcaaatccaaggaagccatcctcgaagagctcaccaaccgagacaacaatatgcaggacgacttcaacgaatccgtcatgaatcgcactgaccttaccgccctcgaaaagttccgcgtgctatggcggcattcgatgaccaagcaagaccacgtgcagatcatgcgagccgccatgccgatgctgagcgatccggtttcgttcgccgcgaatatgcaggtatggagcaagcatctgcccgaacgcttcctgccgctgatcgaggcgggcgtcaaggatggctccatccccaccgagtatccgcgcgaggccgcagagctgctttcgttgctgccgaattattggctgatgccgtatttctacccggtgaccctgcccgaaatggagcatcgcatccgctgcttggccaccatgctcgacgcgatcggcgtgccgattttcgatgacgagctcatcacggtcgccgcgaagggcatgatgacgttcgcaggggagccggagaaaggctcagaatgaatagcacagtgaaacccgagaatgacatcgccggcaccgccacccaacgcccgctgctgtcccgcgacttcgtgctgctggtcgccggacaaggcatctcgctgttcggcaatgtgatgctgcgattcgcgatgtcgatgtgggtgctggacgaaaccggctcagccaccatcttcgcctcggtgctggccatctccatcgtgccgaccatcctgctctccccgttcggaggcgtgctggccgatcgcgtcaaccgccgcaccatcatggtggcgctcgacgccatctccgccgtgctcgtgctggcgagcgccatcgtcttcgccaccacgggcttccatatcgtagccatcgccaccatgcaggtgctgctcgccgtgctcggcgccttcgaaaccccgaccgtgcaggccgcactcccccagatgttccggcagtacggcccggccaccatgcgccaaggcatggccgtgatcaatcaggtccaacaactaagcagtctgctgccgagcttcctcggcggcgtgctgtatgcgatgttcggcatccgtctcatgatgatcatcgccatcgcaagcttcgccggcgcagccgcgctcgaatgcttcatccgcctcagtgccccggatcgcggcgacgaggagctgcccaccccacttgaagacctcaaggcaggcgtgcgattcctcatcaaggaccggccgaacgtgttcagactgctgttgttcgcggcggcgctcaactttgtgcttatcggctattccggcgtcggcttcccgtacacgattcgtacagtgctcggcttcgacgccactgtctacggcatcgccgacggcctgatcggtgtttccggcgtggcgggcgcattcatcgccggcctgttcgccgccaagctcacgatgcgctggctgccggggctgatggcgacgcttacgctggccatggtcccacagggtattgtgttcctgctgccggtcgacgcatggaccaaactcgtggtgctgatcgtattcacctgcggcacgatggtcgccagttgcttcacgaatctcatcgccgtgcccgccatccagctcagtacgcccgaggcaatggccggcaaagtgatgtccatggccgcggccgtgagcatgtgtgcccagccgctcggccagatggtgtacggctgggcctacgaccaaatgccggtcgccatcgtgctgttcatcaccaccgccctgttcgccgtgctcaccgtgctgatggttccgctcgccaagcagttcgaggactgacgatcggcgcgcacgccacatcctgccgcccggccataattgaatcaccgcacgaaaaggcacgaaaaggcacgaaagaggtacctatggccacgctcaacccccaatcattggtcacgttgtggcaaatcgaacagtatggttcgttctccgccacggccaaggccacgggttggtcgcagccggccatcagccagcagatcaaaaagctggaggcacagtgcggttcgactctggtgcaacgcacctcgcatggcgtggaactcaccgccaccggttcgatgctcgcccgccacggcgaggccatcgccgatcggctggagcgggcggcccgtgaagtcgaggattatcggcatcatcggtttgatcacctgcatttggtggccccaccgtcaatctgctctactatcgcggcccgtaccgtggtcaagctcagtatgttcacggacatcgagctgagcctgattcagatggagccgccggaggcgatcggtctgatttcccaaggcaaggccgataccgccgccgtgttccgctacagcagcatcccgaacttcctgcacatcggcgacgacctgaccttccattcgctgggttacgatccgatgcgactgctggtgcgccgctccagcggcatcgccaaacgattcgaggagaccggcgaacctgtgccgctgtccgccgccaaagacgagcattggatcgccggctgccccacctgccgcgcaaatttggtgaaactggccgcccgtgccggattcaagccggatatccgccactgcacggatgattactgggccacgcagaacctggtcgaggttggtatgggcgtctcgctggtgccggcgctcgatacgcatatcaacttgcagggcgatctggtggcctgtcccattgccgacgattttgcggcgcgcgaggtcggcatcgtgactcgtgccggcgaccatcgccccgcgcttggttcattgctcgaggagctcgagcgcacgtcactcaaatatttgagtgccaagtagtcgcacagcgataagcaagcttgcgagcgccatcacgatttcggggagccagaccgttgagcggcccttctgcaccgggaacaatggcatgttatgagcatgaacaacattccccagtcaacgactttgagcaacgcaaccgccggcacctcttgctttgatgccaatcacatcgacgtgacgaccatcgaggatctggagcaggtcggttcggataaatggacccgctaccccggctgcatcggcgcattcatcgccgagatggattacggtctggcaccatgcgtggccgaagccatcgaagaggccaccgaacgtggcgcgctcggctacattcccgacccgtggaagaaggaggtcgcccgctcgtgcgccgcatggcagcgccgctacggctgggaggtggatccgacgtgcatccgcccggtgccggacgtgctggaggcgttcgaagtgttcctgcgcgagatcgtgcgcgccggcaactccatcgtggtaccgactccggcctatatgccgttcctgagcgtgccgcgtctgtatggcgtggaggtccttgagattccgatgctgtgcgcgggcgccggcgagagcagcgggcgcaatgatgaatggctgttcgatttcgacgccattgagcaggcgttcgcgaacggctgccatgccttcgtgctgtgcaacccgcacaacccgatcggcaaggtattgacgcgcgaagaaatgctgcgattgtccgatctggccgccaagtacaacgtgcgtatattctccgatgagattcacgcgccgttcgtctaccaaggccacacgcatgtgccattcgcctcaatcaaccggcagacggccatgcaggctttcacctccacttcagcctcgaagtcgttcaacattcccggcaccaagtgcgcgcaggtgattctcaccaatccggacgatctggaactatggatgaggaacgcggaatggtccgagcaccagacggccaccatcggtgccatagccaccacagcggcctatgacggcggcgcggcatggttcgagggcgtgatggcatatatcgagcgcaatatcgcgctggtcaacgagcagatgcgcacgagattcgccaaggtgcgctatgtggagccgcagggcacgtatatcgcgtggctggatttctcgccactgggcatcgatgacccggccaactatttcttcaagaaggccaacgtggcgttgacggacggccgtgaatgcggcgaggtcgggcgcggatgcgtacgcatgaacttcgccatgccctacccgctactggaggaatgcttcgaccgcatggccgccgcgctcgaggcggacgggctgttgtagaaaattgtggctcccctcagagaggggagccgaggaacggccgaattaatcgaagtcggcacccaacgcttcgagtttgccgcggaagtcggcgtagcctcggtcgatcaggctgatgccgtgcacgtccgaggggcctgacgcggccaaggccgcgatcagatggctgaacccaccacgcaggtccggcacgtcgatgtcgcgtccggtcagcggggtcggtccgaagatcacggcggaatgcttgtagttgcgctgccggaaacggcacggcagcgagcccaggcactcgcggtacaactggatggtggcacccatctcgaccagcggcttggtgaagccgaaacggttctcgtacacggtctcgtgcacgatcgacaggccgttggcctgggtcagggccaccacgagcggctgctgccagtcggtcatgaacccgggatgcacgtcggtctcgatagccacgggctttaggtcgccgcccggatgccagaaacgaatgcccttatcggtcacttcgaacttgccgcccaccttgcggaacacgttgaggaacgtaatcatctccggctgggtggcacccttgacgaaaatgtcaccgtgcgtggcgagcgcggcggacgcccaggacgcggcctcgatacggtcggtcagcgacgtatgcgtgtagccttgcagctccttgacgccttcaatgcggaaggtgcggtccacgtccacggaaataatcgcgcccatcttctgcagcacgcacaccagatccatgatctcgggctcggtggccgcgcccgacagttcggtcttgccttcggccagcacggcagccagcaaagtctgctcggtggcgcccaccgacgggtagggcaggtggatcttcgcgccgtgcaggccgttgggcgcggtgatgtggatgccgtccttgtgttccttgtccaccgtggcgcccagcttgcgcagcgtctccagatggaagtcaatcggacgtccgccaatcgcgcagccgcccaacgcgggaatgaacgcttcacccaaacggtgcacgagcgggccggaaaacaggatcgggatgcgcgacgaaccggacagtgtatccacgtcggccacatcggccagctgcacacgcgaggcgtcgatggtcacaatgccgttcgcaccgtccacatccacgtccacgccgtgcagacgtagcaaatcggacaccacatgcacgtcacgaatctccggcacgttcttcagcaccgacttgcccggtgccagcaacgcggcgaccatcgccttgctcacgaagttcttcgcgccacgcaccttgatcgtgccattcaaaggcttgccgccctcgacatgcaacacgtcatccggattctcagccacgccactctcctcaatcaatcaagattcaaaaaatgctaccgtccagtttgccataagccatgtgccgactccgtgaaatgcaccccagccgaactttgatcaccgtgcacaacggatcccatacccccgtcgaatcaaaccgataacgtgatcttcctcacatttgccgccacggcgttctccatacttttacgctacgattcagggcaatggcatcagacgccatggccacaagcaaaggagcattcatgaccacagtcgccgtcatcggctgcacgcacgccggcacgttcgccaccacctcgattctcgccgagcaccccgattggaccgtccatgttttcgagcgcaacggtacgctgtccttcctctcctgcggcatcgccctgtgggtgggcgaccacgtatccgacccgaagaaaatgttctactcctcccctgccgctctggccgaagccggcgcgaccatgcatatgcgcaccgacgtgacgtccgtggacctcgacgccagaaccctcacctaccgcgcgctggacgaggccggagaccccgccgaacagaccctcgctttcgacaaactggtcgtgaccaccggctcgcgcccggtcatcccgccgatccccggcatcgacagcccgcatgtgctgctgtgcaagaactgggatcacgccatcgccatcaaggaaaaggcgaaaaccgccaagtcggcagtggtgatcgggtcgggctatatcggcgcggaaatcgccgagcagttcagcgtcaccggcgtcaagaccacgctggtcgacggccttgatcgcccgctggccaataatttcgataagaccatcaccgatcaggtggcggccgcgttcgaggagcacggcgtcacgctcgcgctcggccagaaggtggtcgagttccgcgacaatgacgacgacaccgtcaccgtggtcaccgaaaagggcgagtacacggccgaaatggcgattctggccgtcggcttcctgccgaacaccgacctgctcaagggcaaggtggacatgctgccgaacggcgcgatcgtggtcgacgactacatgcaggcgtccgcgccgggcgtgtacgccgccggcgactccgccaccgtgttctacaaccccaccggccagcacgattacattccgctggccaccaatgcggtgcgccagggcctgctggtgggccgcaacatcgagacgccgaccgtgaagtacatgggcacgcaggccacgtccgccgtgcagctgtacgatctctcgctcgccgcctccggcctgacccgcgccggtgccgaacgccgcgggctcacggtccgcgagacctcgctcaccgaggattatcgcccggacttcatgctcaccaccaccccagtcacgtcgattctgacctgggacccggaaacccgcaaggtcaagggcggccagttctgttccaaggccgatatctccggcgcggcaaacgtgatttccatggcgattcaggccggcttcaccatcgaccagctcgccaacgtggacttcctgttccagccgaacttcgacaagccggtctactacgtcggcgccgtggccatgaaggcggcggccgagtaagacggctgtacccaccgcaaaaaagaaaccccggcgtgatgggcgccggggagagaaaggagagaagaagaaagaggttaagttatgcagcttgttcggccgtgattacatataacagcaacagtttcaatgcaacatgggcactgtctgggaatcgtctgggaatcacggcccgtacaggctgttgcttgtttttggagccgatttaccggctggccttgatcttgtgggccagttcggcgtcccacatcgcgccggtggcggacatcaccgagtccgcgccggcgtcacggtacgcctggtagtcggcgggcgagaccacgccgccgacgccgttgatcgcgaaatcgagcccgagcttttcacgaatcgcggccagacgggcgaccatgtcgaggccggcgccacgaatcgcattgccgcacacgcctgagcgatcgcggcccgcgccgggcagggcctgattgccattggcatcgaccagtttggcggaaatcgtattgatggtgctgaagccctgcacggtgccgtggcccacggtggaacgcaccataagctccagagcgtcgtcgctggggatgtaggcgagcttgaccatcagcgggatgtcgccgatctcctgcttcacggcctcggtgatgcggcccacgagcagcggattgtggcatagcaggcggttgtggccctcgttggggcagctggtgttcatcaccatgagcttggcaccggtctccttgaccaggcgggcggtagtggcatggtcggcgatgtattcctcctcgctcatgccctccacacgcgagccttggaagctcgggaccagcacttgaccgggaccggcggcctcgatggcggcgcgcatgtccggctgccagacgtcagggctctgcgagggcacaccgaagctgttggagatggaaatcggctgttcatagttggtgtcggccagcacgccttcgtccagttcggcgctgcccggcgtcagtgaaccgtccgccgacttggggtgtacggcgagcacgttcgggaacgggttgcagccccaggcgcgcgaacgcacggttttgtaggtcgccagatcgaaacccatgtggaaagcggccgtggtgaaacggctgttgagcagcgggcctgcgggaatgccgaaaggcaggttgaccggctggcccaaaaaggtggccaaggcaccctcggaggcaccctcgctggtggttccggcggcatcggcaccgttgccatccttcagcgcctcggcgaacgcgccgaacggcccttgctcatagttgtcttcgtaactgcggctgacatcgtaaaacggctcaaaatcactcatgcttcaacgataagccaacctgcatgcgcacacgcacactcaacccatcatcgcgccgacaaacgaaataatggcgaaagcggcattggctaccacaaagatgatgaacgtcggagctgcccagccaaagtacgtgtctggaatactacgattcgtacggtgatattggcgcatctctttgccgtatatcacgaatatgataatcgatccgatcacgccgatcacagatagcgacaatgagaatatcaaatatgcgttgtcatcaagatagttgccggcaagggtatcgatggcgccggaaagaatcgcattgttgaagatgtgcagtgcaatcgaccaaaccaacgagtattccatggccacgaatcccagaatcaggccaaagaggaacgcgaatgtgccttgcactacgtcgtcatggaacaggccgaacaccattgccgaggtgacgatggcgaagttcttgcccaacggcttgagctccttcatcagtacgccgcggaacagtacttcctcgcaaatcggagcgaccagcccaacgtacagccacatgcttacggtgacgctggattcggcgatgctgtctgacgtgggagaggcaagatcggtgcccagcctggaaaaagcgacctgcaccaacataacgatgccttgcacgcccatgcccagcacgatgaacatcaacgcccagagaggctgcatgcgcccgccgccatattggctgatgtggccaagctgattgggctccccgtacgagtcgcgatgctggccaccaagccagaattcgcaggtgaagatgtcacggtggcgcatgagcagcagaaatccgaacgcgacgaacaccgatatcaggctgatgatgccatcccactgcacgccggacaaatcgctcgcggttattacgccgacgataatggtggcgaccattgcgcccaagagcatcatgccttcataggcgagagtcagtcccattacacgattgaccaccttgcgacgccacgtgcgccatacacggcgaggatcgatcggcatgaccacgggcattgctgcgggcatcgtggcaggcattgcgttgggcattgtgactggcattgccggagccgtttgcacgaatggttgcggcgcagcggaatagggttgtggcgcgtagcccactggttgagcgtagtacggatgagcgaggggctgtggagccgactgttgcgccgggtatggggaataggcggattgcgccggatacgtcggctgcgtgggatacatcggctgggcaggatacgtaggttggacgggatatgtcgggtatacgagctgcgcggcgtattgtgcaggctgcacagcaggtattgcggcttgcggcacaggttgtgaaacaccttgtgaaacaatccgtggaacaccccgtgaaacatcttgtggaggtagcggttgtgcccatgcctccggctgacccgcatattgcggctgcatgctcggcccaggctgaacatactgtggcgtctgtggcatcggcgtctgtgactgtgccgcagactgcggtgccggtcgaggtggcaacggttgcgctgacagcgattgcgccggagccgtatcggaatcgttcgacggattcatgtcattcatggtcatgatgctcaacctaaccgtcattactggatgaatcgtgattatgtccacaaatgtgtacgaattcaggcacagtatttcgaacgctaggacggagttcatgagtgttgaggaaagcgccgccacgccggtgttggtggctgcggtggataacgaccgtatggcgttgttggcactgaagggaatattgccgcaactcctgcccgccgcgcaatggatgtggggcgcgggcaccagtgagacctttgtttgatgcgatgcgagcgacccaataatctcaatcagacacagagccaacggccctgggcctgcaattatggactcgcctttcggcgaggctcaatgctggcctcgctgctgtcgcagctcggcacagggcctgctgaaagcccaccgggctttcagcaggccgatcgcggctaaataatgccgcgatcggccaacggccctgtccagtctgcgtcctcaggctcgcgggcggactcgattctttcttcggcccagtgtttggcggggatggtcttgggcttgaaggggaacttttcggcgcgcatcttttcgtaggcggcgatgtcgtcctcgtgctgcagcgtcagatcgatatcgtcgtagccgttcatcagacgccaacgcacgtaatcgttgacctcgaacggcagggtcacgtcgccgcaagtgacagtgcgggtctccagcgagacagtcatctcacgaccaggctcttcctccagtagcttccacaggagttcgacggactcctgcggcataatcgcggccagcacgccgttcttggcggtgttgccgtagaagatgtcggcgaagctcggcgcgatgaccacgcggaaaccgtaatcgtgcagcgcccacacggcgtgctcgcgggaggagccgatgccgaattcggggccggcgaccagaatctggcccttaccggcgtattccggcttgttgagcacgaagttcgggtctcggcgccatgcgtagaacagggcgtcatcgaagccggacttggtcacgcgcttcaagaacacagcgggaatgatctggtcggtatcgacgttggagcggcgcagcggcacgcccacgccggtcagtgtggtgagtttttccataacaattttcctttcggggatctctcccccagtcagtcttcgactgacagcccctcgtcagagggggctcacgtgtattgactcagagatcggcgggagacgagattgtgccgcggatggcggtggcggcggctacggccggcgacgccagatgcgtgcgcgagcccttgccttggcggccctcgaagttacggttcgaagtggaaatcgagcgctcgttcggcaccagcttgtccgggttcatgcccaggcacatcgagcagccggcgttacgccattcggcgccaaagtccttgaacaccttatcgaggccttccttctccgcctgcaaacgcacgcgggaggaggccggcaccaccagcacgcggtggatgttctcggccttgcggtggcccttcataatcgcggcggcctggcgcaaatcgtcgatacgaccgttggtgcacgaaccaatgaacacggtgtccacggcgatgtccttgatcggcatgcctggcttcaaacccatgtatgtaatcgcacgttcggcggcggcgcgcttggtggcgtcggcgatcttgcccggctccggcacggaggcggtgatcggcagaccttggccggggttggtgccccacgtcacatatggaccgagcttggtggcgtcaatatccaccaccttgtcgaatacggcatcgtcatcggtcttcagcgtcttccagtacgccacggcctgatcccacagctcgccttccggcgcgtgcggacggcccttcaggtactcgaacgtggtctcgtccggcgcgatcatgccggcacgcgcaccggcctcgatggacatgttgcacacggtcatgcgctcgtccatggtgaggttgcgaatcgcctcaccacggtattcgatcacgtaaccctggccgccgccggtgccgatcttggcgatgatcgccagaatgatgtccttggccgtcgcgtccgcgggcagcttgccgttgacgttgacagccatggtcttgaacggcttcagagacagcgtctgtgtggccatcacgtgttcgacttcggaagtgccgatgccgaacgccagcgcgccgaacgcgccgtgcgtcgacgtatgcgaatcaccgcacacgatggtcatgcccggctgggtcaggcccagaatcggggcgaacgcgtggacgatgccctgatcagcgtcgcccagcgggtgcaggcgcacgccgaactccttgcagttcttctccaaagtcgtcaactgcaacgcgctcgtctcgtccgggttcgggcgatcgatatcaacggtcggcgtgttgtgatcctcggtggcgatgagctgatccacgtgacgcggcttgcggccggccaagcgcaggccctcaaacgcctgcgggctggtgacctcatgcatgagcatcagatcgatgtacagcaaatcaggggctccgtcgctgcccttgcgcaccagatgatcggcccagaccttctcggccagtgtcgttcccatagtgattcctccaaaaaattccgcgcgaggtattgtgttcgcgccttgttcgtggtattagcctatgtgcttgcgatgggcccggccatgagcatgccggatattgagatacggtcaaatgatggcctcaatatgactcggacccgactcgaacatgacctagtcatgactcggttccgctccagacatgtctcttcggcatccacgaacgccctttcaacttcatggccaccctgtgagacacttccccgatttgccatttcactatgtgagatggcataatcgcccttattatgactgattcccgggaagaaccattgaacaacagcttgaccaagtccgagccggttgaagacaccaccgccaaggacgatggggaaatccattccggcgttggcgtccttgataaaactgtaaagattcttgacgcactggaatccggcccgtctacgctgggccagcttgtggccgccaccggtctcgctcgaccgaccgcacatcgtttggctattgcactggaacgccaccgtttcgtactgcgcgaccagcatggccgattcgtactcggctcccgtttcgccgaacttgccgccgcagcaggcgaggatcgtctgctgaccgccgccggcccgatcctgcagaccctgctcgatcgcactggcgagtctgcgcagatttaccgccgccaaggcgatcagcgcgtgtgcatcgccgctgtggaacgcacctccggcctacgtgattccattccggtgggtgccatgctgtcgatggaagccggttccgccgcccagattcttctggcttgggaggattccgaccgtctgcaccagggattgcgccacgccaagttcaccgccaccaagctggccgccgtacgcaagcgcggctggtccgagtccgtgaacgagcgcgaagagggcgtgtgctcgatttccgccccgatccgcaacgcctccggccaggtcatcgccgccatctcgatttccggcccgaccggccgcatgggtgccgcccccggacgccgctatgcgccgctggtgatggccgccggcaagtacctcaccgaggcactggtcaaagccgttcgctgaaacataccagtcaatccaaccgatagcccaaccggcagaaatcccgcgtcacaacgaaagagacgcgggatttctgccactaatcgtccaacacagcggaaggccaccgaaacctcgaatacttcgcgccgctttccgcctctatcaggaacagttacctgaataaaccggacagttgactccatagcgacggcttgcgcagcaaatcatcgccctcaccctcgccaggcgtggtctggttcaccgcataggtgtaggcgcgtttggaactgggcttgcccaccagttcgccaaactccagcaattgcgtacgcggctcgtaagggtgacggatatcaaattcgatcaatcgcgtggcacgtttggccggagccggtccgtacgtattgaatccgcaggttggcgtagcgataagcaacagaccctcatgttcgccgacgaaaccgttgcgatgatcatgaccagctacgacgccgaaatacccctcgcgcagcaattcgaattcgcctgacgtatcagggcaggatatgccttctcccaaatatccgccgggctgggtttgcaattcgtccagcacgtagtaggtatcggcgtgcgaacgatagccctgcatggcaaacgccgcgttggccgccaccggcttcagcacgttgtaatactcgggcatcggcatgtgctggaacaccattgatttcgcaccgatacggtcgggcacggcgttcaggaaggcgagcgctgcgggcgatggtgcgccgaagccgccgccatgcacgtaatcgccggagtcaagaatgaccagacccagcacattgcgcgtatggtcaacgtccataaccggcagcgcgaaggtgcctggttcaccggaacccactgcggatgtgggggaagacacagcagaaggcacaacagcatcggcaccagcatcgtcaacgacgcccaacgtatcagccttcgcggtaatccccgcaccggagccagtggcaccagacggcgtctgcacagcgccacccgctccacaggtatatgcaatctggttcggcaaggtctcactcggcggattgacacaaccggggaactcacgatagataccgtccagttccgcattgcttagcccgcattggaaatcatggttgccatacgtcacagcccacggaatgccgcgcgccgccaacggctcagtgaactggccaatggccttgcgcaccagcgctcgggtatggttcagcgcggattcggcaataggttcgtcacaccagcgacgtttacggaatgaatcggcgaacgccggatcgtagccggcgatctggttgccggagaaaatcaccagatcaggccgtgtggcatcaaggctggcctcaatcagggtgatggtgtctttggagactttcggcccatcctgaatgtcggcaatctgcagcacgcggaacttgccggaatagtggaattgcagtcgtccgagacgcgcagagatagagaccggacggccgtcttcggcatcggccggcttgatacgaggtttcgacgacatcccctctggcgtacgctgtgtttccgtcatgccctccactgtacacacaaacgaaaaggcccgccggagcgggccttttctacaagttcaactactggagcagaatctctgcacaacatcatcgttgtaacggtaagtctttccaatgcccgtccaacgtaacagtcctcgtgaccatacactatttgtgggctctgctctgttcagttgttcttgtacctcataatctattcatcactcccgtttctcgcaacctgcagagagtcgttgtgcgttttttatcacaactgttcaatcgcactttctggctatcggaaaacgagctgaaccgttcacatcgaacccgtccgatgttcgatttcgttcgtttcaccgccgctcacggcgtgtcgcgagcgacgctagcacactcaaaaccaaccaacaccgaactaacatgaacacccgttgaattctggcgcgttcagtcgttttccggccacgccaaagcttacgatataagctatggcacagatatttgacgcaccctcgaaggcaattctgcgcagccaaatcgcagagcatattgccgaaaacgacaacaacgaccgccgcgtcgatcaggaaggcgaggcaccgctgcccaaggaccgtttcttcgaccgcgagctcagctggctcaagttcaaccagcgcgtgctcgaatgtgcggagaacgaagacatgcccctgctcgagcgcgccaacttcgccgcgatcttcgcctcgaaccttgacgagttcttcatggtccgcgtcgccggcctgaagcgccgtatcgactcgggcatcgccgtgccgtctgccgccggcctgagcccgcgtcagcagctgcgcgcgatcagcgagaccgcacaccgtctgcaagacgagcacgcacattacacgatcgacaccattctgccggaattggagaaggagcgcatcgtcctgctgacgtgggacaagctcacatcctccgagcaggagcgcctctcgcgctactaccgccagcaggtgttcccggtcctgacgccgctcgccgtggatccggcccacccgttcccctacatttccggcggttccatcaacctggccgtgattgtggagaacccggcctccggcaagtcgcacttcgcccgcgtcaagatcccgggcaacctgccgcgcctggtgccggtggacgacatgaccgatgaggagtccaaggacgagcgttacggcttcatcgccatggaaaagctcatcgccgcgcatctggaatccctgttcccgggcatgatcatcaaggaggcccgctccttccgcgtgactcgtaacgaggacatcgacgtggaagaggatgacgccgagaacctgctcaacgccatggagaaggagctgctgcgccgccgcttcggaccgccgatccgcctggagatcacggacaccacgagccccttcctctcccagctgctcgccgaccagctcggcgtgagccaggacgaggtataccgtctgcccagcccgctggacctgaccgtgctctttgagctcggcagcgtggaccgcccggacctgaagaaccgtccgttcgtgccgaccacgaaccgtcagatcgccgaggtcgagtcctcccgcgcacaggatattttcgctgccatccgcgagcgcgacatcctgctgcatcacccctatgactccttctccacttccgtgcaggccttccttgcgcaggccgccgcggacccgaaggtgctggccatcaagcagaccctgtaccgcaccagctccaactcgccgatcatcgacgccctgatcgacgccgctcatgccggcaagcaggtgctggctttggtggaaatcaaggctcgtttcgacgaggacgccaacatcgcgtgggcccgcaagctcgaacgcgccggcgtgcacgtggtgtacggcatcgtgggcttgaagacccactgcaagctcatcgaggtcgtgcgtcaggaagcggacggtctgcgccgctactgccacgtaggcaccggcaactacaacccgaagaccgcgcgactgtacaccgatctgggtctgctgacctgcgacccggtggtcggccaggatctgactcgtctgttcaaccagctctctggttacgcgccgaagtccagcttccaccgtctgctggtggccccgcgtaccgtgcgcaccggcctgattcagcgcatccgccgcgaggaggacgccgcccgcgccggcaaggaggcctggatcaagatcaaggtcaactccatcgtggacgagaagaccatcgacgccctgtaccgtgcctctcaggccggcgtgaagatcgacatcgtcgaacgcggcatctgcgctctgaagcccggcgttcccggcctgtccgagaacatccgcgtacgttcgattctcggccgcttcctggagcactcccgcatctacgccttctgcaatgcggacggcccgcagatcggcgagggcccggcttccggcccggaggtctacatcggttcggctgacctcatgcaccgtaaccttgatcgccgcgtcgaggctctggtgcgcgtcaccgccccggagcagattgacgagctcatcaagtacgtggacctgcagatggccgactccaccatgagctggcacatgcagcccgacggcacgtatgtgctgcacaccaaggacgacgagggccgcccgctggtcgatagtcaggaatacctgattcgcaagcaccagcgtcgccccaattcacacaactgatttcactcgatgctccctgtcagcgcaagctaactgagggtggttacgatgcccggctcctctttcgagaggatgccgggcatcgttgttcagcgcgcaaaaactacgtagcagcggtccaacgtgacctacaatacaagagatgggtacgaacagtatgagacgaatcgtggaagccgccggcggtattctgtaccggtggaaggatgatgccgagccgacgcgggcatcatctccatcagtgaaatccaatattgccaccgatggcaccatcatcgcgaacaccacggattctgacggcgagaccacggcagcacccggcgcatcggacgcggcttccaccccggacccggcgcaggccgacagcccagccacagcggacaacgtactcaaccgcatcgaactgtgcatcgtgcatcgcccgaaatacgacgactggagctggccgaaaggcaaggtcgacccaaacgaatcacaccggcatgccgccgtgcgcgagatcggcgaggaatcgggcctgcccgtggaacttggcccctatctgggcgacatcgagtacccgctgtccgaagaaggcagcaaacagcgccataccaaggatcggtcggcggacaccaagcacatccagttctggatggccacgccaatcagcgccatcgacaatctgcggcgcacccatgcgtttggcccggtgcatcgggcggacatcggcgaaatcgacgaagtcctgtggttgacgccggccgaggcccgcaagaaactcagccattccaccgataaggacatccttgcgctattcgttgaccgggtgcaggagggcgcgcttgacgccgtgccggtgattatcgtgcgccacggcaaggcagaagcgcgcaaactgtggaagggctcggacgagaaccgtccgatcacgccgcgcggcgcggctgcggcatacgcgctgaaccgcgagctggcgtgtttcaatccgacccgactggccacgtcgccttgggtgcgctgccaggagacgttggagatgttcgcgtggcagaccggacgagacatggttcatctcgatccgctcaccgaagatgcatacgccgctgcgccggacaccgcatgggagtgtctactcagcgaaatcgagttcgcacttgagcgccgtcagcccatagcgatatgcatgcaccggccggtgattggtggtatgttcggacacctgcgcagcatgtgcgttgcgccgtctctgagcaaacgcctgatcgccaagacaccgttcatgccgaccggcacggcggtggcgctgttcgtcactccgacgcctcatggtcccaaaatcatcgatattcagaaggttcaaccgcttgtctactagacccgcatttcctgattcatccaactcctcggccgctgccgctgcagctcatgccgcgcacaatggtgccgccggcagtctgggcccgggcttcggctcgttgcgtgcggccggagcggcattcggacctgctcgcatgggttcttcacgcccctcgcgcccggctcagctcgacccggctgtggccgatggattggccggtggcatggacccgcaggcgttgagcgagatgagtcatctgtctgctgccgcattgctggatcgtgtgcgccatagcgaagacccggcggttgttgagcgggtgctcacgttggtggagacggtcggcgtggatgaaatcgccgaactatggagcgataccgagccggattcgctgcctggtgtgctgtggcgactgtatatgttgcgtacgtggatgcgatcgaatcgcgactcgatcgcgcatctgtggcgcttgggtgagccggtggccactaccgcctccgccatcgccggcgtggatcaggctcccagtgaagatgacatcgtgcgattggccgattcgattctctccggtgcttttgtgggcgattttgccgtggcgcttgagcgtgcggcggcgtttaccgatgtggtggcgttgggcttgcgcgtggaggcgcggcgcatggtgacccgggccgaggccaacggcggcttctcctcggatgccgatgagaaggccgtgcgcaccaaagccgcccgccttatgcacaccgccggcagcctcatggccaccgccaaggatttccaacacggtgccaacctctggcgtcgcggacggttggagtaaccccgctccaggctccctctgatgagggagctgtcacgggcgatgcccatgactgagggagaaacccaccaaccgcaccccaacaatcagctaccagccaacaccacacctcccccggcgcggcgagccccatcgcaagctatactgagtatccgcgtcggaccgtgcttaagccccgggctccattttttgccgccgcgagcggcccttgcgccgacaggcgctttcgcggttcggcgcttcttttcttttaccagattcacgccccgagcgttgcgatgggcacgaccagtatgccgtcattgcggcgataggccttcccacctcggccggtaaggaacatcatgaattcggggtctcggacctgagccatgggattgccgcagattttgttgcggaaggatttgagcttatccgcattgtcatcgttcaccttaaggtcactgagttttatttcgatggcaccccacctgccgtcagacaactcgataatgacatcaacttcaagccccttgtcatcgcggtaatacgcaatgcgattcccggcacccggcatagccgacagatatacattcaaatcacgaatgcacagcgtttcaaacagatcgccgagcgtctgtgtatcgcgcatcagagtattcggcgcggcacctaaaaccgcagcaggcaacgaaggatccacgaaatatcgcttgggcttggttcgcacacgactctttgcgcggagtggcggttcccaaccctccaaatccgtcagaaggtacaagtccttgaacatttccaaatagctcttcaccgtctgcgtatccggctcacgccgctcatcgccatatgccatatccgcagccagcgtcgcatattttggtgcctgcgagatgttcacggcaagagctcgcatcaaagctcgtgcagtttcaggattcttcttcatcttcggcacgctgatatccagcacacttgcgatatattcgcccgggatttccaaggcgaattcatcgtctagctcaagattcgcgggccatccgccacggcaacaccatctggcgatgtcttcgatactcgtattgcattcggcaggctcgaatttcccctcgaacaaatcggataggctgaccgcgcccgtggattctccggattcagccaagctcatgggccacatgcgcagacgagcaatgcgaccagtgccgctgtgatgaatggcgtcacgatcctttggaatagccgaacctgtaagaatcagctgccccttgcggttcgcattgtcatctatatggcgacgagcggcatcccaaatttgcggtacatcttgccattcgtccaccagatggggctcctcccccatcagcaccaatgcaggatcggtttgggcggccgcgaaaactgccacatcatccagacgatcaacgcttcgagaccgggagagcgcggtccatgtcttgccgcaccatttcggcccaacgatttccactgcaccgaacgccttgagcagtttacttaatctgctatctaccacgcgtgaacgataatcaggcctggtcaaggtaccatcgcgaccactcaaatcgttcatattgcagcctttcccagttctatcgttctaacaatatagattttacaccagtttcattcccgattttacacctatctcattcccggttttacaccagtttcattccctgttttacaccgtgttgttttttacgctttaccctctcagaggtatcagaggcagatctcggcacggacagggcattgtcctgctgcaactggcctatcgcagcaaaaagtcgaatcacccacaaatccaatccgataagcaagccgcgccattaccaattcggcaggtcggcaaacttggactaggctgggaatcatggaactccatgttttgaatcatccgctggtcgagcacaagctcaccgtgctgcgcgacaagaacaccccctcctccaccttccgcgagctcgtctccgaactcgtgatgcttgaggcctacgaggccacccgcaacctgtccgtggtggccgcgccgatcgagacgccggtcgccccgatgaccggcaagaagctcgcctccccgcgcccgatcatcgtgccggtgctgcgcgctggcttgggcatgctcgacggcatgacccgcctgattccgactgctgaagtcggcttcctgggcatgaagcgcgacgaggagcaccccacccagcaggtgacgtacgcgaaccgtctgcccgaggacctgtccggccgccagtgcttcctcatcgacccgatgctcgccaccggcggaacgctggtcgccgccacgcactacctggccgagcgcggcgccaaggacgtgaccgcgatcaacatcatcgcggcccccgaaggcatcaagtacgtcgaggagcacatcgacccgtccatcgacttcaaggtcgtggtgtgcgcggtcgacgaacgtcttaacgacaagtgctacatcgtgccgggactcggcgacgccggtgaccgtctctatggcgtaattgactgatttccctggctcccctccccgaggggagccaacataacggaacatctatgcaaatcgacattattgcgccggggcgcgtgaaggagcgttaccttcgcgacgccattgacgagtattccaagcgactttcgcgctactgcaagctcaacatcattgaagtggcagatgagaaaacgcctgaccatgcctccgaaggcgttgaccgacagatcaaggccagagaaggcgaacgcatcgccaagcatctgaaggacggcgcgtttgttattgcccttgccatcaatggcaagcagctgtccagtgaagaattggccgccaaaatcaacgaccttggattgcgtggcaccagccatattcagctggtcatcggcggttcaatcggccttgacgacgcgattctgcgtcgtgctgattttctgctgagtttctcgaagatgacgttcccgcatcagcttatgcgcgtgattctgctggagcagatctatcgcgcttataaaatcaacgctggcgagccgtatcacaagtaaaacgccatacctcatggggcgggaaatcccccatggggcggtaattgccccatgaggcggcaaaatcctcatggggcggtatgccaaaatggcttaattccgcggtttcacatattcttcaaaccgccccatgggcaagttaccgcccgatgagcctgtaaccaccccatgggcgcatcaataacgccctcaacctcacactgcgtcggggacgaacgcttcgaagatgtggcggtcgaagtagggggcgcactgggcgagttcatcgctgctgcgcacggtccatgaaaccggcatcgcacccatcgaacgagcgagcttgacttgcggcgaagcgccaccggtccagtcataagccacgaaatcaggacgagacagccagtcgaacgccagtaagccggcggcccattcagccgcaccattcttgctcagcttcgccggccagctcagctgaccgcggcacacctcagggtgatgctccttgtaccaattcaccgcgcccgggtggaaggattcgatcacgtacgggccgtcatacgcctcaagcaaggcgtggcccttttccatgagctcttcgctacgctcatcccaagccctgttgttgctgaacttgtattccacaatcagcggagcctggccggccaccacgtccagcacatcggagaacagcggcacatgctggtagtaccccttcggcgcggcggacggcgtgaccaccagcggcgggttcgcgtcggcacccggcaacggttcggccttcaaatcgcctgactcgccgttcgggaagagcggaatacgggcgagttcgtcgtaagtcaggtcttcgatgcggcgcggatcgccggccacgcgcaacaaatcggcgtcatggaccacgaccacttggccgtcgagcgtaagctgcacgtcgagttcgatgccatagccagcctcgcaggcggcggcgaacgcggccagcgagttttcgggagcaatcggaccggtcatatccgcactgccgtagccggccttgacagccatgcgacgggcaagcgacacataatcatcgttttcggcgatggatcgctcagtggtatcggcttgggcgctaaccggattatccccaccataatcagcgatatcggtatagccgaccaaaccagaacccgcatcatgcaagccacgatgggcataccatacctccggaatggagggcacgaaattacgacgcttgtcattgaacgtgcgcggggccacggcccacacggcagcaccggcggcggccacgcctgccagcgccacgtttctccagagcttcgacgacattggaatccttcctgttgggctgcctctagcctaacgcttctgccagccattgtggagtggttggatcatccggtttcagcgcgcggtccaggtggttggcgcgcagtggctcccagctgaaatctgccagcagatcggcgggtttgcaaggaattggagtgggttgcagacgcagcagccaggcgcagtatccgatgatttgctcgggggttacgttgcgggcgcgcaaggctcccatatccagcgaacgttcgcgcttggctaaacgccggccggccgcattgtcgataagcggcaggtgcgcatactcggggtgctcggcgagaggcttttccgtgttgccgcattccggctcaaagccgccagccaacagacactggcgaatccacatttgcagcgcggtggagcgcagcagatcacggccgcgcacgatatcatcaacacccatatcgaggtcatccacgaccacgaccagttgatagccgaacagtccatcggctcggcgaatcacggaatcgcctacctcgcgggccaaatcgtagtgctgtggactatagacacggtcgttaaagcatgcgacaccatcaacgattccggcatcgccctgctgttccggcggcacggctcccgacagcgcagcggaatcgtcaggcactgtacgttgcttttctcccgctgccgattccggcatggcgatacggatggaatgctggtcgccgcgaaccaaacgggcacggacctcgtcgggatggtcgtgcagcaggcggcggcacgtgccggggtacaccatgaagccgtcgccctcgttgggggccgaggcggcgcgaatgtcggcacgcgagcagaaacaggggtacagcacaccttgcgagcgcaggcattcgagagcgtattcgtatcgttcagtgcgctgggattggaacatcggttcgccatcccagtcgaggccgagccaatgcaggtcatccatcatgagctggtccgcaccggcgaccacacgcggcttgtccacgtcctcgatacgcatcagcatgcggtcgccacgcgagcgggccgaaagccatgcacccaacatggcgtacacgttgccgatatgcatgcgccccgacggcgtcggcgcgaatcgtccagtcactggccctcctcgtatgaagttcagcaccatggtagcgaaaaggctctcctcctcagaggagagccaatatagtgaagctcgccagcccgaactcccctcagtcagcttcgctgacagctttgctcagagaggggagccagtgattgtcacttgtcttcggtgacgttgtccacgctcacgtccggattgtcggagacaatctggtcgctcgcccaagcggagagctccagatgttcgccgccggtctggtcgacgagcacggtgtcaccgtcgtggaccttgccggccagcagcatacgggccagctggtcgcccacttcggtctgtaccaggcggcgcagcggacgagcgccataagccgggtcgtaaccggtgttggccagccattcgcgagccgagtcggtgacgtccagcgtgatgcggcgatcggtcagacgctgggacacgccagccacctggatatccacgatgccgccaagctcctcacgcgtgagcgggtggaacatgacgatgtcgtccagacggttcaggaactccggcttgaagttcatgtggacggcgtccatcacggcctttttcttggcgtcggcgtccatgtcctcgttcacgaggaactgcgagccgaggttagaggtcatgatcaggatcgtgttcttgaagtccacggtcctgccctggccatcggtcaggcggccatcgtcgagcacctgcagcagcacgtcgaagatctccgggttggccttctcgacctcgtcgaacagcaccacggaatacgggcggcggcgcacggcctcggtcagctggccgccctgctcgtagcccacgtagcccggagccgcaccgatcaggcgcgagactgaagccttctccatgtattcggacatgtcgatgcggaccatggccttctcgtcgtcgaacaggaagtcggcgagcgccttggccagttcggtcttgcccacaccggtgggaccgaggaacaggaacgatccggtcggacggttcgggtcggagatgccggcacgcgaacggcgcaccgcgtcggacacggcggcgatggcttccttctggccgatcacacgcttgcccaggtagtcctccatatgcagcagcttctcgttctcgccctgcatcaggcggccgacgggaatgccggtccagtcggagacgatctcggccaccgagtcggcgtccacacggtccgggaccatcggctcatcggccgggttggccgcgccggcatcggcagattcggcatccgcgctttccgcggcggcgagttccttctgaatagccggaatctctccgtacagaatcttcgaggcctcagccagatttccctcacgggtgaacttgtccgcctgcacacgcaggtcatcgagcttggcacgcaggtcaccgaccttgttgtggccggcctgctccgcatcccaacgcgccttgaggccgctgagcttctcacgggtgtccgcgagttcggcttgcagcttgcccagacgctccttggatgcaggatcctcagccttcttgagctgcatttcctccatttcaagacgggtcaccttgcgctgcagttcatcgatctcctcaggcgaggagtcgagctccatacgcaggtgggcagccgcctcatcgaccaggtcgatggccttgtccggcagctgacggcctgagatgtaccggttcgagagggtcgcggcggcgaccagcgcgtcatcgccgatcgtcaccttgtggtgcgcctcgtaacgctgcttcaggccacgcaggatggcgatggtgtcttccacgctcggctcgcccacgaacacctgttggaaacggcgttccaatgccggatccttttcgatgttctcgcggtactcgtccagcgtggtcgcgccgatcaggcgcagctcgccacgggccagcataggcttcagcatattgccggcgtccatcgagccttcggccgcacccgcgccgacgatggtgtgaatctcgtcgatgaaggtgatgatctggccgtccgcgttcttgatttcgttgaggacgctcttcaggcgctcctcgaactcgccacggtacttcgagccggccaccatggagcctaggtcaagggagatgagcttcttgccttgcagggtggtgggcacgtcgcccgccacgatacgctgggccaggccttccacgacggcggtcttgccgacgccgggctcgccgatcagcaccgggttgttcttggtacgacgggagaggatctgaatcacgcggcggatttcctgatcacggccgatcaccggatcgagcttgccttccttggcggcggccgtcaggtcggtggagtacttctccagggccttgtacgagccttccgcgtccgggctggtgaccttcgcgccgccacgcacgccgggtacggccttgcgcagggaggctgcggtgacgccgttcttctccaggatttcggccgactggttcggcttgctggccgcgatgccgataagcaggtgctcggtggagacgtattcgtcgcccatctgctgcatttccttctcagcctgggcgatggcggcggtcagctggcggctggcttgcggctgcgaagtgctggagccggatgcgctcggcagtgcgaccaaagcgttacgcacggcggcgccgatggcctgtgggtctccgcccgcggcctcgatgagggagcgcaccacgccgttttcctgacgcagcaacgcatccatgacgtgcagggtctcaacctgcgcgtttcctgcggcggacgcactctgaatcgcgtcgccgacggcctcctgggccatagtggtgaacttctgttccatatcgtattcctccatatcatgcggcccgcgcggagcggctcgcgggcttcgaaagccctgcgagcgttgcgacagaccgcagcttgtcgttgtctgatatggtcaaccgacctggaacccattctattcccaaaacttgagtgcatatgactcaagttttggattttggtggggagggtgactagtagccccctctgatgaggaagcttgggcagccgctacttcagtgcgccgacggcggattcggcggcggcgaggacttcgccggagagaatcgcctcggccacgccctcaatctgcggggtggtccaggtatcgcgtacgtcggggccgatttcgttggcgtactggcgcaccacgcggtatacggcggcgcccgccgcacccggacggtacggcttgcggaagtcgaaggagcggcaggagcacagcagttccacggccagcacgcgcgcaaaggccggaatcgaccggcgcagcttgcgggcggcggcccaacccatcgacacgtgatcttcctgcatggcggagcttggaatcgaatcgaccgaggcaggcacggcgttacgcttcatttcggagacgatgccggcagcggtgtattgggcgatcatgaaaccggagtccacgcccgggtcaccagccaggaacgccggcaggccgcggttgcgcgccacgtcaaggaagcggtcggtacgacgctcggagatagaggctacgtcggcggtcggaatcgccaggaaatcgagcacataggccagcggcgcgccatggaagttgccgttggactccacacggccgtccagcgtgacgcacgggttatcgatggcggaggcgagttccacgcccgccacggaggccgcgtattccacggtgtcgcgggcggcgccgtgcacctgcggggtgcagcgcagcgagtaggcgtcctgcacacgcacggtggagcccgggcggccggcctcaatcagaccagagtccttgagcatgcgggcgatgttcgcagcggaatcgccttggccgcgatgcgggcgcagcgcctgcaagtcggcggcgaatacgcggtcgttgccgagcatgccttccacgctcatcgcggcggcgacatccgcggtcttgagcagcaggcgcagatcggtgatggccatacacaacatgccgagcatgccgtcggtgccgttgaccagcgccagtccttccttctctttcaaatcgacgggcgtgatgccggccgcacgcagcgcttcgccgccgccgatcttgaggccgtcagcgttgcgggcctcgccttcacccatcgccaccaaagcacaggctgcgagcggcgccaaatcaccggagcatccgagtgaaccgtattcgtagaccaccggggtgatgccggcgttcagcatatcggcgtagacctgcgcggtttccgggcgcacaccggtgcgtccggtgcacagggtgctcaggcgcagcaccagcaggccgcgcaccacctcacgctccacttccggtccggcaccggcggcatgcgagcgaatcagacttttctgcagctgcgcacgctgttccttggggatggaggtggaggcgagcgcgccgaatccggtggagataccgtaatgcggcacggtgtcgtcggccaaatgatcgataaccgcgcgactcagcgccatctcatgcttcgattcgtccgaaatcgccactttggcaccgccgcgcgctacggcgataacgtcctcgatgctcagcgctccaacacctacggtgaccgtctgctctgccatgctcatacctttctatatatgtgccgcattccgcatatacgacatatgcggcacatgcttcgccggggatccgcgactgcccgcattcgctcaccgcacctgcccatcaacagcaggcgacgcaaacgcgaccaatcgctccccgagtaatcaaaccttggccatttcacctcagtcggatgcccgccataagccacttcgtccatcttgtgtctgaaatctcagacatgtaaggtgatggaaatatgagccatgcctcgcagcaatacgccttcaccgagccacgtaccgtcaagcgggcgcaggtgaagccatcagaacgggaacatcagacatcatcatccgcgccacgtgtctcgctggctccggcggccgaccgtacgctcgacatcctcgagttcatcgcgagcaatggtcagacgcaagccgccacgctcgctcgcgaactcggcattccgcgctccacggtgtaccaattgttggagattttggagcgtcacggactggtcacccgccttgccgagcagcgcgcgtacggcatcggactcaagactttcgagctgggatcggcctattctcgccaacatcgtgtatcgcaggtcgcgcatccggtgttggcgcgtcttgttgacgagaccggcgaaaacggacatctggccgtgctgcacggcaacgaaatcatttatgtgattgaggagcgcgccgcgcatcgcccgccgctagtgtcaggcgtgggcgtgcgcctacccagtcacctgaccgccaccgggcgggccattctgtccgcactcccccgcaatcaggtccgcgcgctatatcccaatcgtcaggcgttcaccgaccgcaccggcatcggccccaaatcgcccaaggagctggaggcaacgctcgccgaaacccaacgcaccggttttgccgaggaacacggagacgtgacgcccggctttgattcatacgccgtcgctgtgcgcgactacaacgactttcccatcgccgggctggctctcactttcgtgagcggatcgctgcgccccgaacaggagcggtcgcttaagaccaagctgcggcttgccggcacggaactgtcccggcgtctcggcgcggtcggcagtttgacatgaggattcgcgagatcatcgtgctgggctccttcgccccgatcacgattttctcaactaagttcaccgattcgctgaccggcaacgccaaactcgccggcttctcgctgacagtgacggccatcatcagcctggtggtgatgaccgccctgcacgcacttctgccgggagcgtaaggcgcgttcttggttccctcagtcagcttctccgcctggacggttcccctcagagaggggagccagaacgagtcacgcccgaacgattacgttgcgcagatcaccgatgccttcgacgtgcacgatggtctcgtcgcctgggtcgaggtggccggaggcgttcggggtgccggtcatgatgacgtcgccaggcagcagcgtggagaacgacgaaatggcggcaatctgctcggggatgccgtgaatcaggttcgcggtggtgccagacgccatcggcacatcctcgccgttcagcgtgaaggaaatcttggcgtccttccagtcgaggtcgtcacgcatcacgatccacgggccaagcggacaggaggtatcgaagcccttggcgcgcgtccacgtggggtcgatgccctgcagatcgcgcaacgtcacatcattgacgcaggtgaagccgagcacgtaatccatcgcgttctcgacggtcacgttcttggcgatacggcccatcaccacggccacttccggctcgaagttcatgtccttggagcaggccgggtacacaatcgggtcgtcggggccgattaccgaggtggacggcttggtgaagatcaccatgtcttccggcgcgtgggcgatttcggagtggccggcctcgtgcatgaactgggcgtgggcctcatagttcttggccagaccgtaaaccttggaggggatgaccggggagagcagacggatgccatcgccgtcgaccgggtaacgagtgccggtgggcttgacctggtcgccggccagcggatggccgtccagttcgatgaggtagtccttgccgtccgtttcgtccttctgcacgaaggcgtagcgcggcgaatcattcaaagaaaaacgtgcgagtctcatgcctgtaagcctactccttggcggttccttccgcagaagcatccgtccaaggagcaagcagaccggccttcaatcgaccaaaacgcacgttcgctgggattgctacttttcggtccaggttttgtcatacagcgactggccgctttgcgtgtgcatgatgacgcgcaatgatgccttgccgctggaggtcttgcacatcgagcccagcagattcgcggtggattgataggtgctgtccatagcatccagtgaggaagcggcggtatcgcctagcgaggcatagctgtcgtcgagcacgtactcgtacaccaaggtgtcaccgtcgacacggtagttgaaggtgatgccggtgtctgcaaacgtatccgcttcggattcaatggagtccttgaattccaaagagtcgacgaaatcctgaatcgaatcgtacagcccataatcgccgtcggttagatcgtcatgggtttcgcccaacgtgtcgtccagcgcatcgtcaagattatcttgagctttgctcttatcgctgctatcaccgttgcccgaagaggactgactatagaaggaatcggttttcgcctcatctatagccttgctggcatacgaggcaccgccgacgatcagcgcgatgaccagtattacctgtatcaccatgcccgccgcactgatgatgatgccggcgatggccaagcccttgcccttgccgccctgtttcttaatctggttgaggcccacgatgctcaggatcagaccgaggagtgagacaaggaacgagcagataaaaccggcaatagccaggccgttgtacttctggttcgcttcaggcggcacactgccgtaagaaccagaccatcccggctggccgttcggttggccgccttgcatatacgggttatagggcgtttgcggaggcacggccccgccgcccggatataccggagcactgacgctgccgtagaccggaggaaccgatccgcctgccggagccgcccccggatagggcgaattgggtgctgccggtgcgggcgcgggcgcagcggcaggagtcactggtggcaaagcctgcgtaggcggtaccggctgattggccggcgcaaaaggctgggtgggctgctcggcaggtgtaaacgcctgcgtaggctgttcaacaggagtgaacgcttgagtgggctgctcgcccgctgcgattgcttgggttggagcattgttggcggcggttcccgtttccgccgtcatcgcatttaacggctcagtcggattggcgtcagcctgctgccacggcacctggccgttcggattgacattcggatcagtcatgacatgcactccttcaactgcatcgcaccccacttgcgagatgcgcccctcgtcttacgcgccacattgtgcgttacagacaactgtactcctcgtggcgagccttaagtaccccaggaaatttggcttccaaaaacacaaaagcctgaaaccggctattgcctcagcaatattcagtcggtttcaggctaaatcgttaatcctctgacgaaacgacgatctacttcttcagcagcggtgcgacttgctcctcgtaagcggtcagggcggtgtcgatcacgttgtgcatgtcatagtacttgtacgtgcccaggcgaccgccgaacacggtgttcggctcggccttggccttggcctcgtactgggcgtacagtgccttgtccgcatccgtgttgaccgggtagtacggctcgtcgccgcgttcggcgaaacggctgtattcctcccacaccacggtcttgttcgggttctgggcatcgtggcgttccgggttgaagttcttgaattcgatggcacgggtgtagggtacgtccgcgtcggagaagttcatcaccgggcagccgaagtggtcgccctcgtcgtagcggacctccttgaagtcgaccgtgcgccacttgaggtcgcccagctcgtagtcgaagtaacggtccaccgggcccgtgtacacgacgggcacgcccgcggccttgagcgcggtcttgttgtacggctgggactcgtcgaagaagtccacgccgagctccacggtgatgcgcgggtcgtcgatcatgcgctccatccactcggtgtagccgtcggcgggcaggccctcccatgtgtccttgaagtagcggttgtcgtagttgaagcgcacgggcaggcgcttgatgatgtcggccggcagctcggacgggtcggtctgccactgcttgccggtgtagttcttgatgaacgcctcatacagggggcggccgatgagctggatgcccttgtcgttcaggttggccggatcggtgccggccagctcgcccgcctgcccggcgataagcttctgcgcctcggccggcgtgtaatgcgcatggaagaactggttgatggtgcccaggttgatcggcagcggatagacctcgccgtcatgcgtggcatacacgcggtgcacatagttcgtgaagctcgtgaaacgattgacgtagtcccacacacgcttattggacgtgtggaacaggtgcgcgccatacttgtggatctccgcgccggtctcctcatcaaagtacgagtacgcgttgccgccgatgtggtcacggatatcgatgatgcgcacgcgcgcgccggtgtgctccaccgcctgctgcgccaccgtcaggccaaacaggcccgcgccgacaatgactaggtctgggtattgagtagtttccggcatgcgcgcattccctttcataaagtcaatatatcaattattatgttcgatttccgagaaaatatcttactcacccaattgcaaatcggcaatcttcctagactgaccagaaaactggacacaatccaagaccagacgacagactcaaggcaatgaatggcatgttcttacatttctgcgtctttgcccggacccgttcgccgccacaaagacagagcgcagaacaacgcaaccaccaatataagcccccgcactcaggcaaacctcaggttacgattggtagatatgagcaattccgaacaggccctcgactcaaccaacgaagcagtcaacaaagcatccaacgaagcaaccaacccatcattcgcgccgcaacacattctggtcaccggtggcgcagggttcatcggcgcaaacttcgtgcactgggtggcgcgcaaccatccgcaggcccacatgactgttctggatgcgctcacgtatgccggcaaacgcgagaatctcgatggcgtgccggccgcgaacctgacctttgtgcatggcaatatttgcgatgccgagcttgtggaatccctgttttctgggctgaaccaacgctctgcagccgcagtacccccgattgacgccattgtgcacttcgccgccgaatcgcataacgataattcgattctcgacgcctccccattcctcaatacgaacgtgaccggcacgtacgtgttgctcgaggccgcccgccgccacgatattcgattccaccacatcagcaccgacgaagtgtatggcgatctggctctggacgaacagcgcaaattcaccgagctcagcccttacaaaccgtccagcccatattcggcgtccaaagccgccagcgaccacttggtgcgcgcctggcaccgcacgcacggactcaaaaccaccatcagcaattgcagcaataactacggcccctatcagcacgtggagaagttcattccccgccagatcacgaacattcttgccggcattcgcccgaaactctacgggcaaggtctggctgtgcgcgactggatcagcgtggaagatcactgcagtgccatctggactattctcacccgaggccgcatcggggaaacctacctcgtgggagccaatggcgaatacaacaacattgatgtgctgcacatgattctgaagctcatgggtcgtgacgccaatgacttcgaccatgtgaacgaccgccccggtggcgataagcgctatgccatcgacgccaccaaacttcagaccgagctcggctgggtgccaaagtacaccgatttcaaggaaggtctggccgcgaccatcgactggtaccgtgcgcacgaaagctggtggatgccggataaggccgggactgaggaaaagtaccggaagcagggtcattgataggccgttgacaggccgccgataggtcactgacagcgcaatcaatgaataccgattgcgagatttggtggcgaaaatatatcttatgttgtacaataatcatatatttcaattataaattgattattatgacttttaaagaacggtaatgcgatgattcgtttacaaagacttgttctagacaacatgaggaacatatcgcacggcgtcttggattttgacgatctgcccgctggcggcagcgtaacgggtatctatggacagaatggatcaggcaagaccaccgttatcgatgccatcgggatactgcgcgcgctgctatccgggaatatgctgccggacaccgccggcgatgccattagcgtcagcaccggtcttgcaaccttgacggcgacgctcctcatcggaggaaaacagaagcccagctaccttgaatacaaggtgtccctgcgtagagcgaacccggattcgacgcgagcgcgcgtcgtttccgagtcggttcgcatcggcgacgatctctcacgcctaggcagggaggcgttggggcatcggatggaggattctgagaccgatggtttcgtgtcaactccggtatatgtgtggcgctccatcgaggcggtcacctcggtgaaaaccgtggtctcacgcaccgctgatcgtgcgtacatggaggggcgctcattcctgttctcgcggtgtgccgcgcttgaagaccgacccgatgccgagttcctcatcgactgggtggtctcccgcgtgcgggaagcgaatggtgtgtccgccagatcactgacatacatcaacgaacgtttcgatgagttcgtacgcctacgcaagaccttatgcgattacgcgaccaatgatgtcttcgtatccactacccgtcgtggctcctatgccgcatatgcgttcatccccatcatggaggaggattccgcaggtcgcaacacagagtttctgttcgacctgttgcaaccgaacccgctgaccccgggccaggcgaaacgacttggacagaccgtggagtccttcgaccgcatcctgcccaccctcgtgcctggtctgcatgtcctgctgaagatcggaaccgcgccttccggcaaagatggcgaggaccgggtcaccgcggagctgttctcgcgtcgtggcgatatcacggtcccattccgctgtgagagcgaaggcatcatacgcatcaccgcgctgcttggctatctcaagcacgcgtataacgacgagaacgcgctggttgccgtggatgagttcgactccggcgtgttcgagttgctgctcggtgacatgctgtaccagttggcggacgggtgcgcagggcagctggtgttcaccgcccataacctgcgtgcgttggaagtgctgccgaacggctgcattcgcactacagtgaccgatcccaataaccggttcgcgatcatcccccgcaagtcctccacgaacaaccagcgccgacggtacctgacggccagcgagctcggctggagcggccccgacatctatgattcgcccataccacgcatgttcggcaacagtctctatgccgccggccatcccgatgaggacgatgacatcgacgacgatctggcagcactcaacacctccggaacgaaggtgaaccgtggctaaacgcaagatcgtcctgctggtcgtagaaggagcaagcgacgccagcctgctcgtgccggcattctcgtcgttaatcgagaaccgcctattccaagggcaggaattccactgcgacgtgttgactgcgccaaaccaccgtgaggagttccggcgtcgtaacgggttctatccagcggacaatcctgtccagacggtgcgcgaactcgtggagtactacctcagagaccacgaccgcacctggggccagctcggccatgtcatccagatctgcgacctagacggggcgttcacatctgacgatcgagtgcgggaagacccattggtggatggaacgcaatattcaacgaccgacatcatcacgccaaaccgcactatcctgattgcggatcgcacgaccaagcgaaacggcgtggatgccttgctgaaactcgatgggttcaggaagaagaacggccgcgccacgctcatggtcccgtaccgcctgttctacgtcagccgcaacctcgaacacgcatttcgcggtaggattgacaatctagacgcacagcacaagcagagcagcgccatcaaactagcagaccgctttacccgcaacccgaacctgttctctacaacccttcaatctcttcggcgaatacacggcaatccgacaacgtgggaggaatcttggcaatatgccatgcaagacctccactcactcgaacgcggtagcaacctcgcattcgtggagccatacttggcaggcgaactgcggtaaatccatcagaatagtttcagaaccatagctggtccgagcccagctagacaccaaagttggaaaacgtagcccagtgcaccttattctggttataaaacgtaagaacagggctcaaatttggttggaaaacgtaaattatggcgctattgctgttttcgtgggtggggtttctccgttgagttgttgagggagtaagagaagagcgctttccgggtaggatgttttcgaccaagataaacaaacaaccgcaaagcgcctgatgaacagcatattcaaccaacttctcaacgtccccgggttctaggtaaaagtgcaacgcctgtctatggttggaagtgttcaagtccacaaccgaagagaaagcgttgcactcgatatgaaagcctattcccacctgtcggcacaggaacgcatccggatcgacgagctgaggaaccgcgaggggctcggcgtgtgccagatcgcgttgaggatcggccgcgacaagtccaccgtcagccgcgagccgggacgcggcccgtggttcgcgtccgacgagaacgagtcctaccggccctacaggccgaaacggctgaaggctgtatttcgtcaaattgaggtggacgtgttcggcacttaatccgaacaccgtcggcgttcaacttgaacaccgacggcggttggttccttgttttgttgtttgtctggtttatttcatgagggagtgtctgttccggtaggattcgccgtggaagcggaggatactgccgtggtggacgatgcggtcgatgaccgcggcggccatgtccccgtcgccgaacacgtcgccccatctgccggactcgaggttcgaggtgaagatgacgctgcgggtctcgtagctgtccgcgatgacctggaacagaagcctggccccgtcgatgtcgatgggcaggtagccgagctcgtcgatgatgaccagcccggccctgcctatcgacttgagctcggcgtccaatctgttgtcgtccttggccttcctcaagcgcatgaccaggctggaggcggtgaagaacctcacgggtatcatgcgttggcatgcgagcatgccgatcgcgatggccaggtgggtcttgccgcagccgacgtcgccgtagaacacgaggtcctcggcccggtcgacgaattccaggctttccagctgttcgcggccccggtcggcggggaacgaggccatgccccggtcgtatccctccagggtcttgctctgggggaacccggcctgtttgagcagccgccgccgtttggattcggcccggctcgcgttctccttctcgaacaggttggccaggaagccgagctggccgggcgtggcgtccgccagggccttctcgagcacgctgtgtgtcaacggcaggttgcgggcgaggcccatgacctgttccggcgtggccttgtcaagaacgcggccgccgcgctgccgcggtttttgctggctcattcggcctccttcatgtatttgtcgtaacgcttcaaatcctgcccgccttcggttcccgcaccctcgaggatgcgtttggcacatgtgccgatcgccgcgcggtcgacggtccgtcccgcgttgatgacggtttccaccgctttgaccgtggcggcgaacccgcagtcggcggcaacggctcggatgtcgtcgagcagattggagcgcgtgcgtgcgtccatgcggtcgagcagggctcgcacggtttcggggaaatcgttcctgatcgggctttcgccccatatgcggggctttcgcgcgatgatcgcgagcaggctcgccggatccacctgggttttcgccgaatggccccaaatcctctccggcgtggtgatcgtttcgccgccggggccccgcggttcgatctcgaagacgcgcaccccggcctgcaggcgcatggaacgccatttcggtccggccggataccggttcgcgtcgatcgcggcggcgccggtcttgtcggttttcacgctcctccagtcgcacgggtcgaaccgcacgccaggcaatggaagcatgtggtccttctccgcctcgaacagttcgatcaccggaacatcatgccggcagtggtccgatccggcgacgcgtccgcactcgtcaagccacacgcgcgtcagcgtttggaagctctcggccgacggcatcggcaccatcaggttgcgcctgacgaagccgacggcgttctccacactgcccttcccgtggccggaatacgggtcgcggaaccgcggcccgaacccgtaatgcgcgcggaacagggagaacaagcgggtccgggcggccgtgccgtccggcctgcgatggcccacaccggtggcgttgtcgaacaccaccaccctaggcgccatgcccatgcgctcgaagatccacagcaaaccctggcacacgcactccgaggtctcgccgggaagggcgaccacccagcgcatgttcgaatacgggaacgacaccaccaggaaatgcaccacgcgttcgactccggcgaccacggccctggcctggccgaaatcgacctgcgcgcttcccggcgcccactccaactcggcgaagccgtccgactccacgcgatgctcccgcctccaacgcttgacccagcgccgcaccgacgaatacgagcccgtgaacccgcactccgccacgagccgctcgtacacgcgcgtcgcggtgtggcgctgcttgacgggcatgcgcagatccgcggccggccacccgtccacgacggccgaataccccgcgtcgaccagcgacctgcccgcatgccccgagccaaggggcttgggagagcaatccccgtggttggcgtacttgaccacggtcgtgcgcgatacgccgagtttccgcgatatctccctgtggctcaagccctggcggtcgagctgcctgatacgccgtcggacacacaccggtgtcgtcatttcctttcctcccgagaaccatcagtttggttgacaggcactcgggaatccatcaaggaaccggacgatgccggtgttctcattccaccggcgccatcaccgccgataccgtccaaattgaacgctcagagtgttcaggaacaagtgccgacagtgaacacctttattcgatcacacacacgtgtcgccctcccccacccaagaagcatccctcatcggcgcggcatcggtgtcgggacaacaaaaaaactccttccttgtgcaaggaaggagccaatgggggaaacggctatctgcgtctcaacatggcgaaactgttggactcgacgatgaacgccttgcggtcgttcttggccatgacgtcaaggacgacacccgtcacgaacagcagcagcccggcgatgacaagcatgaccgctccgatcagcgtggggaatcgggccaccatgccggtgttccagaagtccaccgtcaccgtgccgcacagcacgacgccaaggacgccgaggacacagccgatgccgccgaagaacgggagcggcttgtattcgcggatcatgcggaaaatggtgcccatcaccttgatgccgtcgcccacggtgtcaagcttgctgacggatccggcaggacggtcgcggtactgaattggcatctcgaacagacgcaggttgttgttcaacgagtggatggtcatttcggtttcgacctcgaagccgcgcgacaacacggggtaggttttgacgaaggtgaatgagaaggcacggtagccggtcatgatgtcggtgacgttcgcatggaacaggccgttgatcgaaccgcgcaccagacggttaccgaagttgtggaacgggcgcttgttctcttggaagtaggtggagctcaagcggtcgccgattaccatgtcgtatccttcggcgatcttctcgaccatggcgggtgccgcgtcggctgggtaggtgtcatcgccgtcggccatgacgtacacatcggcgtcgatgtcttcgaacatggctcggatcacgttgcctttgccttggcgtggctccttgcggacgatggccccttccgccgccgcgatctcggcggtgcggtcggaggagttgttgtcgtacacgtagatgtccgcctgcggcagcgcgattttaaaatcacgcacgaccttgccgatggtgacttcttcgttgtagcaaggaagaagtaccgcaacggaaacgttcgaattctcaggcatgcactccactatatctcttgtactggtctgcatggggaatggattataggtgatgctgcatacttgaagcaaatggatttatcgattcacattaattatcacgagtgtagcgtgacgaagtgttcgtcttgaatgccgaatcgcttttgaaataatcgttatagttgatctccatgttcgattggccagcggctataaaaagttcgcccacgcatgcatcatgtactgttttcatcacagtggtagctatggcaaattccatggtgtattgggcaagtgaccctttgattctaggcaacttgattgaattttttcctgctttatcgattgttgaagaactggcgtacttatgttttccttctcgtaaagtaacggaaatcgttttccccgatgaggatttctgagctgagccgcttaaggtggtggttttgttctgttgcagaaccatgctgtccattacatagctcggtaaaggaagggtggcgtttccgttttcttgtggtgttttcttgtggtgttttcttgctttcctgagcgtacgcaggaaaacagaatgaatgacagtgtcaatgagaaagttcttctaaacatctgaacaaatcatgaaggtggaacagcgctatggcgcgagtatagcggtttccaaacttgtttttcatgtctcggacttccgattcgtagataaagatgctgtgttctccagattagatatgagagcggacgcctgcggatgagtttccgcttctgtcggagatactttagcgttgatatgctaagggcgtgcaagttggagaaggaaaggacgatcagtgacggcaagacaaacagatatgtggcaaggctctgtcgacaggcgggaaagcagatgtcacggtactcactatgtatttgtggacgtgctgaacattgtttcctgctttgccgtggtatgtctgcatacgtctttaggtgtgttctctctgcaacatacttttctatgggcattccaagagctcatgcaggcgatgtttattttcgccgtgcctattttcttcatggtcagcggaatgaatcttttggactaccggaagaaatattctacgaaagtgtttttcaaaaaacgattcgtacgagtgggacgtgcgttgattctgggcagcatcgcttgctatttattgttcggtttgctccccggcctgttttatggagcgcaatcaatcgccgatggtttcggtcctgtcgatttttgcaagagattcctcaccaactccatcatcgatatttattggttcctgtattccatcatttatttgtacttattgactccattgctttcaaaaatcgtccatgaccgtcgtttgttggaatatgccattgcgctgacgttgttctgttcaatcctgattcctgcagcaaaagccattggaattaacgagaaatatttcagcccattgttgagctggccgctatttgcttccagtgccctgctgtatttcctgctgggatattatttagaaaactacggcttgccgttgcattggaatgcgcctgcatgggccgcaactttcctcggatctgtgacgttgatgttcctcggcggtttatgttggaacggtttcttccagaattcgatgggagtggaataccagaattatcttgtcggcatttcctctccgttatgtgtgatatccgcggtatcactgttcatgctctgcaaagcgctggagccatcccttcagcgtggatctgacagaatgaagtcgataattcgcaaagtgtccagcgtctcgctcggtgtatatatgttccacctactgctggtgaaccttacgcttggtgggcctttcgagcgcatcctgacgtttgggcaataccacccattcattaaggccattgcggtctatctgcttactggcattgccgtatatgccggcaagtggtgcatctcaaaggtgaaacgagccctactatcgaagtgagtcagcgtaggactcgcgtccggagagacgatttaggattcttcaggcttaaatgcttcagcgtaagtgatagaaacagtggaatgatatacagcataggcaacacatagcgtgttgcctccgtgtgcgtggaaatcggtccagcaaatagaacaagcattgtgatgaacattggcagattaagcatcaacagattaagtttgttcttcttggatctcagtatgagaaacatgatggcacaaggaagtattgtagcccaaaaggctttttgccatatgatattgaatataggcgtcgctgataatgtgtctgcgtagaatcgtccaatcgcattaccagctttggtgttatctgtccaaggaatatattgttcgatgttttgataatgatgtttggaattgttgattggaagcatcatgctgagatctcgttcttctcctgatgcgacattgaatgagaaccatgcgacggagagtccaccccatcctgctatcatgtcgccgggatgtttaaccagctgtttcatccatgtcgtgattaaggcatggacatctttagaagataattcctgtccttttatcggatcagctttataccaacagtaagcaccttggagttgatcaatatccatatggtaagtttgttggattttgtcgatttcggctgcgctcaaatcatccttatggtcatgcaccacattggcgacttgttgcatgggcacagcaagaatctcgttactttcccctggggcaatgtgcaatgctggcaaaataaaagtcggcacgattataccaacaaccaaataaggaacgctacctaaaacaatagtagctattttacaggaccaatgtttgacaacgaagcatgccaaaagaagcagagccagaacaatgatatacatgcctgttttttttgttaaggatacggccaatacatctaagataaagaaaacattaaatgaaacggattttaaaatttccccctgtgttctccaaagttcacagaatgcgatagagaagaatacgaaaaatggcgtattgaaagtatctttcgcaagagacatcgacatcatggggatgatggggaaaagggtaagaaatgcagcgataaagaaacggcatttccaaggtgtattgtatttgcctgtatagcagactgtacaagcgatggccaatgtggacagtagcgactgcacgagcactagcaggtacaatccatagatagcgttattgaacaatgctttgccaatatgtgcgaatccgacatacaaatacgtcatcatgaagggatgatgatcggtgaacggcactgaagggtcataatattccatcagctgccaggaagtatcgtaccagtagacgcccgggaaataagctacaaaatacggaatccagaatgccgttacgagacaccataacgtgataatggatcgaggagaccagtccattgtgagtttgcggaacgcttcaaacggtttactcagtgattcgttatggtgatttatgcgcggaactatttttgtcgcagcgaaaaacagtaatgtgaacagggcaatataaaagagagtgttcacataaagcagcgcatttcgagtgtcgattttgccctcatgctggccaataaaagaacacatgccgaacaacgtacccagaagaatggggacgagataagcaaagttatgttcggtaattctaaaactttttgtggcctgtttcaatgcgattattcccttcctcgaaccgcgcgaccgatggccttcgccatggcacgacggcgggaacctattggcatgagtggatcgacaatcttgcgaattgggttatcctctccaacggcgcgttcgtgctttggacgaagcgcttcttcagggattttcggttcgttcgccttgaccacgcgcttgagcagacgctcatagaacggggtttcacgtgcgtatttccaatagatggaggcgaaatcgcaatctggatcggtccatggcttttgaaaaccagcgtaatggatgatcttcggattgttacgcgacttcatgtatgcatcgtagatgtcgtttggcgcctgtacgaagaggttgccgacacgtccgccacaatcgtgcaccacgttccattcccatggcagatacagcacgttaccttcgcagtgcgcgttgagcacatcctggtcgttgtagatgaactcgtcattcgatgcgtaagcgagccattgctcgatggtgtaatgctcacgcatcgccttggtattgagcaccagcacgccagcctggaagtaatcgtaggggttctgcatcttcagcacggtcttcgcgtaattcatacgcttaccatgctttacgttcaaattgccaaggaaatcgatatcgcgcactgcgccaagtagcttgccctgcaaatcgatgttgtagagctttgcgatatcaccattgatgatgatatcggaatcaaggtacagcaccttgtcatagaacggcaggagcttttgaatcaggaaacgatagtatgtttccacgctgatatgggcgttgttggtggaaagctcatatccggcaagttcgcggtccacgttggtgaatcgcagattcatgttcgggaactgtttgaagaacccgcgcatacgttcctgcttgtcccaagagatgttgcgctgcagtacggtgacatcgtagaaatagctcggatcagcgttcttcatggctgagtacacggtagtggttagctgcggcacgtaattgtcgtccgctgcgaacaccactggaatgatcggcttatcagtgacgtcaagtggtttgagctgctcggctggttccggattggtgaagtgcacgcactgcagctccttgaatttccaattggatccgatgcgcttgtggtgcatgagatagatattcagcaggcgttcggaaagatgtcccggcgtacgcagtgcttccttgctgtacgtgctataactggtttccttgtcgaattcctcaaggattgggaacatccattcacaataatcgaagaagatttccttcttcatgatgaacatattgcagaagcacgccttgttgccattgaagaaatcctgcgcatcctccttataatcaggatacatggcgcacagaatctgataacagctcttcaaatcgtcatcgtgcagcaggggagaggcctcccacagagcgcgtgggcttccatacttgttgatgatttcgtccagattgccgaacggtgtggtgatgacgtcatactgtttaaccacgcgggcgatgttctcatcgtccagaccgtactccttctcagccttggtgtcgatataatcatccatgatttcgccgaacgcgttttcttcatgcacggtttcggaaaaatcgaaatagcggcgataatggcagaatccgtagtagtcggcatcaacgttcttccaagcccagtattgcgtggtcagttcgcaatagcgtggattgcgatcggagatgttctctccgtcggcatcgctccaataataggggaaacgggtggggttttttgccgatccaacatgaacgggctggaaaatgtcactggaaaaggtcgaaaccagcttatgcgcggaaacgaagattttaacggtctgcttcttttgacgcttatgcaaatcttgggtttccttgaattcctggatatgacgcgatgcggcatctttcatctgagtataggaaaccggtagcacatgaacatcctgggttaattcttctgccagagcggcccaatccagaaaagccgacgttgatggattgagatattcgattgaagcgtatgcgccatctcgcgcaaatctcattaacgcagttgcggtttccacctctccgataatcggggcgacggattttgccgcttcgattttgtcattatcagatactcggtctttccattcattcatcaatgtgaaggtaagtcgttccttcagtcgagtagctgattccttcaccaataccgactctgtggagtcagcaaaatgcttggcttcttcccagcaagacttgatctggctcgccgacatgaggaatttatcaggggagagcatgttgtccgtggtcacgcctcggccgatgttgtacacatatcctcgaatgtcggtattggtcacttccaagttggacatgctggcaagcacaagaaactcatagctgtcttccgctcgttcaagacgtgaacccgtcattgcatcgaaggccttacgacatatgctgcctcggaaggccttatgggtcacatgccagtctcttccatattcatttgttgaaatgaaaacttcggaaagcaattgtttctgattggaggcagacgaatttgcatttgcccaagtctcaaaatcacgagcggcatggctgctcatgccattctgttctttgcaaagcagaccgaagcgcaaaatatcaggcgtatatttttggatttccgactgaattttatcgagtgtcccctccgcgaaagcatcatcggaatccaggaagaggatgtattctcctgtgctcagagcggttccacttttcctggcgagatggagtccctcgttgttctctttatcgagaagacggattctactatcctgtgaagcgaagcgagaggccacgtcgtgagaattgtctgtacttgcatcattgaccacaatggcttcccattgagtgtaatcttgggcgagcaggctgctcagacactctggcaggtattccgcgcagttatagcaaggaatgatgatgctgaaaaaaggattatgaccggacatctattatttctttcttcggatagtggggaaaagagatttgatttgcgataggatacggatgattttcgtagaatgcggcgtctccttcggtacgggaagacgtgtctgcaaatctgcaaagtgtctgagcgcttgttcccggtacttgttgtactgcggagatgaatcgttgccggcgattgtttctgcagtctccttccactgcacgtatcgggattttttatcaaaggcgtctcccgcatcccaatgggaataagcgtcatctcgtgtgagacgcatcaattccgttgcgatctccatgtgagtgaagtttgcctgcatcgcgggaagaacagacaatttatcttcgtcggatagccgtacataccagtcgccaaacagcatctccaacaatcgtcggcggagttccacggcacaaggaagaagatcgaaatcggtgaagccgtttgcgtattcagaagctgtgcttatcagagttccataattcgaagagagcgaaatgaatttctgcttggacattggtttgaaagtggtgatacctcggcctaggtaatagcgatatccgattagctcattatggaaggtttccgtattcgcgaggctggcaataacgagccattcgtagctatcctgtcctctgccgagacgagagctggacatacggctgaaagcttctttgagaagttcggtccgatacagacgttgcaggatacgccagtcttgacggtgatcttcggaatcggtgaaagaagagaaggcgatttccggaccatgcagtgtgggtaaatctcgattgctgagccgaagaatatcggagcatgctgattcaggcatatcctctccgaaaagttcggtaccgaaatggagaacatcgaatgattgttgcgaagcgaacgtccttaaagagggcaatgcgttatttgcgagctcatcatccgcatccaggaaaagggcgtatttcccccgcgcacattccacgccgctttttctcgcgagatgggttccctcattttggcttttgttgatgattatgattcggtcgtcttcttcggacagctgactggcaatatgaaatgcgtcatctggactcgcgtcgatgacgatgattgcttcccaatcctcaaaagattgtttttgcaaagactgaatgcactttcgaagataaccaccattgttgtaggaagggatgatgattgagaaaaaaggactcgaagaattttctgccgattgtttattcgtcattttcttctccatgctgtgctggtatgggcgtggaaggcaacaattacattccacgccccatagattaagaatgcaatggataatttcagccgactacgccttcgcatttgatcgaaagaacatcgttgttgagcagtgcgtaatctccattcctggaatcgcgaatcgcgaagatgcaggcgtcatctccattcgcgaaggcgatggctttaggcttcttcggattgtcgggatcatcgacacgcaatgacgccacaatctggaaatcaccattgttgaagatgttgacaggcagcgcgaatcgtaccttgtggtggcctggattatggaacttatacagattggggccagggtcgaaggtcatacctcctcgtttcttatcaatcaaggtcatggtgaaatagaaatcgacatcctgatcaaagaagtactcgatgtcgaattcgaaaacatcatctttgccgcaaaccggcttggaggccgcaagaaccttaagccatgcttcattatcttgcttttcggccttatcggtatccggggaatcagtctgcttgagattttcaagcgtgtaacggtctgcgacatcgttcttgtcgccgctggcgatgatctcgccgtccttgatgaggatggccttattacagtacttcttcacagcatccatggaatgagtgacaagaatgaccgttttagttgggtctttcttgatttcagcaaagaagttgtcgcatttacgctggaacgcctcatctccaacagcgagcacttcgtcaagcaccaaaatgtcgccttgggctttaatcgctacagagaaagcaagacgaacctgcataccggaggaatagttcttgagcttctggtccatgaagtcctcaagctcagcgaactccacgatgtcatcatacatcgcgtcaatctgcgtacgagtgaatccaagcagagcgccgttcaagtacacattctcacggccggtcagttccgggttgaagccgacgccaagttcgatgaatggcaccagtttgcccttgacagtgaccgagccttgctccggggtatagatctgggagatgatcttcagtaatgtggacttgccggaaccgttacggccaacaataccgaaaaagtcgccttggcgtacttcgaaattgatgtcgcggagcacatgctgctcggtgtagcctttgatgcccttcgtccagtttaagaacgccatcttcaggccggtcgcctgctcagtgggcagacggaacattttggccacatggtcgaccttgagcactaccgggcgctcgtccttggcttcttcctgtgtcttttcagtcaatgcaatttcagccatgatcagagcacctccgcgaacttggagctgtatttacggaacacatgaatgcccagccacagaatgaacgcggacagcacgtacggcagaaggcatagcagtttgttatcgaccatgctccacacggtcggcacatattctggggaaagcaggttatggcgaatatccatgattacctgagtggaaggattcagcataagcaatttagccgcccaagagaaatctgggttgttagccaccatcgaaatcggatagatgataggtgtggcatagaacatggcttgcagcacgacttcccaaatatgcgccacatcacggaagtatacgaacagcgaggcgagcagcaatgccacgcccagccctagacagtacaactggattatgctgaacggtacgagcagcacgcgccaagtgtagtgtgcatgggcgaagaaaccgaacaaaatcaccacgcacaagttaatacctaatgaaatcatggaacccatcgtggtggaggccacgatgatgtaattcgggaaatgcactttgcgtagcaaatcaccgcgtcccacgatggattgcatgcccatgctggtggactcggagaagaagctccacaaacaggtaccgcacagcagcgaaatcgggaaggtcggggtgccgtcggagaacttcaggaatttcacgaacaccacgtacatcaccgcgaacagcatcaacggcttcaatacggaccacaccatacctaggaacgaaccttggtagcgcagctggaaatcggtcttcaccagttccttgaacaccaccatcgcgtagtggtacctcttcttgaggctctcaaaaaagtctttcacaagcattccatcctactagtgcgaagcgtttggacgcaaaatcatgtggcagtgcggttgatgcgctctccttcgacagtactctcatatattctagtgaggaaaggacgtttgtcttagtaaggcggaatatctcacatggttctcacagcggaacagcaccattcgaacatccgaatcttcgtgtcggcacataagcaggccacgtttcccaagggggagagcattcttccgatgcaggtaggcgccgctcacgccacaacccgtttcccgaacaccttgcatgacgatgaaggcgagaacatctctgccgaaaatccgcggtattgcgagctgaccgcgcaatactgggcttggaagaacgaagatgccgattattacggtttctgccactatcgtagatatttcgatttcacggataccccacataaggaaaacgattacggcgaaatcattgactcatatattgacagtcgcacgattgccgaatatggcatcaacgacaaggcgatcgcacatgcagtggacggatgggacatcatcaccacaccattgaacgatgttcgtcgtatcggcggattttcaaaccttaaacagcattgggacgccgacgaacatctgcggctgaatgacttacgccatatgtacgacattctgtgcgagcggcatcccgattacaagatggatgccgatgccgtactcaacggccgcaccgcagcattctgcaatatgttcatcatgaggaaagaaatcttcttcgaatacaacgagtggctattcccattgctggacgaattcgcaatgaccaccgacttcagcaagatggacatgcaggccacgcgcaccgtcggccatctctccgaacggcttttgaacatctttatcgcacacaagcagcgcaccggcgcagactggaaaatcaaacgactgcaatgcgtgcattttctgcatccagagccgaacgcgatactggaaccggtagggcaggagcgtggacgtgtggtgccggtggtgttcgccgcggacaacaattacgtcccgatgctcaccaccaccatctattcaatgctgaagaacgcttccacgaatcgtatgtatgacgtgatcgtactagaacgaaacataaccgacgagaacaagcgctacatgcggcagttctttgcaaggttctcaaatgccctgattcgtttcttcgacgtgaaccgctatctcgccggattcaatctcactaccagcaatgcgcacatcagcattgaaacatattatcgtttcatcattcaagaagcattgccattctactcgaagctgctgtatctggattgtgacctggtggtcaatggcgatatcaccgaactattcgataccaaactcggaagcaacgctatcgctgcagtaccagatattgatttcattggaaatctcaacatgaagaacggtgagcgtgctgaatacgttcataagcagttgcacatgcgtgacgcatatggctacttccaagccggtgtattggtaatgaatctcgaccgcatgcgcaagattcacacagtgcacgaatggttagaaatcgcttccagaccgggatacatatacaatgatcaagacattcttaacgtagagtgtgaaggtcttgtcacatatttggattattcgtggaacgtgatgcacaattgtgcaggccgcattgctggagtgttcgatttcgcacctgcctccatgtacaaggcgtatatgcaatcacgtaatatgccaaaaattgtacactacgcgggctttgataaaccatgggaaaatccatggtgcgatttcgcaccgctgtactggagctatgcgtgtgaaacgccattcgcggcacaaatggttgccacaatgagcggcgtggaacgccctgccccaccagaacaccacgaacgcgcaattgccgaagacagccctatgcgcaagtatgcggacgtgctggctccggtcggctccaaacaacgagaactgctgaaagtgatagcgcgcaaggcgcagggcaaacggtgagacagacagacagataagtcaccggttgttgacggaggcttcgtgtcctcgtcaacaaccgaccatggtttcacagggaagaattagtccctgcgaaacagatcgcgggtgtagaccttgtcgctcacgtccagcaaatcgtcattccaacggttggctacgatggcagacgagcgggtcttgaaatcagcgagatcatgggtaacctcactgccatggaaattagattcgcgcaatgtgggctcgtagatgagtacagggatgccgttcgctttgaactgcttcataacgtcttggatggcggactgacggaaattatcggaaccggacttcatggtcaatcggtagataccgatgatagggttctgaacattcctgacaagttccatcacctcagaggctacgaattccttgcgggtacgatttgcgtctacaatggcctcgatgaggttctgcggaacctgactgtaattggctaacagctgtttggtatccttcggtaggcagtatccgccatagccgaagctggggttattatagccgtcaccgatgcggggatcgaggcaaacaccatcgatgattgcacgcgtgttgagtccacggctttccgcataagtatccagttcattgaaatacgccacacgtaacgctagatatgtgttggcaaatagtttgatggcctcagcctcggtgacgcccaccaccaatgtgggaattccggtgctgccatcatgattaacgcgagacgtctcagcggaatcagcgccttcaacgagcagggacgcgaatcgacgtgccgcttcgacagactcagtatcattctgcggggcgccgacgacgatgcggcttggatgcagattgtcgtataacgcgtgtccttcacgtaaaaattcgggggaaaagagaatacgatcatccggaaggttcttacgtaactgttgcgtatatccaaccggtatggtggatttgatgacaatccaagcattcggcgcatatcgtctgaccgatgtaatcgccgcttcgacactggacgtatcgaagtaatttttcttttcgtcatagtttgtcggcgtggcgatcaccgcgaaatcagcatctctatatgcctcctgcggatctagcgtggcatgaaagtcaagtattctttcgccaagagtgcttttttccaagaaatcagtaattacagaatcgacaataggacttttcccattgtttaactgctcgactttctcgggaatgatgtcgagtgcatgaacttcattgtgctgagcgagcagcaaagcgacagacaatccaacgtagccagtccctgcaaccgcaatcttcatagtgtcagcctttccttacgcaatcctaagatattgtagacgcaggtcactgcaacgaatcaacgtagccagcatcttccaaatcgcacatgccgacgttcatcctgtacgggcgaaccggtaaccaatgcacatttcttgatgggtcttgcagaacgacgagcgaatacggctaaggagcatcccgaaaacgtaattatcgcgtcattcgtgaaaatcaaaacacgtcagcttccaaggacagaagaggcacgaaaagctcgcacggacgcaagatggcgtccgcacccggacccgaacccccagccgttggcatgcgacggtatgctggaatggtgaacagcatggcgtgcggcggcgtattcgagccgcgtaatatcctggtgaccggcggatgcggcttcactggcgcgaacttcgtgcgatacgtggcgcggaaccatccgcacgtgcacatcaccgtgctcgacaagctgacgtacgccggcaatccggagaacatcgccggcctgccaccgtcgcaggtcgatcttgtcgtaggggacatctgcgacgtcgcgctgttggagcgtatcgtgcccggtcacgacgccatcatccacttcgccgaggaatcgcacaaagataattccatcgccaattcggaaccgttcatccgcacgaacgtggaaggcacgatgcggctgttggaggccgcccggaaacacgacgtgcgcttccaccacatcagcaccggcgagaacgtgcgggacaggcccgggcacgacaggcgatacgcgatcgacgcatccaaactgcgcgccgaactgggctggtcgccgatgcacaccgacttcgccggcggactgcgcaacgtcatcgattggtatgcggaacaccgcgattggtgggtgccggccaaggaggccaccgaggcccgctaccgcgcgcaagggcagtgaaacgacggctgctacaggcggcccttccgcggcagagcgacgttgcgcagcagacgctgcacgggcttaagcaccacggtatcggcaatcaccgcaaatagcagcgccgccagcaacgtagcgccaaacatcagcacgctgatacccgcatacgaccatccgtccgtaggcacgggaatcctcgggccaatcagcaccttggacagtggcgagtgcaccaaataaatcgtgtaggaatatccagccagccagataatcgccttacgcacccgcgccgacgtaatgtgcacgtcgtaccggaagaacaggaacgtcgccattaccaccatcgcgaacgcaaccgtgaccgtgcgaccaacctgcatctgctggccggcgaacagatatggcgtggcgactgtccaggccagggcgaatggtgccaacgcatacacgccgcgccgtatacgcgcggacggcggatagtattccaacacgaatcccaacaggtagtagatcagcagtccacgccaagggaatgactgcaggaacgtcaacggatatccgacaagatcgcatatatgctcggcagcggctacggctgcggccagcccgaccagcaaccaggctcccgatcggcctatcgtacgcatcatcgcggccaggaacggcgttgccagcacaaacccggcaagcatgaacacgaaccaatagacggaatcgtcatacccggagaacagatcgaacaacgttccagacacagcgccgccaaccgaacgatgatcaatcaccaggtaggcaacgaatcccatgccacccgcatacagcagatacggcacaatcagcgagacaaagcgtttgtagtagtagcgcgcgtacggcgcgaggctaccgggatcggcttggcccgcaccgccgcctgcccgggcatcagagccagagcccggcagacggcccgctgagtgggtgctcaccggccggtcggcatcgaatgtcaggttgaaccggcccgataccataatgaacagcggattgcagaccatgaacagcgcgaacagcacggatcgcgtcacttccgcgctgccggcgagggtcatcttgacgggcatgtagttgttgatcacgtggacgccgatgaccagacacatcgccaccacgcgcagcagatcgtagttcacgtcgcgcggcttgccggcgacgccggaaacggaatcgggcatggtcatcacatggatcccgccagggacttcagatcgaccgggcagctgatctggctcttcaacttgtccaaggcgtccaggccggccgagggatcggaggacgcgtccttatgcgcgtcgttcttgccgccgtccgcgccgccgttcgcaccatcggcaccgttcgcaccatcggcgccgttcgtatccgccgtgcactcatcggtcacattaccgttggagcccgtctcgacgccatccgcattcaccaccggcgtggttaccacgttcagtggatgtgtggcatcgctgctgacccgaacggtataagcaatcgtcaattcttttccgggctcgatccactgctggttgaacataatgtactgacggtcatacaggctcgcggtgttggtaccccatgaatctatatcagcctgcacagcggtgatctcgccaccgtacggagcggtaagcaccacgcggtacaacatgccgccgagcactggattctccgagccgccattaacgaaatcaggcaacgattcggccttagccttagtcagcgtgttcttcatggtgaaggtgaccgtgtattcgtcaccgagctgatcttccgtaaactgacccagatgcgtgttacgcacggctgtcgtgatgcgcttatccagcacgccagaatacagggcgttctggctggctgaggcgtcgccgcaggtttttgtgaccgtggtggaggtcttcagataccaatcctgcttgccttgctgcagctccgaaagatagatgccggcttcgggcacctgactgtcagcagacaactcgccactggccttatcgtcgataagtccggtggcaatcagcgcctcctgctcatccggatcagccatccatagcttgaaatgaccgctagcgctggtatctctaattgccttcaacagcggggatgcggtagaggcattcgcgttgccaagcacatggttcataattgcttgagccgcttcggaaacgaagttgttctgctgctcgaagtccgggtaatccgtgtacaggtctgaagcgaagaacggcaccgtggtggtgctatccagcactcggccgtccgaaagcttgacctcgcctgtggctcccagcaatgcctggagaaatacgggatcgagtgacaatacacccgctacgttctcgtcttcgttgcctttctgatacagccacatgtatttgttcatctgtgccacacgctggaattcggggtcgatggtcgtggtggccgggtactggtcaaaagtgccaccaaatacctggcgctccttcagcaccgtatcatccattggctcctcaggaatgtcccaaccagaagtggtggcgaaatcaccgatggtaatcgtgcccttatctgccgtgattgcggcgatggtgcctaccatgccgcccgccgaacgtagctcggccgggttctgcaccatcaccaaatacgtgcgcttgccgtcctcgccaagcagttgcggtagcaagttaatgaggccatcgtattcgccgagcatcgaatccacggtcttgagcgcagccttttcggtttcgagcacggtggccaccttggcgacgctcggagtcggcaccttgttgagcttggtgagctgctgcgagatatccttatgcgcctgcttgacgatatccggcatatccatcagggcgctgacgtccaccgagccattcttcagggagaagccctgcaatcgtttggacaggttcagcagatcagtgaacggaccgttgaccagcgtatccacggaagccagcatttcgcgggcggcggtgatgtcgcttccgaatcgcgaatggtcgcggaagaagtcccactgtgggccgttcagctccgcattgagatcattggtggcattgaccagctcttgggagatgtccgacagactcttatcgctgccacagccaagtgccgaattggccagactttcggcggatgtcagcacacgctgcgcatccgcggccattctcgagacggatgccgcgtagagcgtgcccacacaggtgacgctggccagcaacgtcagcagcagtacaaccaccactcgcgcccatatcggtgtacggctgaccagcgaacggccgttgccacccacgtgctggggagtcttcaggtttacgggacccgtctgctgatttgcagcgctattcgtagatgcggagcgattggatttcccgttaccggcatggcggcttctcctacgccccacagccttatggctcgaatgccctgaagtgaatcgcatacttatcctacccgaaaatctgctcagctcatactcttatccaacggcgcaaggccacgcttccggatgccggactccgggcgaatccggaatcgcagacatgccggagcacacgtgacgccacgcatatctcatgccagtgtaccgatgccaccgaaatagaccgagggtttatcccataccgggtgcaaatcccctcatgaccaccacatcgctgtcagaatgttctcagacttcattgaggggtataacagtattgcgcaagaaaacggtcactaaacgcaacaatagttaaagccgtattgatctgttcggcttaggagaacgggagaggtaattacatgttcgtcctcagcaacgcctggcgggccctgacacgttctaaaggacgtacggccctgaccgcgttcatcaccttggcggtcaccttcggcacagtcgccggactggccatcattcaagaagataccaacgcacacaccaccacgtacgatcagcagaaggccacgttggccattcgcccgactgcggctacgtggaagaaggtctccgctacggactcggcttccaccaagcattacatgacgtggacctcatacaccgaatacgccacgctcgtccagtcggccaccaactcgttgaacttcacggttaccgaaaccgtgccggcccgcgtgagcggtgatttgaaggccctggacggcggatcgctgggctcggcctccgatgatgagaccggcggccagctcatttggcgagccttctggaccgaggatgccgccaaggccagcgacctcggtaccttcgaaatcgtggacggcaaggacctgagctacaacaaccagtcctccaacccgaacaccaccggcgcactggtctctgaagcgtttgcctccgccaacaacctgaaggtgggcgatacgctcaaggtggcggccgcctcggacgcccagaccacggccgagctcaaggtgcgcggcatctacaagtacacatccgaatccgccgtcgccaatccggtgacggccgcccgcaaccgcgagaacgcgatcttcaccaactatcagaccttcgccaaggccggactcgacccacagtccaacgacaagaccgcctccggctgggcgatgccggatctggacgtggtgttcgacaccggtgatcccgctacatacaagtccttggtatccaccctcaagaagtccaagctgcccgccaagggatacgaggtgtcttccccttcgctggaatcctacaacgcttctctggagccgctggatacgctatcctcgcgcgcgaagaccggcaccattgcgttggttgccgtgggcggcgtgctgttgctcatcctcgtgctgtcaggcgtgtggacgcccaagcgtgacgacgagatcggcatggcactggtgtccggcgtcactcgcgggcgtttgggatggcagttcatgctggaagtgttcatcgtcaccctgcccttctacgtaattggtctggtcggaggcgcgttcgccgccaagccgatcggacctgctctggcatccggccatgccatcccggtgacatcggacctgatttggaccatggtctggtatggactgggttcaatcctgatcctggcgattcttgccgccctgcgccttgcgttcttcagcgcgaacaagctgttcgccgccgatggcgactggggcaccgtgagcgagaccaacaagacgaccaccacaaccgacgatgcggaggcacaggcatgagcgacaagaacaacgatcaggaactcgagaagaccactgacgcaacggctgacgaagtgacttctgagactgagacgaacgacgccattgaatccgttccggctgactccgtgcagttcagcgtgaccttcgatgacgttgatgacgaaagcactgttgacgatggtatttacagcgcactggcatctgccgaaaccggagaaaccgacgagaccagtgaggccgaagcagacgccatcgcttcggtcaacgcatccgccgaagtgaccgagcgcaatgccgcccgcgtcaacgaaacactccgactggccaaaaccgatcacaaagacgcattggccgagcatgcggagcctcagggcaaagcggccgaacccaccatgacgctggcctcgcgtatcgatcgcgtgttggtgggcggcggttccgacgacattctgctcaagacctacccgaccttcgccctgaacaaggtgacggtcgccggacccaagggcaaggtcaacatcctcgatggcgcgaatttcttctgctattccggacacgcatacgcgctgctgatcagcgacgaccccgattcgggcatcaccgccgacgccaagcgtcgcgcgctgatgggcgtgatgagcggtttgaccacgccggcgtctggcacggtgatgaacaagagcgccaacattgttgagctcgagcccgtggaactgcgcggccaccgtctgggcatcgtaccgcagctgcacgccgtgcagccgaagatcgacgccgaacaaaacgtgctgtacgccatgaatgcgtccaaccgcaacttcctgaagcccaagccggtaatcgcccgcgaactgctggccaaggtcggcttctctgaggccaccagcggcgtggccgtcggcacattgcctttggtacagcagcgtttggtggccatcgcccgtgcaatcagcaccgaagccgaagtgctgatcctcgacgagccgacacgagggctgaacgcggatgacgaggtgaccgtgttcgccgcgctggccaagctggcgcacaccggtgacccgaagcactgcgttatcgtgctcactgcgtcgcgcgaaatcgccgaagcagccgacacactcttcgaaatctgatgttcagaccatagagccccctgtgattcgtattgccgaatcacaggggtttttcaatgctgcggctcattgccgcgctaatctgaggataaatctgaccgtacgaggcgaaacctgataattatgaccggatatattcccacactggagcagatcgacgaattgcaccgcaaaatcgcgccgtccaaggcggcgtacgagctggtgcacacgcattgcgtgattgtagcgaccatcggctgccagatcgtgcgccggcagaacgcgctgttcacgcgccgctgcacattaccgaaggacgcggaggtaccgcccaccgcaggcgtcaccggcggccatgtgccgccgcgtctgctcgacgagcatttggtactcatcggcggactgctgcatgacatcggcacctaccgcgtgttcaagcatgacggctctgacggcgaaccgctcaaattcagcaagaaacgctacattctgcacggtcttaagggctacgagtatctgctcgacgagggcgtggacgagtccatcgcccagttctgccgcaaccataccggcgtgggacttacgcgcgaggatgtggtgcgccaggagctgccgttgccaccagccgactatgtgccgatgaatctcgagcaggaagtggtgatgtacgccgacaagttccatagcaagtcagtgccgccgaagttcctgcaggtcgaggcgtatacggcccgagccgagcgatttggcggagagaacaaacagcgatggctggatctggtagccaagtatggcgtgccggatattccggcgttggcggagaagtatgggatgcggatgatttgaggctctaggggtctccccccaagtcagcctgtcggctgacagccccctcgtcagagggggcttatgaaggtatttcagatggaacggagacggtaggtgccgttgcggttggagacgatgatcatctggtcgttctccagcacgttccagccttcctgcttgtagccggaagaggagaccacgacaccggcggagtcgccgttgtcgtcgcgcagctcacggtagcgcatcacacggtagtcggcggcctgctcgccacggccgtactcatcgtagatttccacgatgcgcgggctggtcttctcacgaccggcggcacacagggcgatgagctggtcctcggactgaatcatgcagttgtagctggacttcgggtaggcttggcgcagttcgcgcacggcctgggccacggcctcgtcgagcgagaagccgaagccgatgtattccagaatcaccgcgaagaagatggcggagtcggaacggccgccggtggagaggaacacgctgtggttcaccgggtatgagcggttggtgacgatgttgcggccattggcgtccgagatatcgccgttgtggatgaagctcaggccgttcgcatagaacgggtgctggttctccatgatgagcggcagattggaacttgccaagcgcaggtgccagatggcaccgcgagacggttcgtcggccagcgcctcaaacgtgctgtcatgacgggccgcgatggtcgacttgtagattcgggtgccggtttccggggtgggtgcgccaccgtcgcgcacgtgcggtgcttcggcaggatcggaaagctgggctacaccccagccatcattgtggatttcagacagttcacggaaatcctcgacattgtcttgccccaacacagcgttgagactcaggttgaagcctgccgtcgcgtatcccagtaatctgcacatggtatttcaacttaccgaaaccgtgtggcgacgtgcggcgaccgttataggcattctttatagagcgcatcagcgccgctgcaaactggtatgttatcgcttctgtttggcggagcgctgaggcttggcggcgggtttgccgttctcggccttgcccttatcgcccttatcgccctgctcagcgggcgcatcggcggcagcggcctcagcggtcttccgcgcctcggccgatacggcggcatcgagctcctgtaccaatcgcccaagcccggacgtggtgtccatcgggtcagggacggcggccgggtcggccactgcacgagtcggcgtgggcgtcgggatggtcttggccgtatcggtgcgcttcagacgcggtgggcggcgggtggagacgaacagcggctgcacctcgaccaacgggttgtaaggtgccagaccgaaccacttaaccggcgagccggccatgtggcggattgcgtacttggcttgcaacgacagggcaccgcgtgcggaaaccttggattccggcatcagggccttgtgaatcagcacgtaacggatggtgccgatgtccggatcggcgtcgaccttggggtaaatcgacttctgcttaggcagttcgccggttttggacaggtcgtgcatgatctggtggatgtacgccgggatggactgcgaaaccttgaatcccagacggaagcgcacgcggtagatgtagttcgtgccgaagtcctccaccgagtattcacgggtgaacggctcgtcggtggtttccacgctgactgcccaccaagcacgggcgcgcttggggtggtcggcgaagatggagaagaagatgtccgtgtcgagtcgcttggtctccgagtcggaggtcaggtacacgatgttgtccgcaaaatacgggatgcggaaatcactgtgcagcttgtcgagcgcgggtaggaagtcgttgggccgcatgtgacggcgttgcgcacgttcgagcttggtgccctcattccacgtgtacatgacgaacagaatcgcggcggtcagcagcatggtgaaccaaccaccatgcaggaatttggccatagacgcgatgaagaacatggcctgaatcgccaagaacagcacggtgaacacgatggcaccgacccgcttgccggaatgccataggtagacgccgagcaacacggtggtggtgatcatcgtaatggtcaacgccagtccatatgcggcagagatgtgttccgaatccttgaagatggcgagtacggccagtgtggagacgcacagcacgccgttgaccaccggaatgtacagctggccacgcgtgcgggccgggtaccgcacctgcagatgaggcatccaattgaggcgggtggcttcggagaccatggtgaacgcgccggtaatcagggcctgggaagcgatcacgccggccgaaacagacagaatcacggccagataacgtacgttcggagacatcatctggaagaacgggttgagtgactccatcgcagtgtattgcgggttatcgctattggccagcatccacgcaccttggccgaagtagttgagcaccagcgcaaccttgatgaatggccaagtgaagtagatgttgccgcgccccacgtggcccatgtcggagtacagcgcctcggcaccggtggtcgagaggaacacggtgcccataagggcgatgccggcagcattgttcgggctgaacaggaatttgatgccgtacaccgggttcagggcctcgaacacagaccagtcgttagagagattcgtgacgcccacgatggcgaggaagccgaaccagaccagcaccatcgagccgaatactttgccgatgctttcggtgccgcgcgactgcacggagaagagaatcacgatgatcacgacggtgatcatcagggtcaggcttgggttttcgtcgaacaacccttccaatggcggcagggtctgcaagccttcgactgcggaactgatggaaaccgccggggtaagtaccgaatccgcgaggaatgccgcaccgccgagcatggcgggaatcgcgagccatgcgccgtacttgcgaatcaacgagtacagtgcgaagatgccgccttcgccattgttgtcgatgcgcatggcgatgagcacatatttgacggtagtgatcagcgtaatcgaccagaagaccagcgacagcatgccgagcacggcctctcggtctacgctgccaagccctccctgaccggcaaggaaggtctgcgcggtgtacaagggcgaggtgccgatgtcgccgtacaccacgccgagcgccacgattgccatgccccaggtgaccttgtctgggctggattgcaggcgggcccaccatcgaccgaggccgcctttcgaccatgcgctggcgattttctcggcttctttggtttcagcttccctctgcttggcgagtgcctcgcgctcctccttggtgagagtgcggcgggacaccttgggagcattggtaaaggtgtcggccctcagcagtgcttcttcttcctgtcgggccttggctttggcggcaccagactgggctttctgggcctttgaggctttttgggcacgtgcggtcctttggttcgactcagccatacgttcagtcctccattgaggtggagatcatccccctcgcttatgtcaaacacatcatgatagacctcgttcacaattctgacaaattttacaagtcaacacatcgtctctacacgcgccgcgacggccgcacacccggccctcacagtccgtatacggcgcgggcggtatcgcgggtgccgcgcgccacatccgcgatgggcaagtcgagcgtgtcggccatggcgcgcagagtgtagggaatcatgtacggcgcgttggtgcggccacggtacggcatgggcgtcagatacggcgcgtcggtttcgaccatcgcatggtccagccccacaatccgtagcgattcgcggataccgtcattgcctttgtagctcacggtgccggagaagctcagataccagccatgttcgcgcgcgatctcggccatctcacggtcgccggaatacgagtggaatacggtgcgttcgggcgcgccgtcggccagcagggtttcgatgacctcgcgatgggagtcgcggtcgtgaatctgcatgggcaggcccagttccttggccagggcaatatgcgcgcggaaagcctcgcgctgcagttccttggcaccttcgccggtgcggaagaggtccatgccggtctcgccgatagccaccacttgctcggggtatgtggtggcgaggcgatgtacttcggcgagcgcgtcctcgaaagacgtgtcatggtaaggcttgtatttgaggggcagaccatccggccccggcacaccgcgatgcccgtggagcacggactcattggggtgtattgcgagcgccgcgtgcacattacccggatgatcgagggccatctggacggcggtcatcaggtgcggcagctcgcaaccgcagtcgataatacccccaatgccgacagattgcgcctgcgccagcaattggtcgacgtcgtacaccgggacttcgggctgtcccttctcctgcgcctcatggctcatagcgcgcgcgaaagggattacggaggccacgtgagtgtggttgtcgatggtctgggcatcgtccggcaatgcttcaggtgccggagcccagctacggtcgcgatggtggtgcttgctcatggtttctcagtgtaggctgtttctcagtgtaggctaccgccagcaacgctcgtaaggcagtccggtaagacgttcgactacacgacgggtatcgtcggtcacgcccgcctgaacttgccgtttcttgccacgagcgcaacattcccgggagagtagcgcaaccggcaagcgagacggccgccatcctgccgcctttttctgcatcatcagcccattttctgcctcattttgataaaatatgatgcagaaaagttcgtatgatgcagaaaatgaggcagtatgagatcatttgactacatcgaatcaggtaagacgttgctcaccccgcacaccacgagtttgcttgccgctattcacgaggcaaaagggcgtcaaagcatacagacaacgatcagaccggatatattggggacgctggttgccgtcgcgcgcatccaaagcacagatgcctcaaaccgcatcgaaggtatttctaccagcgatagcaggctcaacgatctcgtctcggagaaagtcacaccgcgcaatcgcaatgaagaagaaattgccggttaccgtgacgcgctatcggttattcacgaaagccacgactatattccgattaccccgaacgtcattcttcaactgcaccgcgacctcttccgacacacaccactgacctttgcggggcatttcaaggacagtgacaacgtcatcatcgaacgagatgcacacgggaccagcaccgtgcgattcgccccaccgtccgcacttgtcacaccggaactgatcgaacgcgcgtgttccgcctacacgcaagcaatccgagatggacataccgatccattgcttgccatcgccatgttcattctcgatttcacctgcatacatccgttcaatgacggcaatggccgcatgagtcggctactcacgctcctgatgctgtgccgcaatggctatatggtcggcaaatacatcagtatcgaacaccttatcgagcaaagtaaaagcacttattatgaggcgctggccgcaagcacccaaggctgggacgacaacgccaatgattatgcgccattcacgaactacctgcttggcatcatactgtccgcgtgcaaggaattcgacgaacgcatcaatctcacggcaggcggcagagcgcagggagcaccgcgagtagccaccaagggaacgcggattgaagcactgcttgatcaatccctagttccactctccaaggccgatattctcgctcgcatgcccgataccagcaccaccaccattgagcgcacgctgaaatcactgttggactccggtacgatcatcaaaatcggtgccggtcgcagcacccgctatgtgaaacgccgctaaacgcatccttgtgcgcaacatctcgtcactcttccggcgctccactggccacgcgaatcatcgcgtactgggactcgtagaggcggtagtacgcgcccttggcggcgagcagctgcgcgtgcgagccgtgctcgacgatctggccgtgatcgatgtagaagatctcgtccgcgttctcgatcgtcgacaggcggtgcgcgatgatgaagctcgtgcgccccttgagcagatgctgcaggccggcctgcagcgcctcctcggtgcgcgtgtcgatgttgctcgtcgcctcgtccaggatcaggatacgcgggtcggcgagcagcacgcgcgcgaaggcgatgagctggcgctggccggccgacagggtcgatccgcgctcctccaccaccgtgtcgtacccgtcgggcagttccatgatgaactcgtgcgcgtgcacggccttcgccgccgcctcgatttcctcgtcggtggcgtcgagcttgccgtagcggatgttctcgcgcacgttgccggagaagatgaaggtgtcctgcagcatcacgcccatctgccggcgcagcgatgcgagcgtcacgtcgcgcacgtcgtagccgtcgatcgtcaccgagccctcggacacgtcgtagaagcgcgacagcaggttgatgatcgtcgtcttgccggcgcccgtcgggccgaccagcgcgattgtgcgccccggttcgacgtggaagtccacgaggttgaggatgttgcggccgtccttctcgtagcggaacaccacgtcgttgaagtcgacgcgcccgcggatctgcggcaggtccgccgcgtcgggcttgttgcggatctccggcgtgacgtcgagcgtctcgaagatgcgctcgaggtacgccgagcaggtgatgagctggttgtagaagttgccgatgttgatcaccggattccagaagttgttcgcgtagccgacgaacgcgatgagcacgccggtggtcacgttcacgcccccgaagcccatcacgccgacgaagtagatgaacgagatggtcatcacggagatggtctgcacgcccggccacatgaggaactggatgtgcacggcgtgcatccacgcggaacgcacctcgccctgctgttcctggaaggtcctgaactgggcctgctcctgtgcgaaggtctgcgtggtcttcacgccggcgatcgactcgtggatgtaggcgttcaggttgctctgcttgttggagagcttctggaaggcgcgccgctggaagatctgcagcacgcgcacccagatgatgagcaccgggaacaggatcaggctccacagggccagctgccagtcgatcacgaacatcacgatcagcgtgatcacgaaggtgaacacgtcggagatcacgttgatcagaccggagctcagcgtgtccgaaagcgtgttcacatagttgaccacgcggatcaggatcttgccgtgcgggcgcgaatcgaagtagctgaagggcagcgtctggatatgcgtgaagatatcgcggcgcatgtccttgagcatgagctggccgacgcgcgtgatcgccaccgtgcggtagcgcagcccgaactcgtacagcacgatcagcgcggcgaggatcacggcgaggatgccgagcttgccgaggtccttgttcgggatcgcctcgtcgatcatgatcttggtcaggtacggcacggcgacgacgatgcagctcatcgagatgacgacgacgagaatgcgcgccacctgtgccatatacggtttgagatatttgccgacgcgcaggatgtcccggaagttgatctgctcctcgagttcctcatcctcgcggtatgtattgcgttgtgccataagtcctcttctaaaaaccttgtgcgacgccggactggagtccgagctgcttgtggtagatgtcccagtagcggccgtgtgcggccacgagttcggcgtgggtgccgcgttcgacgatacgtccgtgctcgagcaccagaatcaggtcggaatccttgaccgacgagatgcggtgggcgatggcgacgatggtcttgccgccgtccatctccttgaggtgcttctggatctccgcctcggtctccatatcgacggccgaggtcgtatcgtccataatcaggatcgacggattgtccgcgagcgcgcgggccagcgacaggcgctgcttctgcccgccggacaggcccacgccgcgttcgcccacgacggtgtcataaccctgtggcatcgacctgatgaaattgtccgcgccggcgatctgggccattttctggatatatcggtcgtcgctatcaccgctggcaccaaaaccgatgttgccgccgatggtgtcggagaacaggaaggtatcctgcgccacgatgcacacctgcgagcgcaaggtggccagcggccagtcgcgtgcgtcgatgccgtcgatgagcacatggccaacggtcgggtcgtagaagcgggagatgaggctgacgagcgtggacttgcccgcgccggtttcgccgaggatgccgagcttggagccggcgggcacggtgaagtcgaggtccttgaggatcggggtctccgggtcgtccgggaaggcgaagctgacgtggtcgaagcggatgtcgcccttgatgtgcagcgggcaggacttgcgttcggtggactgctgggcaccggatgttccggaagccacgggcgctccggtagccccggtagcctcatcatcgtgcttgacttgctcgacgatcgtgaccgcctgcttgacggcttcgaccgcgtcgggcttctccacgatgcgcggctgttcggtgagcagcttgcggattttgatgcagctggcgttgaatcgctgccagtcgttgatcagccagccggactggcgcaccgggccgtcgatcatccacaggaaggagttgaaactcaccagattgccgagggtcatgtagcccttgatgaccagaaagccgccgaggccgagggtgatgagctgcagcgagaagccgaggccgtccagccacggcatgtacttgcgcgagttgtaggccaaggccatgttgcactgcatgtaatcgtcgttgtgctcgtcgaacttttcggtctcgtacggttcgcgcacgaatgccttgaccacacggttgccctcgatgttctcttcgaccatggagttgagggaggccagcgagttgcggatggcgaagaacagcgggtgggcgtgcgtggacaggccgcgcgtgagcacaaaaatgaacggcgtgacgcaggccaggacgagcgcgagtcgccaatcgatggcgaacatcacgcacagggcgcccacgaacatgaccacgcagtcggcaatctgatagctcacccaactcaggcagtggcggatcgcgtcggtgtcggaggtcaggcggctcatgatgtcgccggtgcgtgtgtggttgaaatacgtgaagtcgagctcgtgcagcttctcgtattcgtcggagacgaggcggtagaccgagttctggccgaaacgctccatccacatctggtagccgtatcgcgcgcccacgcggatgatggtcatgaggatcatcagtccacacagacgtggcagttcgtcggcatgtccgccgacgatgacgcggtccacgatgataccggacagaatcggaatggtcagggccatcgtgttatttgcgatgaacagtagaagcgcgcctaccacgcggggcaggtctggtttgcagtatggcagcacccatttgagattgcttgcgctggtattgattcccggatcgacgtacatgtgaggagatcaccgtttcttggggattgtttgcttgtggtatggtgcggcatgctcctgcgccgcacgcggcaatcgctgccgccgcgattcacgatcagccgtgcttcgcactgcgcctgtcattggccgcatgaccgaagctctccttcatcggtcgaagcacgttcgactttcgcaaacgcgtactagtctaggcgacctgcgtctaatcgcaacggcccgcaactctgcgtgttccccgcattagcaacgatacgcggctctctaagcgcaacattccccggaatgcgtcgctgcacacctccgaacaggtccaattcgcaacgcattcccgggaaagtggcgcatgtcatatcacgctcaaacaacccagcatagtgagtggttcattcacgttttacgtattgtgcgacggaatcggcatctcccgcaacacgtgagatatgcaaaagtgccgcacgctgaatggtgatcagcgtgcggcactgcgcgaaacgcgtgaaatccgcagaacgcacgaaactcacgaaacagataaaacgtacaaaacgcaagcaaggcgaagcaacgaacagacagagacagacagactacaggtcagaacgccagcgaacgcacgtaggaaccaacttgcgggcggaacagctaccggggattgttcgtttgcgatgttcgcattcatggcaggtttctccatacgattcgggcggtcggttcaggaggttggttggcggaggcaggttcggtttcagcgtcggtccagggccacccagagcacgccgtgcggcggaatcgtgccggtgatgacgcggtcggcacccacgccttcaagacgcacgtcggcgggctcgcccggcgcgtcggcatacagatcggcgagtgtccaatcgtcattgcgggcgtcaagccccacgatggattggagctggatgttgcggccgatctcgtatgtgtcgctgccggtccagaacagcgcggcgtaatggccgccgtgatgcgcggaacgtgtgccatcggcccaatcggctgcgtcggcggaccagacgatgaactcgccacggtaggtgctctcatcccaccatttgccaaaaatccgttcgcgcacggtctcgcggttattggtggagccggcaagcacctcacgcaacgcgggattctgcagcagcgcgatggcgtcgctgttgctggtgggcagatcgccgccgaccataagcgggctacgccccatgcaccatagggccagcagtgtcttctgctcgtccagcgtaaggcgggattggcggtcgtcgccgcgttcggcgcgcaggcctatgtgcccgaacggcaccatgtcggcgtcggcccagtggccggtggtctggaacggcgcccagcgggccaggcgggcgaactgctggtagatgtcttcccaacggtcccacagatcgtcggaaatacgccacatttgggcgttctcgcgcaggaagtcgacgtagctcgtcgccacccagccgccgggcgagagagacaggtcaatcgaacggccgtatttggcttcggctttggcgatggcgcgatgataggcggcgatttcgtcggagtggaacggggtctgcatgtcgtcgaccttgaggaagtcgaggccccaggaggcgaacaggtcgagctgcgcgtcataccaggcctgcgcgcccgggtgggattggttcaggccgtagttgtccggattccacttgcacacgtggtcgaggtcggccacgtccttggcggtgtagttggtgccgtatacgggcaggttcttgtccacagcgatacgcgggatgccgcgcatcatgtgcatgccaagcttcaagcccagttcgtggacggcggcggcgagcgggccgaatcccttgccgccggcagcactcgggaaacgcaccgggtcaggcagctgacggccgtattcgtcgagaatcagcggcgcgttgtcgttgtaaccatgtgcgcgggcggtcgggtcgtaccagtcgatgtcgatgaccaacgtatcccagccggcgtttttcaggtgttcagccatgaaccgcgcgttggccagcagctcgtcttcggtgagagtcgtgccataggaatcccagctgttccagcccatcggcggacgccatgcctgaggaaggctctgcggaagatccgtcatcgtatcctgctttcgttgatattcgcataagttgccctacggcggtatgccagccgcaaaccaatcggcatcgcgcacgtacggataggtgaagagtgacgccactcccccggagagtcccatcccaacgtacgacgaacttcatggcctcttggcacaccgacgtatgtaccgttacatattcttccaccggaacgatatcaagcaagcgcatgttacgctcggcgcgtcatcgcctaagcgcagcattttcagcgattccggcacacagccaccatttgccaaaacacgatgttgtgaataccgttacaaccattggaagcattacgggcatgatccaatgcccatcacaggcgaaacatgaggtgacgttatgccgagcggcaaaccaacattgcgcgacgtagcgaaagccgccggggtctcccccatgaccgcctcgaatgcgctgcacggcaagccgggtgttaaggattccacgcgcgccaaagtgctggcagtggccgaaaagctcgattaccgcatcaatctgacggccagcatgctgaagtccggccgcagcaacatcatccacatcatcgtcaacgaattcgattcgccgttctactccaaactcgtcgaatcgctcgtcaccgaaaccaccgcgcgcgggctgacgccgttcgtggagcaaacccggtactctccggatgccgccaaacacgcgctggccaacaacccgttctccgggcagttgttcgacggcgagattatccacgcttcgggcctgaatgccggtgtgccgctttccgcgatcaaccacggccgaccgctggttctgattgacgcctgcgaggaaacgcccacgttcgatacagtgaatttcccgaacgaagacggcgcgcgggcggcagtgcagcatctcatcgaatgcggatgccaccgcatcgccattgtcggcgacgggtattcgccacgaaccgaactggcgcacgtggaaagttccagcggtttgcgtctacgcggggccagcggcgcactgcttgacgccgggctgccgtatgacgaatcgacgaacttcattggttacggtagcgacagcggcatcgaagccggtcatgccatcgccgaggcgatgctcgaggctcgtgcgcaatcggctgatgacactgctgagtcccgttccccgggcaccacgcgggcaacgggaagcaccccggccatcgatggcatcttctgcattaacgactatgccgcattcggagtaatccgaggccttgccgactacggcatccgcgtgcccgacgatgtgagagtcatcggcttcgacggcgccacggccggctcgtacaccacaccgacgctgagcaccgtccaagtggatctcgatcagctcgcccaattcgcgcttgatatgatcacccgccgcgtggagcagcgcgaccagggcgacggcaggtccgacgaatccgctggcatgccggccacgcgcgccaccattggatacacactggttccgcgcgagtccactgtcggttcggcaaacaggtaacgctgaaacgccgaaatagggcggcgattcccgactgccgcgcccactgcccaagtgccgtgcagcgtgacgtgcgaggtttcggcatgcgtcaaaccgttcccagcgctcccacgtggtagtggcgcccatgcgcacttttcctagggttaggaccatgaccttccctaatcacacggtgttgtagaggcgggcggggaaagcgtcgcggtattggccgggggtcaggccagtgcggcgcttgaagacgcgcatgaagtacttgggatcggcgtagcccacttctcgcgcaatatccgccacgctggaagcggtagaactcagcagttcgcgcgcacggtcgatgcgatattcgatgatctgctcggccacacccacgccgaacacgcgccggtacatcgcggtcagatagctgggtgaatagtggaagcgcgcggccactttggccacggtgatgtcgtcgaaggcattggccataatccacgagcggatggccagcatcggcgccaggccggacgaatcgccagcggcaccggccgaatcgacatgcatggcccattcctgttgctgccggacgcggtcggcactggtgatgggcttgccgtcgccccggtagccggcaagcgtacgatgggcggcaaagtccgccttcagccgctcctgcgcgctgacctccagcagcaggccggtggcgaagtaatcgcagtaagcgttggaatacgggccgaatcgcgcatagatgtcgatgagctgcccacacatcaccgccagccggtcggggtcgggcagggtgcgttcatcgggcagcaacaggcaatggtcgtcctgcggcagacccgcgtcatcggggagcatgcgcgcatccggcaatttgaaatgcatccagtagaagtccacgtcagacgtgatgatgtcggcgcccgcatgctccacattcggcggcaagagtgcgatttggccggcctcgatatgcagggtctgctccccacccgcatcggcaggacgccccgacgcacgaacatcagctcgaaggtgtcgatggtgcgccgcagatggcgccagcccggtccggacacaaactgcccgaccgagtaaaagtccaccggcccttcgagccgacatgtcgtgatgcccatggctaccagagtagccgagagcaaatatcagccgcgcagccagacggtcatttcgttttcgccgcggttggcccaggcgaagtacgggatgagcgtggcggtggcgggctcgcgcttgaccggcgcgtacacggcgtagagcggcgcgaacgccggaacctcggccgcgccctcacccgcggcggccacagcagccggcaacggctcgcgccaagccggcacctcaagcttcaccatgcggcgggtcacgtcttccacctcgccctggcccttgtcgtcgatgcccttggcgccggcgtggaagtcgaactcctcgaccttggccgcgctcgggtcggccagcagtgcctccacatccgcgtgcagcaggtgcaggttggcgccgttgtctttttcctcggcgcagaaggtgatcgggccgcgcacgaacgccaccttgccggcgtcctcgcgcaccagcgggttggcggccagcatacgcaccggcatcgggaagtcgaacgtcacggtgtcgccgtcgcgccactcaccggtcagatacaggtagccgtcgcgaatttcgcgggtcacgcgggaactatcggccccagactcagactcgcccgtggccgtaatcgcggcggcagcagcggactcatcgcccacccaaccgggcagacggaaggccagcgtaaagcgagcaggagcctgagccgaggtgccagcagcgtcaccgcccaagcgcacgaccgccttgccatcgccttgccacggcaggttcgccgtaacatccagctccacagccgtaccattcaactcagctttggccacgccgcccatatacaagtgcgtgaacagcgtaccgccatcctcggcaaccgtgtaggcatattcctgcaccgactcaacgatgcgggcgatgttcggcgggcagcatgcgcagccgaaccacttctgacgcaccggcttgacgtggcgcaggcggctgtctttatggcaggcatacggattgacttccagcgggttcacgtagaagaagctcttgccgtccagcgccatgccggccagcgtggtgttgtacagcgccgactccataacgtccgcgtactcggcctttggcgcgagctcgagcatgcgacgggcgaagaacgccagcgaaatcgcggcgcaggtctcggagtaggcggagtcgttgggcaggtcgtagttgtaggagaatgcctcgccgtccaccgtgccgccgatgccgccggtaacgtacagtttcttatcgacgatattgcgccagagccgctcggccgcatcggcgaggtcctgatcgtcggtcagtcgggccacgtccgccagaccggagtagaagtagccggcgcgcacggcatggcctacggcttcgtcttgttcggtggccggcttgttcgcctggtggtaggcgtaccggttggggtccgtgttgggtttgtagttggcgtcggcgtcgcgctttgcgttctcgtctgcctgaatatcgaagatgtacggctgccggcctcgctcggtcacgaaatattcggccagatcaaggtaccgctgttcgccggtgacctcgtacagcctcaccaaagccatctcggcaatctcgtgaccggggtaaccacgcagctggcccggcttgcgaccgaagcgctcgtctacgtaatcggcgaaacggcaggcggccttgagcaacttgtctttgccggtgccctggtagtaggccaccgcaccttcaacgaggtggccgaggcagtacagttcgtgatggtcacgcagattggtgaacgcgcgatccatgtcgttcagaatgtagcaggtgtccagatagccgttgtcgagttgggcggcacacacgacgtcgatggcttggtcggcggtctgttccagtgcggggtccgggtgatgggcgagggaatagccgactgcctccacccacttggagaagtcggtgtcttggaacacgaagccgtagaacttgtctgggtcgggattggccgggtcttcggggagcgcctcaaatccgcggaacgtgtacttcggcggcacgaacgccttgccctgggtatccttgcgcttgttttgcgcggcagcggccttgaagttgtgcatgcagtagctgggggccgcgccggggacgttatcgttcagggcgttccactgatagggaatcacagccgtgcgcacgagttcctgctcggtgcgccagaacgaatcggtgacggtgacgtttttcagggccagcggcttgctatgcagcgaagtcatgacgtactcctttggactatgcgacattcgtcaacaatatgtatcggtacatatgatacgtgcgcccgcgcgagcagcaaggtggacaaatcgttggcggggtggaatcgccggcgcatatccgcccgtacgatttcgcccggtgaatcgcccgacgaatacacggcgacttatactaccgacggaccacaaacgtcgcctacatgaatggaagatcaatcatcatgacagcaaacgccagcgcacgggccatcaaacccgaacttctgcgtacgtacaccgaagacttcaacaaagaccgcgccaacctgatcgcggcggacgcggcggtttcggccggcgtgctcaaggcggccaccgactatcgcggcgtacgtgcgctgccgcgcgacttctccatcgaactcaagcagggttcgatcaccaatcaggagcgttccggccgttgctggatgttcgcctccctgaacacgctgcgttacgaactcatgcatcgctggaatcttgaggatttcgagttctccgagacctacctgttcttctgggacgcgatggagaagtcgaacacttatctggagaacgtgctgcgcacgctcgacgaggcgaccgattcgcgtctgttcgaggccatcaatgagtcgcctgcagacgatggtggctggtggcagatgttcgccgcactggtgaacaagtacggcctagtgcccaagagcgcctatccggagtccgagaactcccgcaattccgacgatttcaagcagtacctcaactccaagctgcgcgagttcgcggccgagctgcgccgccgttcggctgccggggcgtctgaggacgagctgcgtgcgttgaaggacgagtacatgggcaccgtgtaccgcatctgcgccgtggcgctcggcgaaccgccggagaagttcgacttcttcgcgcgccccaaggatgatgatgaggataagaagggcgaggctcgcaagtgcaaggccgaggccgacgcagacggcaaggccgaatcctgcaagtgcggcgaatcctgcaagtgcgagggcaaatccgacgccaaggcctgcaagtgcgataaggacaagtccgacaagccgaaaaccggcaaggacgagcgcccgcagattcgcgagatcggcatcaccccgcttgagttctacaagaagtacgtgccggtggacgtcaacgatttcgtgacgctggccaacgccccgctcaagaaccgcccgttcaaccagcgctaccgcatccgcttcagcgcgaacgtggccgaggctggcgatatggaattcgtcaacgtgccgctggacgtgttcaagaaggccgcgcttgaccagctcaccgccggccacccgatctggttcgcctgcgactgcacgcagttcgccctgcgcaaggacggtttcttcgaccagtccgtggtgcgcgtcgaccagctgttcggcaccgaattcaccggcgacaaggcccacggcctcgaatacggcgacagcccgagcaaccacgctatgaccttcaccggcgtgaacctcggcgaggacggcaagccgaaccgctggaaggtggagaacagctggggcaaggacgccggcaaggacggctactacgtcatgtccgacgcctggttcgaccgctacgttaccgagctcatcatccgcaaggaatacctcgacgacgccacccgcgccctgctcaccaccgaaccagtcgagctcgatccctggcagcccctcacccgtcgctgccgctgacatattccgcccattggccgcggctgaagtgctcctatgttttgccgacttctcacagagtgagcaaaacataggagcactttagttatccacagagttatccacatcctcagcaagctagaaccacataccccgtttttcatggcgaacaagcgaccgctacgctacggtggcgttatgaacagcggatttcccaccccgccacccggcgtattcgacgatgaaccacccggctggaccaacaatgccgcggcaccgagtgctgcgtccacgcacgccgtcaagcccgagccatactcaccaccgcgtatggcaacccccactgcgcccgctatgagcgaaaccctcacccaacgtaagcgggaaattcttaaacgatgcacggacgccgcgcaacagctcggaaagcctgtgctcttcggcatgaccacatcgctgatactgcaatccgtgccacttcccaaggattgcgatctcaatgccaccgagctccataccgtctccgactcgcatcgcacccggatacgcgccgtcgttccgccaacaacaccgcacatctggaaaccgctaagcaccgcgcacaatgcacgtatcaacaagcatgtgcacgcgctggatctggtacatacttgggcgcagctcgccgctcacatgtcattggaatcattggtcatacttggcgacgcaacccttacggcaatagcgcgcaagccgagcctatcgggcggccgcaccgccgacgaaatttatcaggactttgtgcggcaggtcagcgaacttccgaaattcaacgcgaaagccacatgcatgatcgcacttgaatttattgcaccgcgcgtggattctccgatggaatcagagacccgtatcacaaccacgcaatacgggcttccacgagccgtgacaaattacacagtgcccggcgcgacgttcagcaatggtgcgccgataacactcgatctcgcttggcccgaattccgcgtcgccatcgaatatgacggcgatcatcatcgcacagacaaggcccagtggcggcgagacaacgacaagcgcgaactgttacggcatcatcattggatcgtcctcatcgccaccgccgcgaatatggctgatgaaccgtctcaagccgaactcgcctaccgagccgggcgacagctggcgttgcgaggctccatattcgatttcaccttgacagcgacgccgctcaatgaacttgcccggcggaaacgacggaaatccaccggggcgcactgagctgacatcgatacgattgcgcgcgcttgctgcaacgcatatgccattcatcgcaccccatttggtcgcgtggccccgaccgcatggcactgttgtgtgtcacacgccatgttacgtccggcgaatccgcacatcatctgcgttgcgtactgccatattatgcggttcgcgatatacgtcacggtgtccgatgtcctggtaacgacgtcaatcgatttatgtgtgtaccgggccagatttcgttgtcccggttctccatttcgcctctttttgagcaaccgggacagaaacaccctcgaaaaatcgccaattcggccctaccgcacaatatccgccatcacacatcggcggaattccgggcttctggatttgcatacattgagcgctcacgggatggtctgtcccggttccccaaaagaggccaaaatcacgaaccgggacaacgaaatctggcccggttcgcacgtcaatcggttgccgtcaccaccgggacaccgactgcgcatagataagatgcttcaatgcttaacaggcatgcgaccataccgcgatagcaacgtttcgctggaagtagaggaatcaagcagcaccccccaaaccggaagcatggagggaatcctgcaatgctccgaatcaccgcgccccgtgcttggtgtggcggatcacggcttcgagcggcgtggatgtagctggacagcagcgtaacttgcgttgcatgatgcggcccaaaacgaagaaacccggcggagggggccgccgggtgagagagaagagagaagaagggttcagttatggggttcggaagaacctcgccaccggtatgaacttcattccgttgacatcttctatataaccgtctctttcttggggattcgatgtgcttgtctgagaaaagtcttggcaaactgtgacgggtttgtaacgccgcccgacaaccggcctcgcattgtcggggctaggccgcacatacggcaacgggccaccccgcaacacttcatgtgcgaggtggcccgtcagctacgagctagcaatgccgaatcactcggcggcgagcttggccttctcggcggccagacgttcggcttcggcggcacggcgagcagccaacgcttcatcgaagcgagccagctcctcttccacggcctcggtcggaatcttggcgaagatcggtgcgggcttaggcaccatggcgccgacctcgattgcctcgctcttccacgggtgcacgttcacaccgagctcgtaatcgccggtgatgatcgggtacgtgaagccgggcttgtcgagatcctcgacttccttgagctcaggcagcggcgagaaggtgccggtgccgccgagcgcctcccacaccttctgtgcggagtgcggcaggaacggcgcgagcaggtggttcgcgtcagacacggcctgagcggccacgtgcagcacggtgccgagacgagcctggtcgtccttaatcttccacggttcggtggcggaaatgtacttgttgatgtcgccgaccacacgcatcgcctcggacagggcgtgcttctggtggtgggtttcgatggaggagccgaccacgtcgaacgcggcggaagcctcttccagaaggccacggtcttcgttggtcatcgaatcctcgtccagcggcggaatctcgccgaagttcttgttgatgaggttggccacgcggttcaccaggttgccccacgaggaggcgagctcctcgttgttgtggcgcacgaactcggcccacgtgaagtcggaatccgaggattcggggccggccacggaaatgtagtagcgcacggcgtccacggggtagcgggcgaggatgtccttgacgtagatcacgatgccgcgggaggagctgaacttcttgccttccatggtcatgaactcgctggccaccacctgctcaggcaggttgagcggacccatcgggccggtttcgccgcccttggagcccttgccgttgtacgccagcatttcggacggccagatctgggagtggaaggtgatgttgtcctttcccatgaagtagtaggccgggcagctcgggtcgttccaccattcgcgccacttctccgggtcgccctggcgtcgggcccattcgatggaggccgacaggtagccgatcacggcgtcgaaccacacgtacagcttcttgttcgggttgtcaatccagcccttcaccggcaccgggataccccagtcgatgtcacgggtgatggcgcgcggcttgacttccttgaacaggccgagcgagaagttgatgacgttggtacgccagcccttgcgggtctccagccacgccttgttggcttcggcgagcgccggcaggtcgaggaagtagtgctcggtctgctcgaagcgcggggtttcgccgttaatcttggagacggggttgatgagctcgtccgggtcgagctcgttgccgcaggcgtcgcactggtcgccacgcgcaccttcggcatggcaaatcgggcactcgccctcgatgtagcggtcgggcagggtacggccggtggacgggctaatcgccacctgctgggtgcccttgtagatgtagccgttctccaagcactgcttgaacatctcctgcaccacgtgctcgtggttaccggtggtggtgcgggtgaacaggtcgtagctcaggccgaggtcgcacagatccttggcgatcacgcggttgtaacggttggccagttcctgggcagtgagaccttccttctccgcctcgacgagaatcggggtgccgtgctcgtcggtgccggacaccatgagcacatcattgcccttcatgcgctcgtagcgcgcgtagacgtcggagggcacaccaaatcccgcgacgtggccgatatgacgggggccgtttgcatacggccaagcaacattcaccaaaacatgactcataaggcttgattatccggcgcggcggggacacgcccggatagccgccgcgccgccatcctcatcccactcacctatccacccgcaacttccccacatacttatctgtacacctcttgcgcgcttatccacatacgcattcgcacacgtatccgcgcacccatccgtacgcacgcccacgcacatccgcacacacttccgcctgccaatatccaccgagttatccacatcatttgcacacctagtaaagttatgcacttatccaccgttttcgcctatccggtggcgcgcaagccgcatttctgcatattgttcggtcatggatatcacagcaggtccgatgacggacatcacaacagtcgcctcgccggcaaccgcgcagcctgcggtgccgccgatactgtttaccaaggatctgccgggaccgctcagccttaaccgtctggccgccttcggcacgttacataagctcgacgattccgccggctactggatcgagcattcgggcacactgtatggtcgcgcgaaaatcgtcgcggaggtcgccccgtttggcactgtggtgtgttcgatgaccgccgcttgggtatggctgggaggccccgactttccgagtaccatagacgtgatttccacatcgcacttccgctcggcatccgtcagccgccgtatccgcgtattcaaaagattgacgttgccggagcaaatcatcaagctcggcgggctgcctgtcaccacgccagcccgtacggcttgcgacctggtgatgagtcctgaagacatccccgatccttccaccgtcaacgcactggtgtgtcagctgatgtccacgtaccagtttcggccaaacgactgtctgcaaatcgtcaaggagcatcggcatcacaagtacgccggacgcgcacgcatgttttttgaatcggtacagcaggagatggacgaaccggctttggagcaatgcgcatgacgagggggttcattgtcagaggccatcgcagaggccgccatgccgctcaccgtttacggcatttgcggcaggcgcaacggttgcctcgccacgcggcggcggcacactcatccgaatccgcatcgcgcgcaatctcggatatgaccgcgccgcctgaaccgcccatcagacttacgcccgcggtggcatgttcgcccgatacggatgttgccgtgctctggcacatcgcatatcacgtgcccgaactgcgtaaatggctggttgccaatcccaaagccgacgcacctttgctggaattggtctcgcagcgcggtgggcccggggtccggcaggcgttggaaatattgttcgagtcgatggaaacgtaacggggagataatcgccggctgctgcgctatcccttgattttcagcacagccgcatacacctgcttgcgattggccaacgatccgtcagccagtggatgctcctgcaccacttgcgcgatggcgtccttgatacgcaggccgtcctccaaagcacggtcgatggagagcacggccatgtcatccacgctcaacgtgctgggcgcggccgcttcggcctcctcgttggacgcgccgccgatgaccagcaccatctcgccacggggcggatcatcaatcacactttggcgaatctcgtcaatcgggccgcgacgaatctgctcataatccttggtgagttcgcggcacagggccatcgggcgattcgggccgaacgcgtccagcagatcgtccatcgaatcggcaatgcgatgaggcgtctcgtagaacacgatggtgcggcgttcgggcaacagcgtgcgcagatactgcacgcgctcggaatgctttcgcggtaggaagccttcgtagcagaagcggtcggtgggcaggccggagagggcgagcgcgtcgagcacagcggaggggccgggcgcgcaggtgacgggcagaccgcgttcaatggcacggcgcacgatggccaagccggggtcgttgatggtgggcatgccggcgtcggatacgacgagcacggtggcgccggtttcgacctggtcgagcaggccgtcggccttgtcgcgctcgttgtggtcgtgataggcgatgacgcgaccgttcacatagacgccgaggcgacgggcgagatcgtagaggcggcgcgtgtcttcggcggccacgatatcggcccgttccaagagggccaccagacgggctgaagcgtcgccgacattgccgatcggggtggcggcgagcaccacggtgccggcggggatggtcacggccgattcgcgggattgggcgacggcggattcgccggcatgaacttcatcattgcgttcaggcacttgcgtcacgctaccgtcagcgtcatactgctcattcaactcatctgcgcttgtcatactcccagtattgcccatgccacagagcaatccacgacaatccatggcgaaatcgaggcattctccctttgcaggggctgatttcacatgttccggaggtctacttccgtttcaaggggctcctcatccggtgaagcaccgatacaaacggctttgacgcaacgctattccgccattttggcggcgtatctacttgaccatcagcccctcgaaacgcaagtagacctccggcaaaccccaaatcagccccttgaaacgcgagatggcagaatttcaacgaaaacaaatgaaaagaccctctgcggtggaatgaatgcagagggtctcgtggagctgacggtagtcgaaaccgcgacctcttcgatgcgaacgaagcgctctaccaactgagctacagccccttggatgttactttgctccgcaaagcaactcgcaacaatatagtacggagtacggtcaaacgcaatttgacgccgaagtgtcgcacgcgtgtcgacacggtaacgtttcggtgtcgcagacggggcaagtcacccacaccgctccgcatggataccgcggcggcacccggcaacgtcatcacgtctccagcacgcccagcaccttcttttcgttgtagaacgcgaacacgatgccgcccagaccgcacagcacggccgcgcacacggcggcgatgcggtagcccgcgccggacgccatgccgatggtggagacgccggtgaacagcagcatggccacggactggcccatcttcatcgcaaaggtgcgggccgcgtagaacatgccctgacggtcctggccggtggtcttggaactggcgtcggcgatattcgccacgatggcctgcggcaggatgccgaacgcggccatcggaatcgcgccgaccaccgagagcaccaaaccctgggccatcgccggaatgaagccgagcacggccgaaccaagggcgccggcaaatgcgaacgcacaggtgaagatcacgaaggcaaccagcagcagcctcttcttgccgaccttattggccagaatattgaccggcagatagaacagcacagagacgccggtcatgagcacgaagtagatggtcgtggtggtttccggcagcttgagcaggctggtcacgaagaacggcagaccggtctggaaggtggtgatggccacccagtagaccacgtcggagcatacgaacttgcggaattcgccgtcgccgaacgtctgcttcagggattcgatggtcgattcggaggtgggatgggagttgacgtagtccttctcgcggatggccagcggcggcaccagcatgcacacgaacgccacggcggccatgatggtgaaggtcacgcggatggcggtgatgcggcccatcatcggcacgaacgcgccccaaatcaccggcgccacgtacgcgatggccgtgccggccacccaagtgaaggagatggcggtggagatggtgagttgctgcttggagtcgtggccgagttcggcgatgagcgcgttgtacggcgtgcagtagaacgtgagggcgatgtagtagccgatcacggtgacgaacaggaacgccgcgttcacccagctggtgccgttgatcgggctccagaacacgagcacggtgaccaccgcgagcggcagggcggcgaatttcaggaacggcatacggcggccggatttggcgtcgcaacggtcggagagagacgccacggccgggtccacgaacgcgtcgaagaatcgggcgaaggcggtgatgccgcccaccacggtcacgatgccgagaacgaccaggccctgcggcacgaatacggtctgaccttgggagatggtctcctggtcaggttggtagaaatacacgagccagttggagatgatgccggaaagcagcgcccacccgaactggccgaccgcaaacgcccacactttggcgatggggagatctctgatggctgacttcgccggtgcaacttgcacacccgttacacttgctgtagtcgcattgcccattctcacaacctccgaatcaacattgacacagtgtcaaaatccagtatacaccggcacaccatgcgttctacgatagtgggcatgacaagtctgaccgagcaactgccatacgtatacgcttttcctgatgcgttggggaccggattactggtgcacaccgagagcgtattggacgatgagatacgcgatcgtattggctcgttcatccatgaatatgaggttgtattatctcgattccgcgatgattccatcgtcggccggatgcgcacggccgcacatggcggcacgttcgattttcccgactgggcatcgggtctgtttggcctgtacgaccgcctgtttgcggcaaccgatggggcgaccgacccgtgcgtgggcgaggatttgattcggcttggctatgacgagtcgtattcgtttacgcctgcgccagatgccgctgaacatgcaggcgcgatccacggacgagccatttggtcagccgacgttgagcggcatggcacaacactggtgacgcgcggaccggtcgcgctcgatttcggcgcgtgcggtaaggggtatttggtggatttgcttgcggggatgttgggtgatggcgcgggtcaccctcaacccattcaatacgtcatcgacgccgggggtgatttgctagtgcacacggacgaaccaatcaccatcgcccttgaagatcctgccgatccggccaacgccgtaggtacggtcgaaatcagccacggcgcattctgcgcgagctcccccagccgccgccactggtctgacgccgcaggtcaccaacttcaccatctgctcaacgccatcgacggactaccggttgacgatgtagccgccacatgggtggccgtcacgccgccatcgagcgccataaccacgaagacatcgacgcatgccagcaatgcctcgacaacggcaaaccgcgataccgacgattcgtcgaacaccgttgcagcacacgtccctgtcacactggccgacggactcgccactgctctgttcaccacctcggccacccagctacgcgctcatttccccttcgaatgcgccatcctcaacgccaaccgcaccgccgcccaatcccccaattttccgggcggttttttcacacactaatgtacgaaatcatcagtatcacatccagtggagcattccctcgggtggaccgatgggttgctccccctcagtcagctacgctgacagctcccctcggagaggggagccgagtatagctaatccgctaatccgctaacgcaggaaacaatccgtcagtcagcgagcgcgaactggctgttgtagaggtcggcgtaaaaaccgcccgccgccagcagttcgtcgtgcgtgccgcgctcgatcacgtcgccgtggttcatgacgaggatcatgtcggcgtcgcgaatcgtggagaggcgatgcgcgatcacaaagctcgtacgccccacggtcagcgcatccatggccttctgaatcagctcttcggtgcgggtatcgaccgaggaggtggcctcgtcgagaatcagaatcggcgcgtcctgcaccatcgcgcgggcgatggtcagcagctgcttctggccctgggagagcgacgacttgtcatcgagcacggtgtcatagccgtccggcagtgagcggatgaagtggtcgaggcccacggccttgcacgcatcctcgatttgcttgttggtcacgccaggcttggagtaagcgacgttctcgcgcacagtgccgcggaacacccacgtatcctgcaacaccatggagaactggtcgtgcacgttccagcgcggcacggacttggtgtccacgccgtcaatcgaaatcgaaccgccggaaatctcatagaagcgcatcagcaggttgaccatggtggtcttgccggcaccggtcgggccgacgatggcgaccttctgaccggccgagactgaagcggagaagtcgttgataatcggcttgcccggctcgtagccgaactgcacgtggctgaattccacgtcgcccttcacttcgtggccgttggtcccaagcaaagcggacttgccggattcgtcctccatctccggctcctcaaggaagccgaacacgcgttcggcggccgccgcgcaacgctgcaggttctggaaggcctgggcgaactgcgccaacggctgggtgaacaggcggacatacatcatgaacgccacgatcacgccgaactcgatctgcccgtcgagcgcgagcgccgcgcccaccacgcacaccaccacgtagccgaagttgcccacgaaattcatgagcggcatcatcaggccggagaggaactgcgacttccagccggactcgtagaggtccgagttgtacttctcgaagcgacgaatcgaatcggcctcgccgttgtatgccttgacgatgaggtgaccggcgtacatctcctccacgtggccgttgacgtcacctagcgccatctgctgccgggcgaagtacttctgggaggacttcatgatggccatcatgatgatcaggccgatgaggctggcaccgatggcgcacagggtcatgatcacgttgttgtagaacatcatcaccagcgcgcccacgaacagcgtcaccgaggtaatcagcgagccgagcgactgccccagcgtctggccgatggcgtccacatcgttggtgatgcgggacagcacgtcgccgtagctgaccttgtcgaagtatttgagcggcagtttgttgattttgaccgagatcgattcgcgcagtcgctgggcggtgcgctgggtgacgttggccatcatccagctttgcacgtagccgagcacggcgtagcccacgtacagggccaccaaagtccaggcgatgtggcccaccgtgccgaaatctaccgagttcatcaccggtctgccgttaacgatggcgggcagacctttgacgatctcgttggtcatgtccttgagcttgtccgggccgacgatctggcagacggtgccggccgcgcccaggatgagcgcgatgatgatgacgggaagatagttgcggcaatagttcacgagcttgcccatgactttgccgaaatcatggggctcttcgacggcacgcctgccgcccattggtcctcttggcatttgttttactccttaaaagtccgtattgacctccctctgatgaaggaggtggcgcgaagcgccggagggagagaagccgtacgcgactacccctcagtcagctgtgctgttttattcgctcgcttatcagctcgtcttcgcctgggaacagcccactgggctgttccctttacggctcagcccctgacatggggagctaccgctgccgcccccccctacgccgtaagctccgactggctgagctgggattcggcgatctggcggtatacgtcgcagttgtcgagcagttccttgtgcgtgccctgacccacgaccttgccgtcgtcgagcacgacgatgcggtcggcgttcatgatggtgccgatgcgctgggccacgatgagcttggtggaatccttggcctcgcgggcgagcgcgtcgcgcacttcgcggtcggtcttgaagtcgagcgcggagaacgagtcgtcgaaaatcaggatttccgggtgacggtacaccgcgcgcgcaatcgacaggcgctgcttctggccgccggacacgttcgatccgccttgggcgatcgcggcggaatacccgccgtccatgcgcgccacgaactcgctggcctgcgccacgtcggcggcggccctgacgcgattcagctgctcggccggtatatcggcaccttccacggcctcgccagcggcgatcaacgcggcctcgcgcttgcgcccggccggggtggaggtatcggccatctcgacctccgccgggtcgcccggctgatcgccgtagctcacgttggaggccacggtgcccttgaacagcacggactgctgcggcacgtagccgatcttgtcgcgcagggccttcaggtcgtagtcgcgcacgtccacgccgtcgaccaacacctggccttggctggtgtcatagaagcgcggcacgagattgataagagacgacttgccggagccggtggagccgatgaacgccaccgtctggccctgctcggcggtgaagttgatgccttccagcatcgcctcgcgcgaatccgggtaggtgaagctgacgttgcggaattccacggtgcccctctggccggttttggccacgtcggcggcggttttggtgccgttctcgacgattggctcagtgtcgagcacctccatgatgcgctgcgcggacacgtcggcgcgcggccagagcacgaacaccatgctcatgagcaggaagctcatgatgacctgcacggagtagttggagaacacgaccatgttggagaacacggtgagcttgtccttgagcccggcggcgtcgatgaggtaagcgccgatccagtagacggcgagcatcaggccgttcaggacggtgttcatcaacggcatcatgaacgccatgacgcggttggtgaacagctgggtctcggtgaggtccttgttggccttggtgaatttggcttcctggtagtcctcggcattgtaggcgcgcaccacgcgcaggccggtgaggttctcgcgggccacgaggttgatgttgtcggtcagggcctgcatggccttgaatttcggcatgaccatggccatcatgatgacgatggccgccagcagaatcactacggcgatgccggtggcgagcgtccattcgaagccttcgccggcgatcttgcacacggcccatacggccatgatcggcgacttgacgatgagctgcaggcccatggtgatgaacatctgcacctgcgtgacgtcgttggtggagcgggtgatgaggctggcggtggagaacttgctcatttcggccgggccgaaggactcgaccttgcggaattcgagcgagcgcagacgctgggtgaacgaggccgccacgcgcgcagcgatgtagccggtgatgatggcacacgccgcggatccgagcgagatgagcagcatcttgccgccggcaatccaaatgtccttcatgtggctgcccggcgtttcgaccagcgtggtgatgtctgacatatagtcgggcagtttcaggtcgaagtagacctgcccgacgatggtcaccagagcgatgagcatctgaccgatctccgctttggagaggtatttcatgatgcgaagcattggtttccccttgtgttggttgggttggttattggttattgacgattggttcttaagttggctgggttatcggcgattatcggttcacgatgtcttaatagtttctattgtttgattacttacactgtgagatattacgcgcacttctgcatgttcgctgtgagcgtcctcaattagccttgccgattagttctccgcgcgcttagctgccatgtgttcagccacgcgcttgccccgctccacgaatgcctcacgcacctgttcagcagtcggccgaggctgtcccggatggcaaatcgacatatatgtggtgaactcagacaccaggtcaacgaattcgcgcgtgcgccgctcccccatttgcgagaaaatccagcaaattgcggaacgcatttcctctatcatccgatgagactgctcgcgcccggaatcagtgagattcacgcgaataatgcgccgatccttggaatcaatgtcacgcgtgacccagccttttttctccagagacgacagcacagtggagatgcggccggaactggcctgcagcgccgatgccaattgcgatggcgtttgcgtccccttcatggacagctcccggagcacgaactgctcaccatgggctccacgagtgaattccctctgcattgtcgaacgattgccccacacgctggcatacagttcactaactgcttcctgctcaaatcccataagagcaccatccattcccattcgccacacggcagagcgccgcaaacaccccaagaatatctcacaccgtaaacaattcattactagaaactatttttggaacgcataatgcacacactccacgctctttgatattctgaaagccgcatagatattcacttcggggcgtcgtctaagaatatttgctgggccaacggtagcgacgttggcattgtgctccatgaggtatctggtcgaaaaggcggacgaagacagaccagttgggcggagcgcgcccatacctcaaaaccattgcaattattcgctttgaccattttcgtggagtcacgaaaatggtcatgaaaaacataaggacacacccatgaaccgcgacgaaatcacacgcaaaaccagcgaactcagcactcccgatacgcctgctatctcattgctcaaaacggtgatccaaagaaagaagaagtggcacttctccagagctattttgccgttcagactcgcaaaacggaaatcattgagcaacgcatgggagaaatcagccggctcgccggccgagaggcccttgccactgcagagaagaaactctatccgtatacccaaatcacacacaacaaaaccgcacaagtgcacatgtacacgcccaaccacgccgcagaacgccggcaaggatgtgatacaggccacagaaagcgttgtaccgcctaggcaatgcaacaattgtccgctatgctctgaaggcagatggcggcacggatgccatcccaaagagggggtatgaccatgattcggggtatgaacctatgcagcatcgccggctgcacgcacgaagcagaagaagcgggcatgtgcaacatgcatttcacatcggcactggttcacggagcgctgcactacactgcgggcggacgtccgtcgcactgctgagcgcaacaacaaagcaaaacaaccagtaacgctcaacggcttccacatgttcatgctctaattgcatgtacttgcagacacaatggccggtctgagccagctgccctcgcatggagcagctggctcagaacggccattattgttgctttgtactgtttgcactgtattgcgcctgcattgcgcaagctcgggcgcactcgggtgcgctcgctgagtggcgtgaatcgcagattgctcaatagcaacgcaatccacgccactcagcagttgccatggttatgcgcggcgtttgcggatgacgagcaaggcaccagccgcagctgccagcaccacaaccacgaccgcaatggcagccacggcagcacccgtattcgaaaggggcgcagcgccattagcagccggcttattcgtggcagtgctaccgggcttagcagtgttgccaggattgttggtatcgccgggcttctgctctccagggccgggagtgacctccgtggccgtgaccgtgacttcgaacgtcgcgttcacgccacgataagagacggtgatggtcctcgtgcctgcggtggcagaatcaaagccagtgaacttcagatcaccatcagttggatcaatcagcttgcgcagcgtttcagtatcgccgactttgtaaatggcggataccttcacatcggcagcgttgaacttatcgcctacctgataggaatccttggtcacttccacagcaagctcagccaactgaggcagttcgccgaatgtcactgtgtaggttttcgccgtgccatcctcagcagttacagtcaccgtggccacgccgttgttctcggccgaagcctgctccacctgcaccgtagccttcgcgtcagcagcagtcgcctccaccgtcgggtaggaagcagcatctccagccagcgcaccggcatatttagtggtatccgcggagaatccgtcaaccgtcttgccatccacagtcagatcagcaagattggcgttactagacggctgcggctctggcgttgcttcaccttcggcgatgcgtacttcagcgatcttggcatagtcattgccatcggcgtaggtgaagttgaggcgaatgcccttggtggcgggcagagcgctcacatcggcttccgtcacggctccagcagcaccattcacagtgactgccggcagcgtggcatcagtccacgtggcgctgtcttcagctaggtacgatacagtgaagctcttcggagcggcctcgcccttggccttatccaccgcaacgctgagcttgcccagctgatatgccttatcgaaggtgtagctgagccacggcgaggtgtcgccggtgccccagttcgaccagttggtgctcaggttgttgtcgcaagtcaggtcggccgtagaagcggaggcccagctgctggccggctcatacttcgaggccgcagcggacgagcagaacaaccgggcaaggttgctttccacagtcacggtgaacgtggcggttactgaagaatcagcgacaagacgcaccgtcacggtttgctcgcccaatttggtggtgtcgaagccttccagcgtgtattcgcttggctccagcacacgcgttttgccattggtgagcgtagcggtaaccgtcacgtccttatgcgcgagcgtctgcctcttggcgatagtggcttcagggcccctggccgcgatggactccacagcagcagtctgcgaaccgaacgcagtgccgttgaaggccacggtgaatgcgccggcattgctgttcgacgtggcgaaagcaccggcatcgagcccggttacgtccgcaccggtcagcgttaccgtagcgacatcctgccattcatcgttcgcggaagcacgccagtagcctttcagagtatcggttgaggtgcgctccagcttgagctgcacttggtcgccgaagccggtaccaacatgcgatgtttccttatcgatgtagccatcggcattggaatcgtactgcatgtaaacgccgcttgggctggcaagtaacgtggcatatcccttgccgccgttagcgtcagcaagaccgttacgaaccaccaggccggcacgcggatcgccattaccgcccaagtcgagcggcttgaccgtggtttccaacgtttcgttcacgtccagagcatcaggctggtacaccgcgctgccctcgttgcgatccgtccagacaccacgattggcgttgtccgtaacggtgaagtcataggtaccgccggatgcggcgacctggcacgcgctgccgcccttccaatgggcttccttccaacttccggaaatcgggttggagcaggaaacgtcgatggttctgcggaatgtgcggcccgggttgaagttgctgctctcggcaagagtgcccgtaatggtgtaggttcccggcacattgaatgcgtaggtgctgccggcagccttggtcgacttgctgactgccgtaccgccttccacattccatgtcaccttggtagcaatggtatcgtcgccttccttgacgttgacggtgtccggcagagtaacggttccgcccgtgttcacggtcttcgggagatcatcgccggtttccacagtccagttgaccagcttgcccttggcgctaccatggttgtcccaatagttcagatcccagccgtcgggctcgccttcttgagcaggattatgcatttcgatggtgccgttctcaccgatggtcagcggcagccaaacataggtggaatcggctttaccggaatcccaacggtcaccaaggtagatgaagtgacctttctcctggtctactgcgagcacactagccgactgcgaaccgaatgtggtgccgcgggtatcgcccacagacaacagaccatccgcgccttccggcatgttgttgtaccacgtgttctcgttggcatcgtccttttccacgccacgggtccagcttcccagcatggagtcggcggtgtagtaggtctgcttgttcgggtcccagccggttgcaccagatgcgatgatgttgtaacgcccgtcatattggaatacggcaggagcttccagcgaaccattttgtttgacgatttggaaatcttcgccacgcaccggggcatccgtagtaccgtctgcaagaatgtatgggtactgcccgtcagcagagtactgcttttgtccctcggactggtccacattcgtggtcttgactacattggtgtaatcatcgttaagcttggcgatatacagcgtggcattggcttcggaagaatacagtacataggcactgtcgtccttcggatccacgaacacagtcatatcgcggctgtcaccgttctcaccccagctggggttacctgcggcttctttccaattgttctggttaggcaaacgataggcacccaccatagtgaacgggcccgccggattgtcggaaacagccacgcccgcaagtgcacgtgcatagttggaaccgcccggcgtggtgcttccatcggaatgccaccacagcacgtattgcttgttcttcttgttgtagatgatcttcggacgctcgaaaatgccctgtacggaatcaaccgcgccatcaccatcctgatcggggttggtgttgaggtacgggaagattgcgtcggccttggcagcgtccacactgccgtcggacttggtcaggttgtaggccttgtcgaagtaggcgtaatcggcattgctcttatccgtcaactgagatttgctggtcaccgcacgcagcgccacaccaagatcggtccagttgtatagatctgtcgacatataagcatgaacaccggggctgttgtcgtaaccgttagaacggtcttcgccataccagtagtaggcgtcgccaaccttgaccacttggccaccgtgcgcttggatgtgtgtgccgccattatcattggcgttcttggcataccaatatggctggaagtaatcgctagcgttcttgcccggatcggctgtgggctggaacttggtgtatgtcggcacttggccgatggcaggcaggtaatccacacctgccgcactggcacttgcagcggccagcccgcatgacaatagcgttgccgcggcggtaattgccgcgataagagcgcccttgcccttattgtttatcttcattgatttggttccttgattgatgataacggttttttgaacaaacagttatgtcgctatccgcgaagtcagaaaagggccgacaaatcaatataccgatactgaaaactcagtattcaacttgtcggaccaattatgctcaaagagcggaggaaccggccggcaatagtcaatattgccggcttgttccttcccccattactgcgcgagggtgctatgcacgcttgcgcagcatgaacaatgcacccgcggcagcggccagcagagcgacagcgccagcgatggcggcaacactggaaccggtgttggccaccgtgttcttgttgccgttgccggtggcaccgggcttgttggtgctgccgggcttctattcttcagggccaggggcgactgcgttggccttgaccgtgacgttgaaggtcgcggtcacaccacggtaggagaccgtaatcgccttcttgcctgcggcggtggagtcgaacgagccaatcgcaagctgcgggtcgtcaagagcgaccggcacttccttggtcttgtcgccactctgatagacggcagtaaccttcagaccggcggtatcgagcttgtcgccgatggcgtactcgatcttcgtgggtccggtcaccttgagcgaagccaaagtgaaggctttgaaggtcaccgtgtaggtcttcgtctcagactcgtcggctgaggtcaccgtaatggtggccttgccgccaagcttgccattctcaaccgcgtcgccagtcaccttgacggtggcggcattgtcggcggcgaaggcctgcagcaccgggtttgcctcagcaccgaacggaagatcaactgtgtagtcggtcttatcagcagcgaagcccttgatggtctcgccgtcaagacgcaggtcgcccagcgtggcatcggatgccggctgcggggtgagtaccgtgctgtcttgtgcgaacacctggatctcagccacgttgatgtacaccttggtgtcctgcaatgtgttagtcaggcggatggccttggcctttaccggggtgccgagcacgaagtcaacggtcggggtgtcggcggcggtgatgccgtcggagccagagccggcatcgccggcctgtatcttccagccatccttggtaccgactccatgccattcgccagcctcatcccggtattccagcgtctggctcttcggccaagacgcacgaccatcgtagtagaagaaggtcttcacttcggtgatggtctgagcttcgtcgaaggtgaacgtggcgaccgggtccaccgtcgaggcggtggaagcccaagtggaccaaccctttgacgtagtgtcaccatcgatggccttggaagcggaggcaccctcctggaagttcaccgagaagttcgtgccagaggccgcggcgatgttcttcgcagcaccctgaaccggcgtcacgaatgcctgaatttcggtggcgttcatgtagtcgttgttcacggtgttcacaatgcgcatcttcgtggcattcactgtgcccttatcggccttgaacgtcaccgtctggcctgcggcaggcttaacatcgctaccgaattgcatccacgtctcgccatcagtggtgtactcggccttggcggaagccggagccttgtcaccatacgtaatggtcacgctgctaagctcacactcagagccgaagtcaatcgtggcggtcgggctggcggaatagtcaccagcagagttccacgtcacccaggcttcagctgacgtgtcaccatcggtgagcttcttccactgatcgcccttgctgtattccgtctgctggttggtcacagtcaggttggaagcagtgtcggccacattctcaggcgtggcggcggtgacatagatcgcgcccttcagcgcaatcgtggtcgcgtcgtccagctggtaagtaccggccacggcaatgttgtcgccagccttggcatcggcgagcttggtatcaagcccatcgaagttccacgtaaccttagccgcatcgccctcgaatgcaggcgatgccttgacgtgcagatacaccggcgcagcctcaagcgcggccttcgcctcgctcgcactggtgccggccagcactgtagccgataccggatcggaaacggtgagcgcgccaacgtagaccgtagcggcgacattgaactcgttgccgtacacatcggtggcggtagcggtggcttcgtaggcgccttccttggccacatcgaccttggaagtatcccagttggcaaccgtggccttgccttcgccccaggtgtagtagagcgtgacttcggtcggcagcgcggccttctcgttaacggcggtctgcacgttcacggtcttctggctggtcggcgttacattgcgcagagtccatgtctggttggcggacggcgaagtgccgctcggtgactgccacaagccaaccttcgtgccgactgtggtaccagagttatccacatcaaggttcgtcttagtcgcggcattgagcagctggtaggtcgaaccatcggaagtgttgagaatccacttggcagccgggtcggacttagcggccccaaccgtttcgttggaaagcgcgttcgtgccatccttggacaccagcaccttgccttcggcgttagtaatcacataagccttgagatcagggcgctcggagtcggcgggctgctcgatctgggtaaaggtccaagtctgcttcttggcgttctcggcatcggaagcgacgttggccagggacagcgcggaatcaccagaagtggtatcagccacggccttgccggactgcttaccaacgagctggtaagtatcgccggtctcgacggcagcatccttagcgtagccggtcacgccagtgagctggatggaggcgatagaacgggcgggcacagtgaccgtagcggtcttggcagccttgtcaatcaccacagagccttcagcttgcttgacgttgctggtcttggcgaagacttccggagtggcggaatcgacacccacgttcttgtcttcggcagaggtttcggtggtcagatagagctcaccgtaagcgttgtcggcaatctcgccgtacttcgacaggtcgatgacgaaggtctggtcagaggtgccggagttgcggtggatgacggtctgcgtcttgccatcggcggaggtggcagtcatgttgttgtcttcatcgttgttggcgatgaccttgtcgcccgcgtggatgaagtgagtgatggccttgacgccgttgtacttggcgttggcaataaccgtgcacggttcaagtccatcggcggtaccgccgttgttgttcacgcgacgctcggagtagagcttgccgtccttaccggccacggtgcagtcgaagtcaatcagcacggtgccccagttggtgttttcaccggccgggttcacgttcgagcccatctgcatgttgtagaggtcctcgaccacctgccagaaggtgaagtccttggactgcaggcgggtgacgttggagctgatcttgctcatcatgcccagcgcgttgtcgaaaccgtacgggttgtaggagccggactgccaggagccgtccacctcgctcatcgacagcttcttgccgtctgcctgagcgatatcgcgcgattgcatctggctgccgtcggagtaggcgtgaacattgtactgatcgataaggtccttgatcgcctgcgggtactggttgtacgacttgacaaagtcagcggagtttgtagcatcagtggctgcgatgatggtgtcatcattgtccttgagcgcctcagcgagtgcggtaatcgtctgctgctgctgggcgttattgacatgcataccctcctgcggcttcttcagcgcgttggagtatggggtgacggacttatctttgtcggagtagtacttatcccagtagttgttaatgagcttggtgttgtcatcgctctcatcggtgtacttcgaagccatgtcgcccggagtgccccagtaactggtctcggactcgttgaacggctcgaccgtgtcaacgtttgcgccaaggctttcgaggtgctcgacgttcttggtcatgtactgagcgaatttctcagggtttgcaagattattgctaccggagttgtatccaccagtggcgtaaccgctgttggtcaggaaccacggagcggagttggcgaaggcctctacatcggtgatgtcggggttatcgccggtggcaccgcgctcaatccaccagtcttgggcggcggacttggagaagtcatactggttgtcgtcagtcgggtcgaatgccgcagccagcttgtctttgtcggcctgcttggtggttacgccattgccatacgtgccggagccggtggcgtcatctttccacgtgccaggcacggcagcgccttggcgcatgaatgggtagccgtaggcaacatcggaggcattgccgccgcccacgttgtagcgggccatgttcaggtccagtccttcatcaccgaagatggactggtagaactgttcgcgcagctgtttgccgtattccacagccttagccttggaagcgtcatcgccgagattggtggtgatggccgattcctcgccgaggctgccggtggcgttggcgaaccaagccagcgaggtgccccagccatcgaaactgttggcataccatgggttcggggtcacggtaatggcatcgttatcagccgcatacgcagtgccggcaaccgcaaacgcccctcctcccactagtgttgccgccgcaaccattgcagcaagcgatttgctcagtaccttcattggtctccttagtgttcctgctgtccgccttataccggaaaaatcggcctttgcttcactgagccagcctctttgcctgatacatgacctacgtcgactccttctttcggcgcagccaaaatgtttacgcaaacattttgatatgagcgattttatcacaaaaccgtcacccagcaaacaacttcagagaccacaaacgacgcacaaagtcatgagccattcgaattgcgctggcccaatcgctacgaatcatatttgccgtagcccttaagtgaatcccactgcatcgagatatcgcgcccgctatcccttccgataacgccgaccacgcgtgttgccttcagcaatcagctttccttgcgcaactaaaccgtttaggaatttgcggactgttctgttatcgagctctgttatcttggcgagttcaggtacagtcacatagtcaacctctgtcaagcgtcgattcatcgccgacagcatcgctgcccgcgaatcaatttcacccgatgcggttgcatctgctttcttaccatccacacgttccccgccaatgagcctcgcaccctcttcggcatctttctcaactacagatctcacgctagcaaaaccagaaccatccacggtcttcagcgcaggaacaataggaatcgtcgcctcgaatatgtcaccatcgcggaactcaggctctcgctcagtatattgccgggacgctcttatcagattccgcagtccgctacccagctgctcggctatgccggtctgcacaaacacattagcgataatcggattctttggcattggcgtgaactcgcccagcttcattcgaccttcaaagaatgagcgcgaagcattaaccgtccggatggattcattatcaatggtgacacgcgccaccaccggactggaatactcccgatgcatgaggctgtttgccaccaattcacgggcgatcatcgtacgcgggctcactcgcttatcgccctttaacacaaagcggtcaggcagattccgctcagtaaattcacggagttgctcgtacgaatcgaacaagttggtccgcaccataagtcggtcatcgtatcggtcaatattgtctcgccgaaccacggcatcagtaatatacgctgggcaaaccgaggaaatgacttcatccttgcccaagagcagcactgcagcaagattaaagccctcttcgccggtcgtgtaatcacgatcgtatagcttggcgctgcggaacagttcttcgtcagacatagttccccaagggtgcccagctcgctgagcgaccgccagctgccgcattcgcgcaatcagctcaggacgcaaatcaaacggagtcacgtaacggaaaattcgccgttcggaatagtagttctgcttgcgaatatacatttgactaatctggatatcgctttcgatgtgtgtatccacatcagcaatgcgatcaaacactgcgcccttgaaccgcacaaccgaagaactcggagctacccaaatacgaacaataatccgttcgtcgtactcgatatgttccgtttccaccattggagccggttcgaacatcttacgattagacactacgttgacaacgttgcgctctatctcactaacgcgcttagaatcgacgccgagcacttgaccgtcatcgtcaacgccaagataaatgctgccaccagaacgattggcgaatgagcatacagtctcaaaagtatccgtatgaggcaattcgctgcagcgcttgaactcgaccatagatgattcaccggcctgcagcacttgcataagttcatcctgcgtcatcgcattccgcccttcatagcgataattcatacattaggacatggcacttatcgtattttagcatctaattagtacattaggacattgttttatgtcctaatgtactaattaggcggctaattgtactaataattgcacactgatgtactaatccgatgatcgaatgcactaattgtccgcgcaaatgcactaatcggatgaccgaatgtatcaatgagacctataggcagccgattggctgacgatcagcccagtcattggctatcggccgctagccagtcagccgccaacagccaacagccacccaactaatagccgccagccaatcagcccgtccaatcactccttgtgttccagtgcggcctttaaatcgcggctacggtagcgttcgcgcagcatcgagaatccaccgaagcccacaagccacaccaggccggcaatcgcggaattgcgcgtatcgtccgcaaggaacaacgtcaggtagatgaacacgaagaacacgattgccaccgtattgagcaccttccaagcgggcatgacgaacccgtccggaatgaaatcagcggagcgacggtacttgcggtgtgccatcagcgtcaggatgtagatgaacaggaacaccgcggagctggcggacgagaacagcacgaacgctccggacacgccggggatggcgttgacgatcggcgacagcagtatcagcgccgcggacaccaggatggcgcgggccggcaccttgcgatcggacacctgaccgagcttgttgagcgtcgggttcggcgacacctcggacagctggtacaggtggcggccagccgagtacagcagcgagttcagcgcggaagatgcggcggtaatcaccacgaagaacaccagcgcagacgcccaattcagcccggcatactggaacatcataatgaacggggatgcgaaggagccgtccttgttcggcttgaacgaggtccacggcacaatgcacatgatggccaccagtgcgcccacatagaagatgagcacgcgcacgataatctcgttgatggccttgggcagcaccttgcgcggattcttggtctcggagacggtgacgcccacgaattcaatcatctcgtaggcgaagaacaccatctggaagctcatgaggaaggccatccaaccgttcggcgcgaacgagaagttggcgaacaggttgtcgaatccggcgtggccggccgggctcacgtggtccacgccgtgaatctgcacggctgggtaatggtagccgatcacgatcatgaccacggcggtggcgatcatcgcgcaaatcagcgtgatcttgatcatcgagaaccagaattccacctcgccgaacaccttgacggcaatcaggttgatggagaccagcgacaccaggaaacacagctcgatcagccatttccaatgggtcaggtcgatgccgaacgtgtcgaagaaggtgatgaagtacgtggagacggccgtgatctcggtcatgcccagcagcacgagcgcggcccaatacgtccagccggcgaaatgcccccacccgttgccaaggtaacgggtgatgaaattgatgaaggtgtgctggctggggtcacggtacatcatttcgccgatggcgcgcatcaggaagaacatgatgacaccgaccagaatgtacacgaagatgatcgaggggccggttagcgagattgacttgcccgagcccaggaacaggccggtgccgatggtgccgccaatggcgatgaactgtacgtggcgattgctcaggccacgctccatctcgttggtctggtccaggctttcgacagacttgagtttgcccgtagcctgctgtgtaccaccattcacattcgtatcggccatactgatttcatttctcttctctgccgcccgattgttacgcaccagacgcgatactcgttcaaaacaagttcaaactgtatcaccgaaatatgtcacgaaaaccgctcagctcaagaatacatgcgatgatactgtaaatattccgccaaaaagttcaattcatcaacaccaaattgaacttctacctctattccacggacttgagcgagctgaccgggtctacgcgatcgagcactgggttggtgaacagctgcaccagcagcgcgaacgccagcgtcgccaccacggcaatcgcatagctgtaccagtgcacttccacttcgaaatacagcgacggcatattcaacgcagcagtcagtaatccgcctatccacctgccaagcggcagaccaaccaccacacccataccggtcaatatcatcatctcgcggttcacgtagttgtgcacctcgcggtcatagaagcccagcaccttcagtgtggccatctcgcggatgcgttcggacacgttcgtattggccaacgtaaacagcaccaccagcgccaggccgccggcgagccccacaatcagcgccaccacggcacccatcaaatcgaacttaaacgtggcggccagatgcgcacagctcacggccttgagcaccgacgattcctcgcccaaccgatccgcatattcggcctgttcggtctcggaacctttcagcttggcgagcatcgcgttccacgtcaaggtcgaggcagtgccatctcccgaagccgaagacgtcacaccgtcggccgcaaacttctggtcgtacagtcgctcactgatgtacacatcagagccgatgaggttgcgcgtcaccgccgcaaccttcaccttggcccgcccgctgccgccattgctcaacgtgacggtgtcgcccgcatgaatatccaacgaattggctgcggacttcgccacaatcacaccactatcgtccagcgctacagtgccgccacccgctttgccgaagatattgggcagctcgaaccacccatcgtcaccggcctcttccagcgtgaccatgtcgttcagtttgttcaacgaattgttgggcaccgtcatcagctgcacggtttcgctttcctgcgccgcattgctcatctcgccgctatccacgcgcagattcagcgtttcggtggcccggccatcttgtgccacctgcttgcgcatcgcggtggcgtcatcgtcattggccacgaccatcaggtcgtactggtagatctgctcatattgcttgacgccagtcgtgtcgacggtgtcgttaatcgcaaatccgcagataatcagcgctgtgcaaccagccacgccgcccacggtcataatcaaacgcgacttgaatcggaagatattgcgcgcagtgactttgccgaggaagttcagccggctccataccgggcgaatccgctccaacaatatgcgagcgcccgccttcggcgccttcgggcgcatcagcgcggcgggcgtgtgccgtatctcctcgcggcaggcgagcgcggtgaccacgcccacaccgaccacgaacagcacgatgccggccgagccgtacagccagtcgtattcgagtcgcacaccgggcaatatatacagtccctcaatcaccaccatcaggaatgccgggatgccgaggaatccgaccagcagaccgatgccgccgccgaccaagcaggcgagcaacgcgaacagcagataccggctggacacggcgagtccgccatagccgagtccaaggtaggtgccgataagtccgcggtcttcctcgaccatgcgggtcatggtggtcaggctcatgagcacggcgaccagcaggaacacaatcgggaatgcgcggccgatggattcgatggaactgacgtctgatttgagcgagctgaatccgtcgatcgaagcgcgtgtctgcacataccaacgtgcgttggccacatcgtcgatgcgccgttgctgcttggcgaattcgctttccgcttcgcttcgcttcgcatcgagttcagactgcgcatcatccagtttcgccttgccgtccgcgagctgttgttcgccttcttccagctgccgctcgccttcttcgagctgctgcttgccgctggccagttgggcggcctgcgcttcaagttgcgccgactgggtttcgagggttgcggcattcgcttcgagttccgcggatttggtattgagctgtgcctctcctgcagccgcttcctgttccttggcggtcagttgcgcgttctgctggtccaaggtggattgtgcgggggcaatggtttcgtttaatgtgcgctgcaaatcggctttctgctgggtcagactgtctcgctgcgtttgcagttccgtttgcttggcggccagctgttgccgcagctcactgattgacggcacttcaggcagggtaatgccaaggcgcgcgagcagttgcttgatggcctgccatgtgggtgagttgaagtcgatattcgggtcaagttgcgccagtagattgtcggcctgttgaatcatggacagcatctgatcaatttgtgccacgccttggtcgatttgggtaatgccctgttcgattttcgtgcgattggcagtcagttccgtttgcgccgcatcgagctgtttgcgagccgaggtgagctgcgctttgcccgattcgagctgggtgcgcgcttcggctatctgctggcgaccttgcgcgatctgttgacgggccgatgcaatctgcgcacgtccatcggcgagctgccgttcgccatcggtaatggttgtcctgttgttctccaattcggtacggctatcttgcaatgtcgtttcgttggcttccagctcggcccagttgtcgtcgatctgcttctgggcttcgtccagctgctcgttggcctcgtcttgggcatcatccagtttgcgctgcgcgctggagacgatctgttgacgacgggctttctggcgtgtggcctgtatctgatgttcgatacggtcggccacggttttgacggcttcatcgtaggcatcggaaaacgtgtcaaaatcggacgcaccagtgacggcaaccgatatcgcagtgtatatattgccggtcacgccgtcgctgggtgcaaagaacgtatagtcctcggatgaggtggaccggaaggaggtcatgcccgaatagccgtctggattgttgaggtcgcgcgggtcaagtacgacgccggtgatggtgagtttcgtggggaactgcggggattgctcggcgtcggcgtccgtattggcggcgacacctaccgtatcggcattattggaatcgtcattggaatcattattggaatcgtcagtctccgtggccgctaccgatatgacggatgaagaggtgtcttgtggcgtcacagtaatggtgccgccaatcttgagtccgctatcgttcaggaactgctgagtcaccgccacttcgccggccttgttcggcagtttgccttgttgcaggtacggctgatcaagcccttcggtaccgatttcctgcatggtcacggttttcttggtgccgtccaccaacgtggtcaccgtctgagaacgttcgggctgcacggtttgcacaccgtcgattcggcgcagtgccgccgcatcatcatcggtcaggccgtatgtggatagcacctgcaggtcatgcagtccctgctgatcgtaaaaacgaccggccgccagaaaagcatcgcggcatccggcgtagatgccggtcagcacggccacgccaagcagcgtaatgacggcgatcgagacgaacctcttccagctgcgcagccagcaacgcaacgtatctttggcaaataccgcagaaacgcccgctcctcgaccgccgctatcgtcgaggttccgccgtttcacagaatgtttcacaaatcgcctcgcttgtttcacggggcgtttcacagagtgtcttgcagtgagcatcgccaatcacctaccattcgatatcggcgatgggctgcggcgttgcattgatctcctcgctggccaccttgccggagcggaagcgaatcactttatgagccatcggtgcaagcgcggaattatgcgtgatgatcatcacggtcatgccttgcgtttggcaaatatcctgcagcagctgcagcacttccttgccggtctcgtaatcgagcgcaccggtcggctcatcacacaacagcagcttcggctttttggcaatcgcgcgggcgatggatacacgctgttgttcgccgccggacagttgcgctgggaagttccccatgcgctcccccaacccgaccttgtacaaggtttccaccgggtcgaaatggtcggggcaaatctgtgaggcaagctccacgttttccagcgcggtaaggttcggcacaagattgtagaactggaaaacgaagccgatgtcgttgcgccggtaggtcaccagtccctttttccgcaggcccgtaatatcgcgcccgccgaccgctacgcggccggttgtggcggtatccatgccgcccagaatgttcaatgccgtggttttgccggcaccggactgtcccagaatcacgcttaattcgccttgttcggcggtaaagctggcctcgtcgagcgcgcgaatcacactgctaccagaaggatattccttgaccacatggtcgaattcgatatacgccatcgcacacctccaacgcgctcgtggcagccacctagccccataggccccgccagaacttcctgctatactcaagtaaaacaacactgtgtcggttctgcaaccaacagttggattgtgggttgtcggaacttggggagaaggccatgtccaaagaattgacggaaagccgccgcacccgttacacgagacgtgccatgcaggacgcgcttatcgagttgctgcgcgatcagccgctcggctccatcaccgttaaagcgttgtgcgagcgggccgatgtgaatcgttccacgttttacgcgcattatgcgagcatcgaggaactgctgcacgacattgaagacgaaaccatggcctgggtcaccaccgcactcgaacagctactcgcccagccagatcctgacggcatcgagcatgttattgagcgcatctgccagtacattgccgacaatcgcaatcatctccaagtgctgatgagcccgaaagcggatatcggtttccagcagcagctgctgggattgatttacagccagcgcggtgtaggcgaacagttgcaatcttcggcgggttacccagccgaggcgcagatgcgtatgcgattcgccgtgtccggcagcattgggcttttgcaatactggctcgccaccgatctcgcggcctctcccgaatcggtgtcccacaccatcttcaccatgtgtacgcctgccacgcagtgagcacagtgaattcagtgaactcagtgaagcgtgcggtttcataagcatcgctcgctatagcttcgcctgctcaccggccgcgcccacgcccgcgcttgcaatagcgcacaaatagacgattgaccatttctgagacgatacggcggcatagaataacgaacgttgcgcatcacggcaagccccgcgtgcgccaaacccaagaaatgtgagagaagagcacaatgagtactactgatgcgcctaagaagccgcgcgaaaccgacgacgtgccggtgccggccacgctgcgcaagtcattgaaaaaccgccacatccagctgattgcgctgggcggcgccatcggaaccggcctgttctatggttccagtgaatccatcgcgctggccggaccctcgattctgctcgcctacttggttggcggcctcgcgattttcgcgattgtgcgtgcactgtctgaaatgtccgttgaggatccgaaggcgggcgcgttcagctactatgccacccgctactggtccaagcgcgccggctttatttccggctggaactactggttcaactacatcctcgtctcgatggtggagctatcagtggtgggttcgtttgtgaactactggttcccggcgattccgacatgggtgtcggcggccgtgttcttggtgatcatctgcgccgccaacctgctgggcgtctctaaattcggtgagttcgagttctggttcgccatcatcaagattgtggccgtgatcgccatgattatcggcggcctggccgtcatcatctttgtcctgcccaccgcatccggcatcaaagcgagctttgccaactggttcaccttggaagggggcttcttcccgaacggtctcatggagcagactaaggacggcacctggaccggcctgttgatggcgcttgtcgtggtgatgttcagcttcggcggcaccgagctcatcggcatcaccgccggcgaaaccgaggaccctcgtcgtacgattccccgcgccaccaatgacattatctggcgaattctcgtgttctacattggcgcgctcggcgtaatcatggccgtaataccgtggaacaccatcggcggagacgatgttcccagcccgttcgtgcaaatcttcgattccgtgggcatccacgcggccgccggcatcctcaacttcgtgtgcctgaccgctgtgatgagcgtctacaactccggcctgtacgccaactcccgcatgctgtattcgctggccaaacaaggcaatgcacccgcgtatctgggcaagctcaacgctaagggcgtgccggtggccggcgtgctgacgtccgccgtgatcaccgccatcgccgtggtcgtggtgttcgtgtggcctgagttcgcgttcaactatctgatgtcgattgccaccatcgccggcatcatcaactggacgatgatcatgttcaccgaaatgaagttccgtaaggtggtcgccgcgggcggcgctcccgaggattccgaactggccggcaagtccggcaaggaagcgctcgacgcgattcacttcaagctgccgttcgctaaggtgaccccgtgggtggtgttggcgttcttggcactggtggtggtgctcatgtgcttctccgccagctaccgcgtcgccgtcatcgccggcgtgatctggctcgccattctcttcgccgcctaccagatcactcaggcgaagagataagcccattaccatgtttggtaggccccgatggtcggggccgggtcgccggttccggtatgactttcctgccctgtcgtcgatgatccgggggtgttgtcgccgggaacggggacgcccgatgaccgctgataggaaccaggccggctacacggacgcttcaggggcgcatggcgcaggtctcgtcgtaatgtgggtgcggcgcgggcgtccggactcctccgagcccgcggcgaccggaaaaccttcatgacgggaggaacgatgatgaccccggacgacatcgacgtgtgggtcggcctggacgtgggcaagagcgcgcaccacgcgcacgccctcgaccatgacgggaacaccctgtacgacaagccgttgaaacaggacgagaaggccatccgcacgatgctgggcaagctctccaagcatggccgtgtgctgctggtcgtggaccagcccaacaccatcggctccctgcccctgacggtggcgcggaacatggggatcgcggttgcctaccttcccggcacggccatgcgcaggaccgcgcagctgctgcccggggacgcgaagaccgaccgcagggacgcgcatgtgatcgcgtgggccgcgctcaagctgcccgagacgctcagggacgcgggcccggatgacgagaccctcgccgccctgaagctgctcgccggccacgacgaggacctcgcccacgaatccacccgccacgtcaaccgcctgcggagcctgctgctgcagacccaccccgcgttcgaacgcgcgctcaagggcgagagaatcacgcgcgacgcgacgctcgcgctgctcgaacgatacggcgggcccatgggcgtgaaacgggccgggatcgaggacgtgaaggactgggccaagtccaacgggcttcgcgccggccgcatcatcgacgacatgttcaaggcgatcggcgagcagaccgtcaccgtgcccggcaccctcatggccgagaccatcatcccctccatcgcccacgacatcaagacgatcagggaccggcggcgcgaggtcggccgccaggtcgagaagctcctggaggaccaccctcttctcacggtcctgacgtcgatgcccgggataggcgtcaggaccgcaagcaacatcctgctcggcatcggcggcgacatcgccaacttcaaatcgtccgcccatctggccgcctacgcgggcatatcgcccgtcaccggccaatccggcaccagcatcaaaggcgaacggccctccaggcggggcaacaaacgcctcaagaacgcgctgtggcagaccgcgttcgtcgcatccaccaaacacccgccctccgtggcctattacaagcgcaaacgcgaacagggcaaacaccacaacgccgccatcatctgcctcgcgcgtcggcgctgcgacgtgatctacagcatgctcaaaaacggaaccctctaccaggaaccagccctcgtagcctgaaccgggccacacgggaaaggacgccggacgccaccggcagggcgaagcgcgcccacgacagccaaccggaatcccgacacgtcaactccccaaggagttgacaaaaacataggaacacccccctattgcaaaaaactctcactgactcaacgtcagtgagagttttttgcaaatgaggggtcagatacggcgcttgcgccagatggtcagggcgataccggcggcggcgaggaccaccacggtaccagccacgccgaagacggcggcaccagtgtcggagatgacggcacccggcttcttgccatcagcggagaccttcacgagggccttgcgggcctcggtcaggtgacgaatcgcatcctggacctcggtggaggtggcgttctccttggcgagcaccttcttcgcttgggccagcgcatcggcgtaggccttccacgaatcggcggtgtaatcgtcctggttcagcttctcggcttcggccttggcaatggcgtcttcgagctgcttgagctcttcctcagtggccagatcgggatccggagtcggcgtctcgtcggcaacgaccttcacggtgaacgtggcggtcttggtcgaatcggccacagactgcacggtcacggtcaccttgtcggaggccttcgaggagtcgaagccgagcagctcgtactcatcggcggcgagctcacgggtggtggagccgccgttgccatcggccacggtcgcggtgacgaccagaccggcaacgtcgagcgcttcaccaaccttgtactcggccttggcgggctgcgcggtcacggcgatggagaggatcgtgcctgcggccgggtgctccggctcgggctggctctcctccaacgcattctgcgcgtcggtcagggccttggcggcggcatcgacatcagcctgagacaggccggagtcaaggaaggtctgcttggccgtcttggctgcggcgagcgcatcctcgaatgccttccagctggcctcggtgtaagcagagccatcggtgccgagcttgtcggccgctccaatcgcgccatcaagcgccgtcgtatcggccatctcaatggacacgccttcgtcggtcgggtgaatggtctgcatcaggccgtccgcgtcgaaggtgatctcgtcgatggcggtttcacggtggtagccgaggccggaggtgaacacgccgagcggcgtgtagtggcgatggtaggccatgagccaacggtcgttgccgtccgcgtcggtcacatgcacgtcggactggtgcgcggtaccttgcaggttcttggaggaatccttctgcagcagcacacccttgtaggtgatggtgccgtcgatggaatcggagacgccgtacctcacatggtagttcggggagttggcgtcgtcgcacgaccaggtccagtggtacttgccgtcgcggtaggcgacgaccacggactcgcggaagccgttcagaccgttgagcttcttcaccgtaccggccttgatgctcaccatgtcgtcgttgagttcggcgatggcgggcgaaccgttgccgtacaggatgtacgacttgccggtgttcgggtcggtgaagatggacgggtcgatggcctgtccaacggtgacgccttccatcgtgcgagtgaccagcggttggtcggcggccttgtacgggccggccgggttgtcggccacggcgacgccgatggcggatgtaccgttcggcaacttcgcgcagtagtagaagtagtacttgccgttcttcttctcgatggtcggcgcccacgcggagcccacggaccacggggagatggcggtgttctcatcgccatcggtggtcggctggtggtccttattgacatcgaggatcacgccctcgtcggtccagttcaccaagtcggtggagctgaacgcatggaagtagttgccgctccagccggagaagccgtcggtggtcgggtagatccagaacttgccgtcgaagtagtcgatgtccgggtcggcgtactggccgggcagtaccgggttgttgcccacggtgaccttcttcagcgtccaggtctgcggcgcaccgtcgcccaaatcaacgaccaaagtacggtccttagccaggtcggccgtaccaccattggtgaacgcctgaccatcaagggtgagcttgatggagtcgtcgctacggttgacagacaccttgacgggcaccttggtcgcgccgccacggcggttgagcacggtggtgacggtcttcgtggaccagtcgagggtggaacggacctgagagtggtcgtcagtgccacgcagcgagttcgggtcggacggcacagtgcccacagaaataccctgcagagcaatcgggctggtcttctcgacttcctgagcagtgagcgcgcggttccacacgttcacattgtcgaacgaacccttgaagtatgggtcgttgtagaaggacttgcccaagtaggccagcagatcgttacccaaatcggtgaccttgttcttggtcgccttgttctgagccacctgcgcaccgtcagagtacacggtcatcacgttgtcgtccaacgtgaccgtgacacgatgccatgcgccgttgccagacaacgtagcgttagccgcgtcctccgcaccatacgagttggtggtgatgcggctggcgagctcgccggagttgttgtacttcaggaagtagtacttggtggagttctggccgaaagcgaacgtgaactggtttttattgatctccgacttgacatccatctgcacagtcagcttgttacggccatcgaacaggcccttcgggaactcggcgtaggtgccgtcagagccgtcgagcttaagcaccttgcccttttcggcatcctcggagaccttggcgttgccgttgaaggtcaagtcgttgctgttctcagtggtgtcggtacccttgctgtcttcgaagtcatactcggcaatcggaccggagccgtcttcatcgggtgtgactggctcggtgtccttgttcttatcgaatgccttcaggattgcgttgtactcggtttcagtgacaggcaggatggtgccgtgacgcttcttgagcgaaccgaagttcacatcagaggcaaagccccaatcagccttatcagtgctgcctaaatcggcagaacggtatggggtgtaacccttaccggctgagtactggtcccacatcagaccgtagagcatcttcttgcccgcatcactggtctgcacgtcatcttcattgtagaagaacagctccgggccttccagctgcgcaccggtcagaccggtaccagtcaggtcaccgaatgtaccgacaagcgtccactggttcggatcactgtcagtgttgtagtaaccattcgcaattgtgtcaccagtggtgagcgttgtggcatacggatccttgctacgctcaacaccgaggtacgtgtcaccggacacacgatagtaatagccgtcatcggccttaatcatcgtggtatcgataacggacttgactcggtcgatccacttgacaggcgtcgtgaagttcacgaaatcacgcgtggtggagtagtacatattggtgcgatcgccggacttgttgtccgcgtcggaagcagtggcccagtacaccatgtactgcttgttcacatcatcccagtaggcttccggagcccaagccatgccggctcccggaatctgagaggcaacgtcaacggcgcgcggttcgctccagttgacgaagtcatgcgactcccacacgattaggttggtgctgccattggtggtagcggtggccgcgccccaaccgccacggttatggatgctcagctcggtagcgatgaggtagacggtgtcgccttccggagagcggaccagatacgggtcgcgcacgccgttgtccttaccacgagagttgccggtctggctgttgttccagctgagtaccggatcgccggactcgcgggtgtcatgccagctcaggccatccttgctggtggcgaagtacatctgctcgtcggtagcgctaccttcggtgccggtgaagtgcgcaaacagatagtccgtggtcttcggctgttcgacggcggccttgacggtcagctcgaattccttggtttccgtgttgccgtcagcatcggtaatggtggcagtgagcgtcaccttggtgtcggttttctgacgagcaacgacaccagctgcgatgtcaccatctgccgcatcggtaatgacctttgcgttgctggatttccacgtaatcgcggaaccgttaaccgagcccttggccggaagtgtgatgttggaatacacatcagtgctgccgttgttaatggtcagcgcattagcgtcggccttggcggcatcggacttcgtggaatcgtaggcttccttgatttggtcagcagtatgcgcagagccgtaaatcttgaggttgtcaagtgcgccggtatagtattcgccattcacccagttggccttgccgatctgcagcacgccgccgtctgcgccgagaatatcggtgagctgagcgaagctcgcgccatcagctggggctacggttgcggcctgctcaccgtcaatgtacagcgtggaagcggcctcgtcgatgaccaaatcgacgtgacgccactggctggcgagaccatccttgctcacattgccggtggtgtcgcgcttaccagcgttgttgtaacgctcaacgttcaccgaagtggtgcgatccatcacgccgaggtaatgctcttgctgataggtctgcgcattcgtattcggtgccgcaaataccgaccagccctgattggtgctggcggacttggaatcgtacgaaatcgtgaccgcatccaggcccttgagcacggcagaatcgtccgacttagtcacattcagccagaatccagaaccgagccgaactgcagcagtgccgtccttgctggtagccactgcggcagcaccgttgatggtcgccttggtgccggtggtgtcatcgacaatagtgccagtagcgcctgcagcgacgttgtcgaaatcaagactggcgagcagatcgctgtctgccgctgccttggcatttgatttcagggctgctgccagcgcccgctgcgcggccgatgaatcggtgggatccgattcaaccgcatttgctgctggcgccaacgccatcagcatcgggacagctgcaagagctgccaccgctttcttccacttacccatgtgtctcctctgattgtgggttttggtttttgcgctgagttatggatcgaagttattgatcaacggtgttcagcttcctgaacaggaaacaaacatcgattttgttatcaaattgttatcgtgcgacggtcggccgctcctttatcggcctagtttcgcgcctttttcgcaccgacgaagctgcttcgtttgccagcgcgaactgtgttctcatgcatccgcgcaacgccccgccccctcaaacgacaccgttttgagggaccggggcaacgcgaagccgcatttttggttataagtacttgcaagtttaatatgagcgttcactctttgtggagcgagggccccaatcatccgtcttcggcactcggctcccctcacccaggggagccgagtgcgacgccaatcaggactggcgcttgcgcagggcgtaggctccggcagcggcgacaagcagcgccgcggcggtgaggcttacgccgaggacggcggaaccggtgtcactgatcttgtcgctcggcttggaggcgggcttttgggcaccgtcgtccttgccgtcggtcttgccggagtcgccggacttcttgaccagcttgtcggcggcggactggagccgcgacagcgccttgtccacttcctgctggtcggtggagctctgcaacacctgcttcgcgtcggcgagcgcggcggcgaaagcatcccaaccagactggtaatcagccttgttatagcccttcaccttatcgacaagcgcctgcaacttggacttgtccagcgtggagccgggctcgccggccttgatggtgaacgttgccgaagcagtaccggagtacttgccagcgccggttacggtcactgtggcggtgccgggttcgatgttgttcgtgtaggccaccgtgtagtcggcgccttccttgagcgtcgcgccatcgagcgtaacggtcacggccggttccttggcagcaccgtctgcggtgaactcgttgggttcggccgtgacgaccgccccggagatgtcagtgccagtcacggtgacggtcgcctcgaccggcatacgggaatcgtcctgggcgacgcccttgacggtgaaagtgccggtcttggcataggaagctgcgtcaatggcatcccactcaactgcaacgtcagaaacggaaccgtccgcatgagtcagatgcgcggtttccggcagcgtcggcgccacaccaaccgtcgtctcggcagacagcgcgtcaacggacttcacagccacagccggagcgtacgcctccagcaccttctgatactgggcgcgggtcacgggcagcacagtgccgtggcgcggcttgccgccatcggaattggtcgggaagttcacctcaggcatcttattgccgataacggtccactgaccgctggcgatatcctcagtcgccatcggcacatagtggtttggaccttgatgatagctcggctggtcggcgaacaggtagtactggtagccgttcacgtcgccatcgttggccttgaatagcgatggaccttcgccggaagtgaaggttttaccgtaaccgttagcctggcctttaccgatgttcgtggcaacttcgctccatgcactacccttaagcgcatcggcgtagttcttcacgccggcaccaccaattgcggcagtcaaatctgtggacttctcctgacgcaaagacatcgtgttttcatctttgtagatgcggtagtaggtatcccctaccttttgcacggtcacatcgatggatccactgcctgcaccgcctcggcgatcaacgtcaatccacactgtcgggtcggagaagttgacgaagtcatcggtggtgacgtacaccatgcggttgtaggtcagctgcttgcggctgttctcgtcggtgttgtcgtacaggttcgaggcccaatagaccacgtacttgccgatttcctcgtcgtagtaggcctcaggcgcccaagtgttgcctgcgtaatcagagctcactttgacgtggctttgcttggaccagttgaccagatcgtcggacttccagatctcaatgtacttggaaccgttagcctgtgcaccagcaaagccattcagcccgttgaggggggcacgaccgtcaatcttcagatcggtggcgagcatgtagaacttgtcgccgtccttggacttcatgatgaacggatcgcgcaaacccttctcgccaaactcggaagtgaatatcggcgtgccgttgttcagcgtgttccagtcgagcgcatcgttgcccttggaggccgcgaggctgattttctcgccgcccacgccctcgccggtgaagaacgcccacacgtaggcctcgtccttctcttcggcggcaggcatcggctgaatggtgacggtgaaggtcttagtttcagtggcggtatcgtacttggcagtggctttgagcgtcacagtggcggcatcgctaccggcggcagggcgcttaacagtgaccgttcgagatttgtcgttcacgccttcgcctagtgtggcgatatccttgccaccggtcacttcccacgagatggtcgaaccattgttgcccttggtgggcacggagaagttgctacggatgtcgtcggagtcctcgatggtgacgacgtcaaggtcggccttggcttgctcggcatcggagagctgcttcggcacgaggaccgtgtagtcggcggttttggcgttgttgccgaacgtggcggtgagggtcacctcggcatcagctgcggttgcggccggacgagtgactgtggccttgccggtagcgttgtcaacggcgatggctgcgttgtccgacttccacgcgatgctcacgccagcggcgctggtcggcagcgcgaagtcctcggtagcggatgcgggcacagcggccttgacagcggcctcggccttgtcgagcacctgagcgtcatacagcttggtcacgtctgcggcgctgatggcagtgtcgtatacggcgtaatcgtccacgtcgagcttggagttcgggtcagcgtaggaggacttgccaatgtaggcgacgaggtcgccgtaattggtcaggccaccggccggaatggtgtaggtggcgtctccaacctgcttgccgttgaggtagaagctcatggtgctgttggtgccgctgatgacggtggtgtacagagccaaatcgctggtggccttggtgccggtggtggcggcgttcgtcgatccagggccgacttcggtgccccacgggctgttattcgggtcggccgcagtggcattggtcattacggatttcgcgtagccactcgggttggccgggttgagcagccagtagccgttggccggataattgccggtcttggccgcgccgatgtacgcggcggcggtattgccgttgccgtaattgttcttgagccagatggagacggtaacgtccttcttaccggcgatggccgtggtcggcacgctaatggtttgcgagccggtcaggttgatctggccattggccaccgtggcgtcgccggatagggtggcatcgctgttggccgcgctgccctcgttagcgatggtcttggacgtcagtgcgttatcgaatgaatagtggatgatcggactggcatcgattggcgatgcgctctcggcactggccgtcatcggcagcaacagaccagcgagcagtgttgccatgccgaccgtgagtccggttgcctttcgtatcagctttcccatgtttctcctcattgatagggttgattgtggttgcgccttcagttatggagcgaagttttgtggccgccctctgatgagctgagccgtgaagaaaacgccagagtcgtttttaggcgaaggcgaacgacagtgagcaaatatgaagcgctgaaagctggtccttaattgcgttcgaggtggccgccgttaggcagtcgggggagagacctgcggcggcagccgcgggatacagaatcggccgaaggccatgccgttctttcggtggcttcgccgcggtctctcccccagtcagccttcggctgacagcccccctcgtcagaggggggcttggttgccgtagcagctcaggcgcgacgcttgcgccagagggttagggagatgccggcgatggcgagtgctaccacggcaccacccaggccgagcacggccgtaccggtattgctcagcgcgctgccgggcttgttgacgttggtcttgtcgccggtggtcggggtagtcggcttattgccgtcgcccttatctccgtcaccttcgcccggattggtcggagccttctgcagggcttcgattgcggtcttaaggtcggctgcggcggtatcgacctcgccctgattctcagcggcgagcgcggccttggcagtcttcagcgcggcggcaagcttggcccaggaatcggccgtgtagtcggattccttgagcgcttcggcggcggcgatctgcttgttgagctcagccaaatcgaccttgccctgttcaatgccgtcaaccgtagtatcggatggattgaccaaaccatcggtgtagccgtcgtaagcaaccgcaacagtgccagagacgctggccgggagggtcacagtggccttgccttcggcgtcgagcttcacggtcttggaccagtcgccagcagagaacttcaccgaaccggcgagcgtgcccttatcggcggcggtcaccgtggcggtgagctcgcgggtgccggcgttgtacacggccttggtggtggagtcaacagcctcgatgtgcgtcgggttggcagcggtccaggacttcgtcaccttgagcacagactcaggcacgttcacgaacgcaccgtgacgcaccttgtccggcagaccgccgttagcaccctgagtgatgtagccctgagcgcccggctcggctttgaccggcttcttttcgttgttgaagtccgggtaacgcttggtcatcgggttgtcccacgtggtcttggaaagctcggcacccgtggtcataaatgcacggtaggcgaagttgtcggacagcagaatgtagccgtcgtcgtccttcgtgttgagttcgtcatccttgttgagcttgatggtctctggtccttcgaacggcagcaacgcctgctcgagcagctgccaaccggtgttcgggtcctggcccggagatgcctcggtggtcggtgcagtcagcaccttggaacgctcaaggaagatgctcttaccagtggtgatgtaatcgccagcggcaccgccctgctcattcttggtgaatcggtagtagtagccaccgatcttacgcacggtggaatcaatgcgcgagtagccggtgtcctgccacatctgcggctcggtgaagttcacgaagtcgcgggtgatggcgtaacgcacctgagcataggagctattgccggttttgtcgttcttgaccggagtggtacgggtgtcatcagtgaacatgcgggaagagaagaacaccacgtaagcgttcaggtcatcatcccagtaagcttccggcgcccaggtcataccggcgttcggcgtgttgatggtgatgccgccgttgccgtcgccgttggtacgggtccagttcatcatatcggtggactcgtagacctcaactttccgagaaccgttaacctggttctggctccagcccattgacgagaccttgagatcagtggcaatcaggtagtacttgtcgccttcgtgggaacgcagcacgaacatgtcacgcaagccacccgtgtctgcatcattggtaagtaccgcctggccattgttgcgagtcttaaacgtgaagaaatcgttcttctcagtggaagccacccaggccttttctccaccgttgctgtcgctctcaaaagtgacggccgcatagccggtgtcaggcgcgatgcgggtcttctccttgacagtgacctcgatggtcttggtgaccttctcaccgccgttgtaggaagcggtggcggtcagcgtaaccggcttggaatcaccgtcgccgtaggccggacgattgatgatgccagcaccacgatacgggtcatcggcaccagtggtcttgttttcgtacttctcgttagtggacgtaatgagcttctcgtccgaggacttccacgtaatcgccgagccgttcttggtgcccttggcgactagcggcagattctcggccgccggaactttcagcgcagcaatcgcggcatcgaggtcggctgcggcggcgttctgggcgttcatcggctcaacggtgacgggcagttcggccttcacaccacccagctcagtggtggcggtgatggtggcagtaccagccttgacgccggttacagtaccgtctgcggcgaccttggccacggactcatcggaggaggaccaggtgacgttcttgctcacagcgtcgtccggggtgacggtggcggtgagcttggtggagtccttctcaatcagggtgagcttgttgttcaccacaccggtgccggaaatcgcaacggcggtcggcatggtcaggtcagcgcccctgtagaccttgatgtcatccattgcaccattccagtactcatcgacggagtagaacgacttgccgatgtaggcggtggtcgcgccgagatcgctcatcttgatgccggtgttggccttgaaaataatcagggcattgttgcggaacacggcaaggttggtgccgtccacgacaatcttgtaatcggcccagctgttgtcgttgccggaaacggtgaccttggatccctgttcgttaccccagttgttgttggagataacgcccttgatggcggtcttgctgttgtagaacatcaggtacttgttggcgttggcctgatcggtggtgttggcgtcgttcgagccgtccttgccgacgatgaacgagaagaacttgccgctgtcgtcgtgacgagtcttggacgcgaactccagagtgaaggagtcgcccgcatccttgaacagctggtcatcgatctgggcgtactggccatcgccgcgcagtgagagcgcctcgttgttgctgcggtcaccgtactgttcgatcttggcgccgtccttcagcgtcagcttgtacttgccggtcgaatcggcaatcgcgctgttcgtggtgccgtttttgcccgtgaagtcccagctggcgagcagcgtcggttcagcagccttagtagtctgcactgtcgcggtatcggttgtctgtggttgggaatcttccgattccatggcatacgtcgtcggaactactgccaccatcgttgatattgcaatcaacgatgctgccatcttcttccaatgcttcaccgcatctctccttgtcctttgcctcgacccacttgtcgagtgtctcgttcgcctctacatgaacgcaaacattatttgcgatgataccattacggcactgagactcagtgtgccagattccttatgtatataagcacttacggggggcaaccgcccagcccgaacactccccgtatgccaaaagcccccttccaagccaatcactaatacccctcaatcggcaccccgctccgccagccgccccaaactgttattaatttgttatctttaccgcgcttgcgtggacagagagcgctcagacctcgaagatcgccgcatattcgtgagaacccgcctagtcaatgagatatggcttgaagacacgctcggcgacggggatatggagcatcagcatggtgccgtaaccaaggatcaccagcaggaacagtccaccgggcatgtggaaccagctggccgccagcagtgccacgaacacggcatccacgatgaccagggccacggtcatcgcgatgtgggagatgccgaagatgaaggcgttcttcaaggtgccggccacggtgttctcgaagcgtgcctgaagcgcgaacacccattcgaaaccgataagccagaggatggtcagcgcgaatttgatgatgagcagcggcgtgatctgcaggacgatccatgaccagaccagtgcaatcagcgccaccaagaacggcagccacagcagtgtggctttgatgaagttggttttgaatgacttgaagtagttggaggttacgcctttgccctcgccctcgatggagcggcggcaagcatcatggccggcagtcagggccgcaccgatggtgatgatcggaatcgaagtgaccagcatcagaatgttgatccatacgccgtcaacaagattgctccacgcgcgcatgaatttcgagtccggtgccagccagttcatcaactactccttgtacagcttttggctcccctcagggaggggagccaaattgtcgggctcaacccttgaccgctccgccttcggccctgcaattacggactcgcctacgacgaggctcatcattagcttcgccgctgtcgcggctcagcctggagcctgctggaagcccactgggcttccagccatgggctgacgacgcgagtcgtcagcccttgacggctcccgccatgacaccagagactatatacttctggcataccaagtagaagacgatgatggggatgatggccagcaccaggcaggccatcatggcgcccatatccacggaaccgtagccgcccttgaggtattgcacggcgaccgagacggtcttgtacttgccgaggtcgagcgtcaggtacggcagcaggtagtcgttccagatccacatggcttcgaggatggccaccgagacgatcgacggcttcataatcggcaccacgatctggaagaagatgcgcggcactgacgcgccgtcgatcatggcggactcctcaagctcctgcgggatgcccttgatcacgccagtgaagatgaacacggccagaccggcaccgaaaccgaggtacacgatgcacaggccccacggggtattgagcttcagcatgtcggcgatcttggagagggtgaacatcaccatctggaacggcacgatcatattgaacaggaacagggtgtagagcagcttcgcggcccagttgttcacgcgcacgatccaccatgcgcacatcgaggtgcacaccagaatcagcgccaccgagccgacggtgataagcagcgtccagccgaaggaagcgaagaactgcgtggtctcgatgccgcgcacatagttctcaagtcctacaaacgctttgccggcaggcagggagaacgcgttcttggagatgtacgccttctgcttgaaggagttgatcagcaccaggacgatcgggaaaatccagaacagggagacaacggcaaacagcacggtccataatgcgccatgcttcacaggcttgttctcgttcatcaggctgccacctccttgctcgtggtgagcttgttctgaatcagggcgatgaccgcgaccaggatgaagaacagcacggccttcgcctggccgacgccttcccagcccatacggccgtagaaggtgcgggtgatgttcagcgccagaccttcagacatgttgctcggcgcaccgttggtcaatgcgaggttctgatcgtagagcttgaaaccgttggtcacggtcaggaaggagcacacggtgatggacggcatcatcagcgggatgatgatgcggaacatggtctgccgtccgttggcgccgtccacggccgcggcctccagcacatcggtgggcagggcttgcaggccggcgatgtagatgatcatcatgtagccgatctgctgccagcacaccaggatgaccaagccccagaacccgtaggacgccttataggtcagggcgcggccccagtgggctagtacgccgttcaggagcagcagccagatgtagcccaggatgatgccgccgataaggttcggcatgaagaataccgagcggaacagcgtggagcccttgatcgccttggtcagcatgtaggcgatggcgaaggcgatcacgttgatcacgatggtggtcacgatggtgaacgcggtggagaagccgagcgcgtgcaggaattccttgtctttcaacgctttgccatagttcttaagccccacccattcaccgtcggtaacggtggtgaattcgcagaagcttaagtagacgcccatgatgaagggcaccaggaacccgatgatgaatgcggcgaatgtggggagcgcgaacagcgcccaccatctgcgtatcgccttgccagccatgctgatcatgacttttcctcctccttgagtccgctgcgttgtgacactgcatcgtgcgccggctgcggagttcaactcaatgcgagcttgccgatcgagaaccgcatgcacggcctgttctcgttcaagcctatgttcatagtaaacgtcgaatcattatatgtcaaacgttgtcattttaggcgtttcaagttcgagcacactccggctccagcaatcttctttcacctaagataatggctatataaagccaatctaacgccgacatagacactttgcaaacgtttgtaatacaatcgttgtcatcgccgcagatcaatcaatcagcatgtacactggagtcagttgtgcatgtgtattgcgattttccattcaacgcaagggggccgcaatggctacgagcattcaggatgtcgcccgcgaggccggcgtctccatctccaccgtctcacgttccttcaccaggccggatctggtgtcggccaagacccgcgagcgcgtgctcgccatcgccgacaaactcaatttctcactctcccgctcggctgcggccctgaaatccggccgctccctgcgcatcgcagtactgatgagcggccatatccgcctgtggttcaccgcctcggtcatcgaggggctcaacgaggtgctgcacacgcagggctacgatatttcggtattccagatttccagcatcgaggagcgcaaggaattcttcgagatgttgccggtacgccgtaacgccgatgccgtgattgtggcgtctttcgatatcgacaacaacgaaatcgcgcaactggcttcggtcggcgtgccgatcgtcggcatcaattcagtcgaacccgaagcccgcggctttaccgccgccgtcaatatcgacgatgtgcagggctccacgctggccgcccgccatcttatcaatctcggacatcgccgcatcacctacatcagcaccaatcgcgaggtgtcgctgagcttctccgtgcaaagccgattcgactcattcaccgcctgctgccgcagggaaggcatcgagccgcaggttatcgtctgcaaggtcgatgacgatggacgttatgaaatcagcgacgtggtcaaccaactcataagccaagacgagatgcccaccgccatcgcatgccaagaggatggcattgctttgccgcttatgttccagctggagcgcaatggattctccgtgcccggcgacgtctcgttgatcggctacgacgatagtttctacaccggcgatatcggcctgaccaccatccgccaggatccggtggaaatggcccgcgtggcagcccgcatgacgctcgatctcattgacgaaaagccgattgagcaaccctacatcgtgttcccggcccagctgaaggtccgctcctccacctcccgcgttaagtaggctcacacaacaaagcccaccatagaaaaagtgtgaggcaaccgcacaataacgctcaatcgcacattgtggagaatggcgaaaaatcgccgattcatggccccacagcgtgcgattgagcgggtgcgtgcctcacacttttctgcggcggacgattttgtgcgagactcagcaatacaaagcggcgcccccggagaaggaaatggcaggggcgccgcggattgttgcttatcggctatgggactctatgagactcagtgcgaagcctcgtattcggaagcccaaccgtccacgaaggcggtcttgacggcatcccacttgccggtgccctgcgcgtactcgagcagtgcctggccgaccttgttcttccactcttcggacggcatcatggtgaagttccaagaaacctgggtcttgccggacttctgatcctcaacagcggcttcagtcagcgggttgtcaaacttgacatcatcgaaggtcttgaacggggtggtgaagcccatgtcctgagagatggccttcttgccggtgtcggaggtgatcacccaagacaggaagtcctcggtggccttcttgtcggcgtcggaggccttgtcgttgatgcaccagtagttctcggaaccagtggccaagccctgcttctcttcacccttgacaccggtgtagattggcatcatgcccacggattcggccttcatgccggccttctgcaggtcggtccaggcccaggtaccgttctggtagaaggcggcctcgccgagcgcgaactcggagttcgcatcatctccggtcttggcgctcagctgggtggggtcggtggtggagtcggcgatgtacaggtcgaagatcttcttgtagttcggcaggtaggtgcccttgatcttggccggctgctcggtgacgttgtcatccttgaactcgtagtaaagcggcagattggccaggtgggtcttgaagcgccagtcggagctggagtcgaagccggcggaggtgaacgcgcccttgatgccgagctcgtccttgcgggcctgcatgtcgtcggccacggccttcagggtgtcgaagttgtcgatttcgtccatggacgtggccttggcgccatccagcgcgaagtacttgttgaggatgtccttgttgtagatcaggccgtaggtttccatcacgtacggcacgccgaccaccttgtcgccatccttcagggccacatcctggttggcgagctccttgtacacatccgtattggacatatcggcggtgtacttcttccagttctggtagccgaccgggccgttgacctggaacaaggtcggggcttcggttttggcgatttcggacttcagggtctgctcgtaggtaccggaggccgcggtctgcaccttgacctcaacgcccttctccttggtgtactccttggccagagcggcccactgatcagccgcttccggcttgaagttcaggtagtagaccttgcccttggagtcgtcgccggaagtggagcttccacaagcggcaagggttccgagggacattgcagcgatggccgccactgcgactgctgacttgactgtacgattcatcatcgaacctttctctttcatcgtcgacccggccgtccccggtcaggacaggtacgctagcacgcacctttacgactatcgacatgcactattgtgcaacggtttgcttctttttgcaaacgatagcaatatcagcgcgtcataaatcatcattttcaggccattgtcaacaaatatcccattaattcagtcatttttgcctcattatcgcaatgcaagcgttcgcaatcatgagagcgctaacatatctttcatggcaatcgattgccacttatacccatcaaaaaaaacaacacgccgacgctatcgtttgcaaatcatttatcgacataccgcaattcccaccacaaacaataaaggcccgcccgcagcagcaggcaggccagcgtaatcacagcgcaaccggggctaggcgttccaccgttcgatgacgttatctcccttatagacgctgagcaccgagtagtgcgccgtatccaaacgcagcaaccgcgcgaaatgcgggtccacgcccagccattgcgaggtgaggatgcgcaggatgtgcgcatgagccaccaacagcacattatggccgtctttcagcagcggcgtaatctcatcgatggcgctcttggcgcgtaccgctgcttcttccagcgtctcgccaggcccggcatggaccagcacctgctcgcccgaaggtaaggtctcgacccaatcgccctccagcgtgggcgtcagcgagcgcggcccgtcacgccacacatcccattcaaaaccgctggcctcactcacctgctggcgcgtacgcccctcggctcggccgtaatcccattcagcgatgccgtccaacacaccgtggtccgcaaaaccggccagttcagcggtttggcacgcccgcttcagcggactggaaaacacacagccctggctgaatccttcggggaaagcttcgcgcaggcgccttccggcatccgctgcctgctgctcgccgaccgcggtcaacgggatgttcgtgcgcccggtatgctgcccggattcgctccacacggtctggccgtggcgcagcaacaccaaaaatccgttgccgccacgagagttctcgacggcaacggtgccgttcacgttctgttcgctcatgcctccactctagtctgcgctcgttcatgactccaccattaacgcccatcttttgcgctgagatgattgagatgctattagactgagagtcatgagcgacgaaacgaacaccgacttcccctccagcgccgaccgtgcggtcgacagcctgcaccgcatcgacgagaaggtcaacaggctgcgcgaggaccggctcaacgaccctgattctctgggcgacaagctcatcaagtcggcagtcccagcgctggcaggcttggttgccggcaaagcattccagatgatatgggacaagggcacaagcaaacgcaatctgcgcaagggactggcggcagacgcgccgcaaggtctggcaatgagtctggcattcgccgccgtttcggccgcactcggcgcagtggtttcgcagctgtcggatcggggctccaaggcgttcgtcgaccaccgccatcgcaagcccagccgctaatcccccggttggatgatggtttctgttggctgactgatgactcatcgctggaatttcgtcaaggaaccatcagtcaatcgacaggaaccatcagtccagcacagttccgccacacaatatcggcatttcactgtgaggtaatccaccgtgacgtccggcgtctgccgtgcgacaataaagccatggttaccaacgcaacaatcgaggctcttctgggccgccgctccatccgtaagttcaaggacgaggccatcgacgacgatacccgcgccacgctcgaaaccgtcgcccaacatgccgcgtccagccagttccttaacgactggtccgccatccgtatcaccgacccgaccaccaaagccaagctcgccgaattcggccatcagccgtatatcgccaccgcgccgttgctgtacgtgttcgtcatcgacgagcaccgcaacgcacgcatcgccgaacgcaagggtatcgatcccgcttccgacgaattccatctcaagtacagctatcgcttcacccaagctcagaacgacgcagtgctggccctgcacgccatggagaccgccgcctattcgctgggactgggctgcgtgattctcggctctctgctcaacaacatccccggccttatcgacgtgctgaatctgccggaatacacgtatccggtgctgggtctggccatcggcaagcccgatcagaacccgaccgtcaagccgcgcatgccgcgcacgatgcagttcttcgagaacacctacccggctgacgccgatggcgtactcgaccagctgcccgccttcgacgaggaagttcaccggtactacgatctgcgccaagccgaccgtccggtggacgctttcagcgatcaggtcgccacgatcagtcggcaggatgtcagccatcagacactgctcgacaaggccgccgctcagggcttccgtctggatcagtgagaccagaaccaacgagatagcctcggataggctcgtcactgagtcgtctcggtctcagcactgcgacgactcagttccaacacctcaacatttcatcaccggataccggcaaaattgcacaaccatcccgccggtgtcgcaccatcaacaaacgttcacatatcagtcccattatgcggacaaccaacggccagttttgcaagaaaacccgccaaaccagcagtattcgcaccagtggtgggaatagactgcatgtggccgcaatgattacgaaccggaaaagagggactggatgcggacggtttggcaagtctttctacgcgattgcagacgtatcttacgcaatcccgttgccgttgtggtgacgctcggcgtagcaatgctgccctcgctgtacgcatggttcaacattctcgccaactgggatccctattcagccaccggcaatctgcaagtggccgtagccaatgaagaccaaggcaccaccaacgatctggtcggccatctcgatgcgggccggcaggtcgtcaagaaactcaagcagaacgacgaactcggctggcgcttcgtagacaatgaggaacaggccgtccacggcgtggagaccggcggatactatgcagccatcgtgctgcccaaggatttcagcaccagcctggtcgaatcggtgaccggaacctccaaacagccaaaaatcaagtattacgtcaacgagaagaagaacgcgatcgcgccgaaaatcaccgacaccggtgccaccaccatcgacgagcagatcaactccgccttcgtcaccacggtagccaccaccgttgcctcggccgtttccgaagcgggaggcgatctcgaccaagccaccggcaaagtccagcacgatacgatcaatgatctcaatacggtgatgtccacgctgaacaccgttcaggattcactcaccgacttacaggacacgctggcccaatcagacacgattctcgccgacgccaaacagaccaccgcctcactcaagcagaccgtcgcggccgcgcagaaggcctcccgccagtccggcacactgttgacggaaacacaggccgggtcacaagccttctccaccacactggtcggcgcactcgacaccagttcagcacaactctccggactggccgttcacgtcaacaacgccgccggcagcatcaccggctccttcaacagcgcgcagaactccgtcgacaccatcaccaacacactttcggccccactgaatgccacccaaacgtcaatcagcgatctgaaagacgcgctgaccaaagccggcatcggcaaagacaccaccgacccagtcggccagaacatctggaaacaaatcgatgcgctcgactcattgatcagcaaacagcagacacagctcaacaccttccataccgacaccacacagttcatcaactccggtaaagacgccaccacgaatctttccggagccatgaccaacaccaccaccggcggcatcgcggcgctgaataccgcgcgcggctcgctgaccggcaccgtaatgccgtcgctcacctcatcattgaacagtttcgccgccctgaatggcacactggatggcacgttgacttcgttatccggcaccttggatcaggccgacggactgttcgaccagcttgtcgataccctgaaccaaacaaaaaccaccatcagcagcacgcaggattcgctgcgccaggtggccagcgatgtcgccaccgtacgcaccgatatcgccacgctcgatagttccgccgcttaccagaaaatccgggatacgctgcatctggatgacaagggattcggcgacttcatgggcaatcccgtcaccctgaccacgaaagtcgtgtatgccaccgacaattacgggtccgcagtcaccccgttctacacgaatctggcactgtgggtaggcggtttcgtgctaatcgccatctacaagcttgaggtcgaccgcgagggcattcgccgtatcaccgctacgcaagcatatcttggccgctggctgctgctggtcaccatcggattcctgcaagccatcatcgccaccatcggcgatctggtgctcggcatccaatgcgagcatccgctgctgttcatcttggccggaatcttctgttcgttcgtctacatcaacattatttacgcgctggccgtggcgttccgccatatcggcaaagccatcgccgtaattctggtcattgtgcagatacccggtgcctccggcctgtatccgattgaaatgatgccgaacttcttccgcgaactgcacccatggctgccctttacctacggcatcaacgcgatgcgcggcccgatcgccggcctgtacgcgaaccattactggctcgacatgctgcacctgttctggtatctgccggcggcgcttttcgtgggacttgtcgtacgccggtatgcgatgaacctgaacgcgctgttcgaccatcgtttgggaggtaccgacctgatgatcaccgagcacaacagcatggtgaacgaacaggtgagcttgaactccgtattccgcacggtgtccgacagcaaggaactgcgcgatatcatcgcccatcgcgcgcaccggttcttcgcgcggtacccaaagatgatcgttgccggtctgacattgctgaccgtactcccgttcgtattcctggtgctgctgttcgtcacccaagagaaaatcgccatgctgacctcctggattctgtcgattattcttatcgacgcctatctcattgtggttgaatacgcacgcgaaacctacgccatgcagcttggcgtcagtgccatgagtgccgacgagttccgcaatgtgatgctcaacggatatgcgtggcggcgtttccacggccacggacgtcacgaagcggcgatgggcagcaatccggatatcggcgaaaccactgaacgactcacaccgttcagtgatcaggccgccgagccgactgcgcacaccgcacagttcgagcagtccggtcagtctgggcagtctgggcaaggaggcgcacgatgaagcttatctggaaaatattcgtacgtgacgtgcgccaagccacccgcaatgtgatcgccgtaatcgtggctatgggattggtgattgtgccggcactgtacgcctggtacaacatcgccgccagctgggacccgtacggcaacaccaaggccttgaaggtcgccgtggcaaacgtggataagggctataagtccgatctgatgccgatcaccatcaacgtcggcgaaaccgtgaccaatacgctcagggccaatcatgaccttgactggcagtttgtggatcgtgctaaggccatcgatggcgtgaactcaggcgaatactatgccgcgctgattattccaaagagcttcagctccgatatgatgacgctgttttcaccgaagatcaagcacgccaagctcgaatactatctcaatgagaaaatcaatccgatcgctccgcatatcaccgaccagggtgctaccaccgtggccacgaccatcgaccagacatttgtgaagaccttggcgagcgtggcgctggatttggtttccaacgtggccgattacgcgcaaagcccgcaaatggagcagtacgtcaacaacgcctccagtcatattgccaccatgtcgtctcgtttgaccggcactgcgtcgcagatggattcctatgccaatctgctcggggccgccaacagcatcattgattccaccgataagctgctgggatcaacaggctcagctgcggccacaaccaaaaaggcgttgaaacagacccgcaacggcgtctccagcctcgacaaggcattgtccggagccaccgatggcgtcggtacggcattgcagcaggccggttcatcctacgacaccattgccaagcaaatcgatgccgcttttgccgatgtgggctcacaatcctcacagatatcaaacaagctaaccgatatgcaatccaaagtggaggctcaggccgacagctttggaaagtatgccgccgctttacgagatctcgccaaacaagcggcttcactgcccgtgggcggagataccgttgccgctcaactgaacgcggctgcagaccaagccacaaaggcgcagcagagcatgcagcaagccgccaccgcgttgggcgatgcggccacgcacatagcaaacggtactgccgatgccgatacagcgcgtcgagatctgaaatcacaaatcgctgccgccaaacaatcgattactcaggcttcagacacgtacaagagcacgctgaaaccgcaactgaacaatctgacctcgtccatggacgaagtgaccacgcaggcaagttccgtaatcgacgggcttgcatcgaccgtaagcagcgtgtcaggtctttctggcggcgtttcagacagcctgacggacatccagtcggccttgactgacgcagctagcgctttgacccgttcggcgaagaaactcgacaacttgtcttcccaactcgcctctatcaccaatggcggcaccatcgacctgtctgtgatttcctctgcgaagcccgatgccattgcttccatgctggcggcacccgtagcggtcgaccgcatcgcgctctatcccgttgccaactatggttccgcgatggctccgttctacacgattttgtctatttgggtcggtgcgatcattctggtcgccatgttgaaagtatcgatttccgaccatgagaaggctcgtatcttagggttgggcaatgatctgccgctcggttcggaagtgggtcttcgcgaggccatgattgccgggcggattgccggaccggccgccgcgttggatgtgctgaagaagccgcgtgccgaggctcccggcaatgcgcggcagttcggtttacgcttgcaccacgaatatttcggccgatacatgattttcggtttccttgctttgctgcaaggtacgctggtgtgcctgggcgatatgttctatctcggcgtgcagtgtgagcatccgattcagttcttgatggtcgggtggttgtctgcactggtgttctcgaatattgtgtatacgctgaccctgtcgttcggtgatatcggcaaagccattgccgtagtactgctggttatgcaggtagccggttccggcggcacattccccattgaaacactgccgacgttcttccaggtcgtttctaaatggctactgttcccctatgcggtggatgcgatgcattcggccatggcaggctcattcggcatggaatactgggtttccatgggcaaactggcactgttccttgtcccctcattgctgttgggacttatgttgcgcaagccggtaattcgcttcaacgattgggttatccgcaaccttgaaaacaccaaggtgatgtaagtgttggacgaagtgtgtccgagcgccctgaacgcttagcagcctacgacctgacgtgtttggaccgtaacctgtctcagacacggcgttggcgaggcctgtggagcttctgacgctaacgtctacgtggcttgtagccctttttacgactgtgtggcttgagttgctggttcagcggtacatgccggtaactggattgcggatcgcgatgcgtgagatgccagcatccgcaaaattcgcaacggtacacccatagctcaactccgcgctcgattaggctttgatcagcggcacgctgaacctgcgccttatcgtgatacatgattttattcgacgtagcgcaacgtttaggggtgaagtaatgcatagcagaagccagtgtagagcgaccccataaccaagccagtttctggctcccctcagggggggggagccgtccgcacagcagaccagggggaggaggcccgggcgtcgggattccacggtcacggacgtgctgttttccggatttcctgcggaaatgggaacgcgccgcgccgtctctcttcggccccgacggcggggccggccgggaatggtcccggacgtgggtctcatgagtgcgagaagccccgggtgtttttgtgggggtgtgtgggtttgggtcgtgagtgtttcgggtatgcgaaagccccttggggcgtgtgctccaaggggcttcctgtacgtgtgatgcggcggcgtgctactctcccacaccctgtcgggtgcagtaccatcgccgtgccaggccttagcttccgggttcggaatgggaccgggcgtctcacctgggccatggccgccgcaaatcttctcttgtacggtcagacgctggggtctgccggcctgtggcggcctgggaaccggacagcggacgcggatatgtcgatgtttcgtcttgtggccagacaatgctcattgccgtctggtgtcgtttgcaggaggaagatgcggtccaaccgccaggggttggaatgttagtgttgcctttcgtccgttagtaccggtcggctccacccctcgcggggcttccacgtccggcctatcgaccacgtgttctgcatggggactacaggaactcgaaggttccacggaatgcttatcttggagcaggcttcccgcttagatgctttcagcggttatcccttccgaacgtagccaaccggccgtgccactggcgtgacaaccggcataccagaggttcgtccacccaggtcctctcgtactatgggcaggcctcctcagcattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgtccgtacaccggcaccggatcactagtcccgactttcgtccctgctcggaccgtcgtcctcgcagtcaagcccgcttgtgcacttgcactcgccacccgattgccaaccgggctgagcggacctttgggcgcctccgttactctttgggaggcaaccgccccagttaaactacccgccaggcactgtccctgaacaggatgactgttcgaggttagacatccaatgcgaacagagcggtatttcaccttacggctccgcgcgatctggcgaccgcgcctctcggcctcccgcctatgctacacaatccacaccgaatgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcacccgaaggctgacggatcctcttaaccttccggcaccgggcaggcgtcagtgcatatacagcggcttgcgccttcgcatgcacctgtgtttttggtaaacagtcgctaccccctggtctgtgccacccccaaaagctcccacagcaagtgtgttcaccatcgggggtctcccttaaaccgaaggaacgggagtgatttgccgagttccttgaccaggattcgctcgatcgctttggtattctctacctgaccaccagtgtcggtttggggtacgggcggctttgagcctgacgccgaagcttttctcggcagccgggatcaccggatatcgggccataaggcccccatcatcgcacctcggacccatgcgggacggatttgcctgtcccacgccctgcgtgcttgaccacggaagaccacctccgcggccggctacccttctgcgtcactcctgcgctgacctactacaaggatcggtcccaacaggccagggcatcccgcccccgaaggagcagtaagcccggacccggaggttagtactccaagcctcggttttggcggctgaaagccggtacgggaatatcgacccgttcatccattcgactacgcctgtcggcctcgccttaggacccgactcacccagggacgatgaacgtggccctggaacccttggtcatccagcggacgggatcttcacccgtctctcgctactcatgtctgcattctcactcccatgaagtccacggcgcgttcacacggccgcttcgcccctcatgggacgctctcctacccagtacaaaatactgccgcgtcttcggtggtgtgcttgagccccgctacattgtcggcgcggaaccactagaccagtgagctgttacgcactctttcaagggtggctgcttctgagccaacctcctggctgtctatgcgactccacatcctttcccacttagcacacgcttcgggaccttagacgacggtctgggctgtttccctttcgacgacgaagcttatcccccgccgactcactgccgggatacgcgtcaccggtattcggagtttggttgctgttggtacccgatacgggcccgcaagcatccagtagctctacccccgggacgtaatgacccgacgctgcacccaaatgcatttcggagagaaccagctatcacggaatttgattggcctttcacccctagccccaagtcatccccccggttttcaacccaggtgggttcggtcctccacgcggtcttacccgcgcttcaacctgctcagggctagatcatcccgcttcgggtccaggacacgcgactcaaacgccttttaagactcgccttcgctacgcataccccacacgggttatgctcgccacatgccactgactcgcagactcatttttcgataggcacgccgtcaccccacaaaagggctccgacggattgtaggcgcacggtttcagagactgtttcactcccctcccggggtacttttcacctttccctcacggtactcgttcgctatcggtcagacaggaatattcaggcttacccaacggtctgggcggattcgcacggggttccacgggacccgtgctacttgggagacgcgatcggcagaccatgcgcgttcaggtacggggccctcaccctctgcggcccggtattcaacccggttcccctgacacatggttttctgcaactgccggccggcccgtcggagccggcgcacgcgatcccgcaacaccccgcgcgcaacccccgacgggtatcacacgcgcaaggtttggccatcatccgctttcgctcgccactactcacggaatatcctttcctgcaggtactgagatgtttcacttccctgcgtaccccccggccgaagccggtaccgacccatgacggtcggtgggttcccccattcggaaatcctcggatcaaagccctgttggcggctccccgaggcatatcgcagcctcaaacgtccttcatcggtcctgtctgccaaggcatccaccatacgcccttgcaagcaacacacaccacgaaagtgcatggccgcaagattcctctagcaaattcccagacgacaaatcatcacactaaaaatgatcacaaaacgatcgaaacgaacaatagagttcgattcgaaatcaacagcaaaacaaagattcaaaaacccttgttttgctcgcgtccactatccagttctcaagccaccacgcaccgccacgccatcgcgccggcacacggccggcccccaggcacgacgggcatcgaatcgcgccaggcaaaaagcctggggtggcgatccgggagcccaaaagcgcatccataccaccccggcacccaccgcacgaccggcagggcaaagccaacgacgtcttccacaccagcaaccccgccgccatcgcaccatgcgacgcgcggggcgcacaccgtcggacgaacatccgactgaattctccgtagaaaggaggtgatccagccgcaccttccggtacggctaccttgttacgacttagtcccaatcacgagcctcaccttagacggctccatcccacaaggggttaggccaccggcttcgggtgctgcccactttcatgacttgacgggcggtgtgtacaaggcccgggaacgcattcaccgcgacgttgctgattcgcgattactagcgactccgccttcacgcagtcgagttgcagactgcgatccgaactgagaccggttttcagggatccgctccgcgtcgccgcgtcgcatcccgttgtaccggccattgtagcatgcgtgaagccctggacgtaaggggcatgatgatctgacgtcatccccaccttcctccgagttaaccccggcggtcccccgtgagttcccggcataatccgctggcaacacgaggcgagggttgcgctcgttgcgggacttaacccaacatctcacgacacgagctgacgacgaccatgcaccacctgtgaacccgccccgaagggaagccgtatctctacgaccgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttagctccgacacggaacccgtggaacgggccccacatccagcatccaccgtttacggcgtggactaccagggtatctaatcctgttcgctccccacgctttcgctcctcagcgtcagtaacggcccagagacctgccttcgccattggtgttcttcccgatatctacacattccaccgttacaccgggaattccagtctcccctaccgcactcaagcccgcccgtacccggcgcggatccaccgttaagcgatggactttcacaccggacgcgacgaaccgcctacgagccctttacgcccaataattccggataacgcttgcaccctacgtattaccgcggctgctggcacgtagttagccggtgcttattcaacgggtaaactcactctcgcttgctccccgataaaagaggtttacaacccgaaggcctccatccctcacgcggcgtcgctgcatcaggcttgcgcccattgtgcaatattccccactgctgcctcccgtaggagtctgggccgtatctcagtcccaatgtggccggtcgccctctcaggccggctacccgtcgaagccacggtgggccgttaccccgccgtcaagctgataggacgcgaccccatcccataccgcgaaagctttcccagaagaccatgcgatcaactggagcatccggcattaccacccgtttccaggagctattccggtgtatggggcaggtcggtcacgcattactcacccgttcgccactctcaccaccaagcaaagcctgatggatcccgttcgacttgcatgtgttaagcacgccgccagcgttcatcctgagccagaatcgaaccctccacaaaaaaacttcatgaaaagcatccgaatagatgactctcaaaacaaaaattgacgagcacgtccttaaggaaggacgccctcaaaaaacctcacccctcatcaaaccctcccgggtacccgaccaccacgacaggcaatcaggcgaggaatgaactggcaatcattgactataaagaagtagtacaaacacgctcttgagttctcaaaccaccaccacaccagccagacgggaaaccaaccagaggaaggaacccgccgcgctgagcggcaacaggtgaataacttacacgcatgtccggattcacgcaaatcaaggcgcacaaaaacccaggaatcggcataacagcgcggttccctcggcgtgtcgcacagagcccactttgctctgatgaggctaggttaacccctcaaatgtttctgaaaagcatcaaatccactattcggctggcgtgtcgcgagagttttcagcttgtcggccctgcgttcatctctcggcaaccacactgccggcgcacaatcggcgcatgacagcgctccgtcatcggatttcgttcatgaatcgcgggtatacctgtagttatgaccaagaagattgctgtattaaccggggcgggcatttccacgtccgccggcatccctgatttccgcggtccggacggtgtgtggaccaagcatcctgaccaaatgagcgtttacgacatcgatctgttcctgcgcaacaaagaggaccgcgagtactcctggcgctggcaaaaggaatcgccagtatggaatgcgcagcccggcactgcgcataaggcgctggtcaagctggaacaagccggcatgctgacgctgctggccacgcagaacttcgatgcgctgcatgagaaggccggcaacagcgacaacgtcatcgtgaacctgcacggcactatcggcacctcgcattgcatgaagtgccatcaggaatatgccacggcggacatcatggcccgtttggatgaagagcccgacccacattgccatcgcaaactgaagtatcgtggcgatatgccgtgcaatggcattatcaaaaccgatgtggtgtatttcggtgaggcgttgccggacggcgcgatggagaagtcgtacagtctggccaccaaagccgacgaactatgggtaatcggatcgacccttgaggtgtacccggcggcgagcattgtgccggtggccgcgcaggcgggcgtgcccatcaccattatgaatatgggtcacacgcaatatgaccatcttgcgagccgcttgattcatgaggatatcgccgttgccctgccgaagttggtggacgagacgattgcggagaacaagtagccctcagcataacgaaagcgccggtgggtgggttaagcaactgatgattgtcggttaaccacccaccggcgcttttgcgccacctcccgccagcgggaggtattggagcacacttctgcgcggcttcccgccagcggtattggaatcagtagatgcgcttgggctggaatccggcttccctgagtgccgcgaggatgcggtcgatgtgctcggggccgttggtctcgaccgtgacgccgagagacaccgcgttggtgtagtggccggatgccttgaactggtcgtgatcaagctgaatgacgttggcgcgctgctcggcaagcagggtggccaccttgacgagctggcccggagtatccggcagctcgacctcgaagttcatgatgcggccgcgggcgatcatacctttctgaatcaccgcacccatggtcacggtgtcgatattgccgccggacataatcggaaccaccacgtgcgggccggtggcggcggcgaacttgcgcgaacgcaggttcaggtgttccagcgcagccagcgaaacggcgccggccgcctcgaccaccagcttatgcttctcgagcatgagcagaatcatttcgttgatgtcgcgctcggtgacggtgaccagatcgtccaggaactcgttaatcagagcgaagggcaggtcgccggggtgcttgaccgcaacaccttcggcggaggtaaccacatggtcagccggagacacacgacccgcggccagcgagtccttccaggccggtgagccctccggaatcgcaccgattacgcgcacttcaggcttgaatgtcttgatggcgagcgccacgccggcacccaggccaccaccaccgagcggcacgaccacgtcagtgacgttcggcacgtcttcaaggatctccagaccgatggtgccttggccgcagatgacttcgtaatcgtcgaatggcggcacgtaaatcatgccttccttgtcggcgagctcagcagcgtgggcggcggattcatcgaacacatcgccgtacagcaccacgtcggcaccgtaggccttggtggcatcgaccttcagcggcggggtgatctgcggcatgcagatggtggccttggctccacgctcgcgggccgcataggccacaccctgggcatggttgccggcagacgcggtgacgatgccgtgagcgatctgctcttcggtgagcgaagcaatcttgttataggcaccgcggatcttgaaggatccggtgacctgcaggttttccggcttcaggagaatctcatggccggtcatctcgctcagcaccggagaaggaatgatctccgtgtggcgggcagtgcctttgagtcgttcggcggccagcttcagttcggctgcatgatcacgttgcagcgccttcaaaacatccttttgttccatagctttccattgtaagcaccacaatgccgagagacaccagctatctcgcttcacagaggtacattcggccttttgcagacagctatctgttttcataggggtaccgagaagcaaaaaccccgggtataagccttgattttcaatgcttatacctggggtttcgacgttacggtacctctctcaagacagatagcatttcgggatagccccgaagtacctctttgagcggagaaaggcactcaatgcactacaactggatgacggctgcctcccacgggtcgagctcgcggttggcaagggaggccacggtgtgcggagcgtcatacgtgctgatcaccacattcggctcggcgattccgacggcggttagttcggcagcctcacgtggcaggtcaacggttcgactggacatattgactacgaccaacaacttctcagcgtcgagctcacgggtaaaggcatagacgtgcggatcagcggcgtcaatcagtcgccagtcgccggcggccacgaccgggctgttgtgacgcagcgcaacgagttgcttgtagaaggagtacaccgaatccggatcatcgaattcaccggcggcgttgatctcggcatgattcggattcacggaaatccatggctcagtggcggcgtccggagcggtgaaaccggcgtagccggaaccgtcccattgcatcggagtacgcgcgttgtcacggctgcgcgcggccagaccggccatcattgactcagacgactgcaccttggcctcctcgaccctctgccggtaggcattcaaggattcaaggtcacggtactggtcgagacgcgtgaagtgggcgtcggtcatgcccagttcctcaccctgatagatgtacggggtgccgcggtgcatgtgcagcatcaggccaagtgccttggccgaacggacgcgggattcctccgcggagtcgtcgccccagcgggagaccacgcgcggctgatcatgattgccggtgaacaagctggcccatcctgcgttctgcacggcagtctggtaaccggccataatgctcttgaatttcggcaggtcaagcggcagcggcttccacttggtaccttcgcaatcaaaatcaacatgctcgaacaggaagagcatgtccaattcaccgttgcccggatcagtgatgtgctcgttacgctgagccgtgacgcctggcgcctcgcccacagtcaggaagccttcacgcccctcgaatacctcacgtcgcatttcagccaggaattcatcctgacgggggccgtccgcacagaacggattcgggttggaatagccctcctcgcccacaggaagatcctcaagctccgagccgtactcgcccggcagcttgccgttcgaatcggtgcgcttggagatcagggtgatgacgtccatgcggaagccgtcgacgcctcggtcaagccaccagttcatcatgtcgtacacagcgcggcgcacggcagggttctcccagttgaggtccggctgcttcttcgagaactgatgcaggaagtattcgccacgctcggggcagtattcccatgcggagccgccaaagtaggagccccactgattgggctcggcgccgggctcgccgggcgtggtgccgggacgagccggacgccaccaataccagtcggcgtgttcgtcgtctttgttcttggatgcttcaaaccaggcgtgttcatcggaagtgtgattgacaacaagatccatcacgatcttgagcccacgcttgtgggcctcggccagcagctcgtccatatcgtcgagcgtgccgaacagaggatcaatgtcctgatagtcggaaatgtcatagccgttgtcgtcttgcggagacttatagaccggggatagccacagcacatccacgccaagatcagctaagtaatcaagacgcgacgtgatgcccttaagatcgccgaatccatcgccgttcgtgtcttggaaagagcgcgggtaaatctgatagaccaccgcgttggaccaccacggattgggggtggcgccgttggtgcggatggcgtcggggattattgcgcggttgaaagtagtcatcattggctccttattgatatctatattgctcgttgctcacagtctaaaaattggcgaattacattcccattggagaactgcgttggtgtgccggaaaataaatatcaatcggcatatgcgctttcatgattgcacccggaaaacacgcagtcggccgtactcgatctcgcaagtatgggtttctcccggattcatatcaatcgtcgcaccatggtcatcgatgatgcggcaagagcgaccgctagccgtaataatgccgatttgtggctgccggcgcaatccgacgaaagcgatgacctgttctgcgccgaatcttgctgtgacaccgagcgcatagtccgtatgttcggggtcattgagcagtgacgcaatgactggtcgggccggctcatcaggacgcggtaatgtaccatcttcggcaagtaaatcacgcaagacagccgcatcagtgtgaccgcaggcatcggaacaatacactggtccgccgctaagcaatcggagcacggcatggactcgcgcatggggatgctccgtccagaacatgtcccaatcacagtggtacagctcccccatcagcagtgcacagtatgcgttctggataaggtgttcgcccagcgaatcaggattgtgcggtagatagtcgtcgctactacgggtgattggcgatgaaggacgatgccaataatcctccggtgccatgcccatgcagttaatcaatgcgccgccgaatcgtcgtgaggtcacttcatcaagcgcctgatggcgtccccaggtggcttcaccgtaactttcggtgccacgaaccattactgacgtggaactttgcgaatccactttgacgaaatcgacgccggcttcggcgagttcgccgtcccaggcatcccagaactgtgcgggttgttcagcacgacttccaggaatcaggcaaccattcgccgtggtggttattgcggtcgggcagctggccgcggctacacccgattcgtccaaaccattccaatagccttggaacgcctgccacacgcctacgctgcgcacgccatagtgcgttttgagcagcgcaatggtgtgggcaagcccgtgggggaaacgttggcgatccgcgccaaagtcgatcagggtttcctttgtgcgatccgtgttggaccaaccgtcatcgataagcacccaggaaatgggcacatgcttggcttggaactcctccatcttgttgacgatagcctgctcgttgacatctcgccccaatgaatcccaagtacaccatcccaacccggtgagcgcatccgggaatggacgctccttacgggtgcgaatacccagctggcgtgctgccgtttgtgtggcagctcgaatggccatatacgggtcggatgcgcaagcgatatatgcggcagtgtcacatagagtcgtgcgaccaacccggttggaagacagcacgagccgcaaagccgtgtcatcagattctgttgcgggctgcccactgaaatcagcccgaatatccgtgccgcagatagcgaccaacactagccactcggcatcttcggcatcgttgttgcggcgtaacaataactgcgtgcgttcaggcagttcagatggtgtacgcacccaggtcgggcgcatccaccactccttgtgctggtatagcgccagcatggtgtcatcgttgccgctgtcgacgccggccatggtgagcgacacgtcaatcgcatggtggggctcaaacgcttgttgttcctgaaaggcagcggcgcggtccttgggctggggtgcatgcgcgttcacatcgatacgccagagtcgcacctgagcatcaccctggatacccgcactggacgtgcactcgtcttcgcatgattcgggaacgattgtgacggcttctaccggcagttcacagattgccgaagcctgttcgccatagacggcacgaccgatatcaagatgggccgttaccgtgcgaacggttattggacaggtttcggcaatcattggcgtaactccttggtgttcttcaatgagattatgctggcaaggcccagacggtagcagctggaggaacgctctcgacctgagtgttcgcctgcacagtcgcgtcagacacaagtagcacggtcatcggctgcggcaaggcgactggttgactgtcagagaagttcgccatcacaaccatgccggacggcaagcgccaaccaagcagcggcgccggacactcttcgttggtaagccacgagaactggaagtccgtgccgttggccacccactgtttgcgcaatgcgacagcagcacaatacaggtgcaggacggaagccccgtcaccaatctgacgattagtggcatactgcgcaaaccatgccggctggggcagccacgaagcaccggtggcattgaagccgaacgccgggccgtctgactgccacggcagcggtacgcggcaaccgtcgcgccccttgaaataatgaccggaacgttcccaattgggatcctgaatttcatcttcggtcaaatcaaagtcctccggcaaaccaagctcttcaccctgatacacaaaggcggtacctggcaggccgagcatcaccagcgctgctgcacgggcacgacgagcggcgagcgcggggtcaatcggcggattcgtgccgttggacgtcacccactgctcgatgtttgcaccgctcggcagtccgagacgcgaggcgatacgtggcacatcgtggttgccgagcacccaggtgggggcggtttcggcagcgagagcatagcgatgcgtgcgctcaatcgtggtgcggtattcttcgcgattccaggcggcctttgacatggagaagtcgaatacggcaccaagttcatcaggcttggcgtattggaaaatacgggtggtgaatggcgaccacgattcgccgaccgcatacttggctggcgtgtactgattgaacaggtcgcgccattcacggtagatatcatgcacggcgtcgcggtcccagagcggatcggagccatcggtagcctgtggagacatcagtgtcgggtcgatacggtcgcgcagcggctcacgcaggtctttggccagaccgtgcgagacatcgatgcggaaaccgtccacaccgcgatcgcaccagaatgtgagtacacgcaggaactcatgccgcacctcgggattgtcccaattgaggtccggctgctccttggcgaacagatgcaggtagtaccagccgtctccacacgactcccatgcggaaccgccgaagttactcagccagttggtaggcggcaattcgccgtgctcccccttgccctgccggaacacataccgttgtgccgcttccgattccggaccttgagccagggcctcttggaaccaacggtgctgatcggacgtgtggttcggcacgatgtccacgatgatgccgataccgcgttcgtgcgctttggccactaattcgtcgaactgatcgagtgtgccaaggcggggatccacatcacaatagtcggcaacatcataacctccatccgccagcggcgatggatagaatggagaaagccagagcgcgtccaccccgagcgcctgcagatagtcgagacgatcgatcacgccttggagatcaccgttgccgtctccattggcatcgctgaatgagcgggggtaaatctggtagatgacggcgtcgcgccaccagtcattgttggtgaaagtcatatcgttcccctgtccgattgctcggtacgtatggttttaccagtatggccgcacgaaacactgttccggcggccataccctacatcctcttgccttcggatcagcccttaaccgagccggcaagcatggcgcggatgaagtagcgctggaggaagatgaacaggatcatcgtcggtgccatgatgagcagtgcgcccgcgttgagcagcaccacgtcggtctgatactggccaacgaacgactgtagggcacctgccatcgtgcgcttgttcgggtcgttctccaacaccacagccaacaggaactggttccaggtggccaggaaggtcagaataccgagcgaggagatggctggcagtgccaacggcagctgaatggaacggaacgtgcgcagatggcctgcaccatcgatggatgcggcttcgatcagatcacgcggcatctgctcgaagcaggagcgcatccacacaataccgaacggaatattcaggccgatgagcggcaggatcagggcaagacgggtattcagcaagcccatgccactgatctcgtagtacagcggagtgaccaaggtttcgaacggaatggtcagaccgacgaggaacagcacgtagatcaggcccttgcacggcaccttgagctgagcgaaggcataaccgccgagcgagcagaagatcaccacgcagggcacgaccacgatcaccagaatgcagctgttgagcagcagcggggtgatgtttgccatgttccaggcgtcgatgaagttctcccagtgcgggtgggcagtgaactggataccttcgggcatggaaccttgcggctgcaatgccgcggagagcatgctcaggaacggcagtacgcagaagaggacggtcagagcgagcatcgccgtgccggtgatgcgaacggctttggattgctgcatggtcactgctcctttccgttgaccagacgctgcagaggtccgacgaccagcagcacgagaatcatcagggtgacggcgagtgcggaggccaagccaacgctctgctgggtgaaggccaagcggtagacctgcacgccgggcaccatggtggaggtgccggggccgccctgagtggacatgtacaccacgtcgaagctggcgagcgcggagatgatggtcatggtcaggcatacgccgatttggccgcgcagaccgggcaacgtgatggagaagagctgacgccaccagccggcaccgtcaagacttgctgcctcgtacagggactggtcgatgccgccgatgcccgagagcaagagcaccacacagaagccgagctgcagccagaaaccaatcacgcctaccgcgttcagggaggtggattggtcgccgagccacacgtgggcgaagtcgccgaggcctactgcgcgcagcagctgattggcggtgcccttgtcggccagcatccaggtccaggccacaccggctgcagcgcctgggataacgcgcggcaggaacaggcaaacctgcgcgaaggaacgaccgaccttggacttcatgtctttgatgagcacggcaatgatcaggccgagcacaatcgggatgatggagaagaagatgatcaggtagaaggagtgcagaattgatccgtacagatcggggtcggtgaacacggtgatgtagttttcgacaccgatgaaggtgctagcatcgataccgttccactcgtagaacgagtaccagatggtctgaatgatcggccacaactcgaaggcgatgtagaacacaagcgccggagcgaggaaaagcaggctgaccagaccgagggacatattgcgcttgggcttgaccgccttggctgccttatgggaatccatgattgtcaccacgctttgctggtttggtgtgaactgggaatcgaacatcgcacacaacgtcgtgcgcgcgatgggaaggaaccaggcggagcgggaaaaagggaagaacactccgcccggtaagtgcaagggttacttgacctccttctcgtactgagcctgaatggattcgacgaatgccttgggggtcatcgtgccgtcaatcagggactggaagccggggataatggcgctggcctgcatacctgcggtggcgttgttgatgtagtcggtggtgttaccggtcttcaccagaccttcgtaggcggtaaggacctggccgagaagctggttatcggtgctcggagtctcgccttcgccgaccggcgggtagccgttgtcaactgcgatctggcgggcttcgtcggactggaggaagtcgaggaaggcggctgcagcgttcttgttcttggcgttggccgggataccgaaagcggtcacggcgttggctgcggcagaaccggaatcggccttttcgccggggaaggcgatccagccggcgtcatcgccaagtgcatcgttgatggaggcggagtaccagctgccggaggggaagaacagggcttcgccgttgcagaagcggctcagtgcagtggaaccgtcaagggcgagcgcgtcggaggagaagtaaccggcatcctgccagtccttgatcttctgtgcagccttcacggcaccgtcggtgttgaaggtggcgccatccttctggataatccaatcctgcacggtatcgcgaccctcatagttggtgagcaatgcctggtagatgtaggaagtgccgccttccttggccggcatcatcatggcgagcttgccagcgtcggaggccttcttcatatcggcctcgagctcttcgacagtggccggagcctcggtgatgccgagttccttggcgactttcttgttccagtacaggccggtcatcgagacaccgtccggcactgcgtagaggctgccggaaccgatcttaccgtcggagcccacgcggtagacctgagtctgggaatccggcagcttccaaccgtaagcatcggcgtaagcgtcaagattgacgacatggttgccacgcacagcggagttgatgtcggtgatacgggcaatgtccggggtgtcggcggcggagatgatgcgcgggccattctgctgggaggtgttgtccggatcgtaggtggccttgatggtgatgttcgggtacttcttctggaaggcttcgatcagctggtcatcaaaggtcttcaggccagcgccgtcccacagcttgagctcatacttggtatcgccaagatcagtgctcaccgcttcggtttcggtgttggctttgttgctggacgagcccgggccgcaagcggcgacggatgccaggcatgccacagacatcagaccggcaataacggttttggcggttcgttcgatcctcattgatcattcctttcttccttccgggcgatcccggctatgtcttccttggctatctcggcttagcgtatttgctaagcgcttatgtatgaggataacagatgtcgaaccggttcgtcaaatccgcaacacgcaaacaaatggccgattcccgaagaaatgaggaaggcttgacgttccccataggcaagcacttccttctcgcgaaattgcaacatcggtcccttaaatacctaagcgcttattcattcacctaggatgacgtttcgaaggctcgggcagctcgggaaaaattgaatgtggctcaatttgataccagtacgccacgctagacacatcatcctgacgctcaaatgcaccttcatatcctgaaccaatttgttgaagcgtgactctaagctcactatcaaacctgatgggatcaggaatatgccatcggtacaagccacgcataggtggacaataatcgtcatgatattggtttgctatagccccatcgcgcacagaataaaatggatatcctacatatggggcacaaaaagtacgctcgcgcgtatgaccatctcgctgctcagcgaagctccatgcaccgccaaaataatcttcggtgccggtactacacactgtgggataatcgttatcgccatctaggaaaaacttaatctctccctcaccccaccaatatcgttgcaacgtagaaatagcaagatatgtgccgacgtaatggccccgtccgctgactccatcgaggattacatagtcctcgcctaaagtagtgattggctgtctgcgccattgcgcatggaaataagccatttcacgggaggaatacgcattacccaatgcataatcaatctgataaaacaaagccggaatagcatgagcgtggtcattgcgcactacgatacgtgcccgtttacgaaacggcatcgtgaaataacaattcatacctcgtgtaggtgccaccacaataggctctgagaacacatcgcaactttgtccaaagccgcaacagaagaagtctcctaggggacattccacagaaggtcgcttttcatcatcccaatagatggcaagcaccgcatcgcgcagaacgtatcgatcagcgtcactggtgcgatccgtaacggtaaaccacatgtgccgaatacaaccggggccttcaatatctgccaatgtcacagactgcccgggagcaatgtcattcaaacacggctttcccttgcgcgacggccccaacggaccagtttcacggcaaccaaaacccttggctcccgttgggttctccgcattaatcgaacatgttacttcgtcgcggacagtcggcaaatccgataaagttcccgcgtacggtcctgccatcatcataggttaactctcctcaattcaagcgtcgctagcgaaaccggcatatagttgaagctgtttctaccgcttcgcttctttgtcatattgcgcctgcacattctttgtgaattcctgaggcgtgatgctgttatccagcagtaactggaagttagggattagcccacttgactgcattcccgcagtagcattattaatgaaatcgctagtatgaccgctcgtcagcacgtcggcataggcatcaaacatactctgctgcaatgcgctattcgccttgagatccaaagtagatgattttggcaaatagccagaattgtcaacaataatctgttgcgcttcggcactttgcgtataatcgaggaacgccgcagcagcatcacggttcttagcattcaccggaataccataaaatgcacctgcattagcagcaacgttcggctcatcttcactggtggcacccgggaaagcaaagaactgaacatcatcacccagcgctttggccacagtatccagattccaattaccgctcgggaaaaatagtccttcaccattgcagaacctgctcagagcagtagaggcatccactgcgttaacaccttcaggcatatatcccttgttattccaatcctgcaaggtggacgcagcgtcctgcgccgcctgattgtcgaaggtaccagatttctgcaaaatccaattctgcacatcttccgcagaactgttattagccattaacgcctgaaagacaaaagaggtaccgccatccttggcatatgtcatcatcggcagtatgccggcatccttggctgtctgcatatccgcctcaaactcctcgacagaggtaggagctgcatcaatacctagctgctcggcaagcttggtattgaaataaatgccagtcaccgaataggagttcggcaatgcgtacaaatcaccgctgccgagcttgccatttgaatccactcgatacaattcagtctgcgaatcgggaacatcccagccgtacgcatccacatatgcctctaaagacaccaaatggttgccacgaaccgctgaattcatgtcggtgacgcgggcgatatccggcgcatcttttgctgaaatcacacgcgggccattttgtccagagacattatccggatcatattgtcccgtgatggtgatgtttgggtatttcgcttcgaacccggcaatcagcgcctcatctacagccttcagacccgctccatcccacaaagtcagctcatattttttattacctaaatcagtgctgacctcagtaggatttgtatcacttcgtgagctacttgccgagccgggaccacatgcagtcagacttccagcgataaatatcgcagcaagcgccgcgccgctgttacgcataatcctattcatcggttacctccttgcatcctcatcatatgcaatcgatatttctctttactgtcaccatttttcggcggcaataaaatatatttgcgatatcgattacgcacatcgtacatctttttgcggaacccgtcaaccttgcatcacaccaatggtggccttaacttcaaaatccagatacaatacaatcgattacgcaatgcaggagatcccatgagcgaaccaacaatctatgaagtagccaaggaggctggagtctctgcggcgaccgtatctcgtgcaatcaacggacgtgaccgcatatcggaaactactaggcaaaaggtatttgatgcatgtgcaaagttggggttttcagcatcgaaaacagcctccatgctgcgaacgggaaagacaaatcgtatagcacttaccgtaggtaactcactggctggctggttcagttcacaactagccgaaggcgtatattccgtgctcgcatcccaaggatatgacttgctatcataccgacttgcaaacgccgatcaaagacgcgatttcttttcctcaatgccagtgaagcgcaacgcagacgcggtcatcatctcctccttcgacatcagcgagacagagaggcgaaccttagaacaactcggtatgccagtcatcggtgtcaacaccatcgggcttacggaacagcgagatatgatttccatcggcgtagacgaaattatagcaatgcgacaaaccgttcatcagctcgcaggactgggacatcgcaatatcgcctttatctgcaagcagcaagacagtaacggattcatatgggaagctgaccaacgtatagaagggttccgtcttggcatggcggctgagggactcaacttgcccgacggatacatcatcgcagtacaggacaacgaatttgccggagcagaggcactcagtagcctgctcgcactctcccctcgcccaaccgccgtatgctgcatcagcgacgagaatgccattcctctagtccatgcgcttcgctcatacggattccgcgtacctgaggacatatccgtcatcggattcgatgactggccaatggcacaagcgctcaatatatcaaccgttcggcacgaccctcggtcctacggagcattagcggcagatgccgcaatccgattatcacgaggcgaaattctgacagaaagttgcatcgttgttcccacgacgctcatgttgcgcggcaccacaggcccagcacctcgagattaaacatcgacaacgtccgcatttgatgatgtgcatatcattattgcaacagcgaaacaacaggtaccagccagaggaaggacgaccgggtaacagccacaaggcggccacccattcaccatgaaacgcgcgaccatcaacgacgtagctctcacggccggagtctcaacttttaccgcatcccgcgctttgcgaggtaaggatcacgtggcagcagctacgcgggataaggtgctgaaagcggccaaagagctgaattacaccgcgtctcgctcggcggcggcgctggcaagcggacgcaccaatcgcattgccatgctggctcgcgaacggctggccggctggttcatgggcgaattattcgacgggctgtatgacgaactgagccgcgcacgctatgacttgaccgtataccgagccggcagcgtcgaggagcgtgcggaattctttactcggctgccaaccaatcgtaacgccgacgccctcatcgtatccggattttccgccaccgatgaggaagccgacacgttggccagcatgggtatgcccatcgtctcggtgaattcgccgtatatcagctgctgccaagcctccgtggccattgatgacgaggcggccgaagccatggcagtgcgttatcttgcggccctcgggcatcgtcgtttctgctatgtggggcgcaccgatccgctgaccggcaaggaatggggattcgatgcacgcgcacgcggatacaaagatgagatagtctcgcttggcctcaccgactgcggcatccacttcatcgactcggaatcaccacgctcggccaaacaagtcatcgccaccatgctcgcgcagcctgagcggccgaccgctatctgcgtgtggtctgactactacgcattgcgcgtggtacatgagttgcaggcaatcggagtacgaatccccgaagacgtttcggtctttggctttgatgggtccgacgtggcggaatccattggattaagcaccatggtgccaactcccccgcgcgaaatcggacagattgccgcgcgcaaggcactgaatttggttgaggggaagaccttggacgaccctcatacgactgtacctgtggcggtcgagcccggcgcgaccagtgggccagtgcgggaataggcgatatgggaaaagcccccctcggcggaaaaccgaaggaggcttgggtggagctgcactacttcacagcgcctcgcatgactccaccgacgacccacttttgggcgaagatgtagacgatgaggatcggggccatggccatcaggtagctggagaaggccatcgggtagttggtggcgaactgcgagctgaagacgtactgggcgagcgggatggtctggttcgactggtcggtcaggatgatcaacggcaggaggaagtcgttccaggcccacagtgcggtcaggatggcgatggtggcgttaatcgggctcatcagcgggaagatgatggtccagaaaatgcgccacgtggatgcgccatcgattcgggccgcctcttccagcgaaaccggaatcgaacggatgaagccagtggcgatgaacaggttcgtgcccaggccgagcaccgtgtacagaatgatcaggccgacctggttgtccaggtgcagggagcccatctgcttcgcaatcggcagcatgacgaccgggaacggcacgaacatggcggcgatgaagaagtagtacaggaagcggaagaagcgcttgtccatgttgcgggccacggcgtaggccacgaaggtgttggtcagcagggtgagcaccacggcggccaccgtgatgatcgcggagttgagcgcggccttcgggtagttgaccttggcggaggcgtcggcgaagttgtgccactgccacgaggtgggcagggcgaaggtgccggcttcggccggagtcttcagcgcggtgacgatggtgaagtagagcgggatcagaatggtcaggctcagcacggccacggcggcggtcagccaccagttgatcttgtggtccctgcggaacttggcgggcttgccggacttggacggggtaactgttgcagtagtcatttcttatcctcccctaaatcagatctgttcctggctgcgggagatgcgcagctgtacgaaggcgatgatcgccagcacgatgaagaagagcacggcgtttgcggtctggtaggcgtactcgccaccggtcaggccacccttccagatgaggtaggtgacggtttcggtggaggagttcggaccgccctcggtcaaggcgacgacctgatcgaaggtgccgagcgcgttcttcatggacagcacgaggttgatggtgaagaacggtccgatcagcgggaatgtgatcttccagaacttctgccaggcgttgacgccgtcgatggcggcggcctcgtagatttcgtcgtcgatggtctgcaggccggcgaggtagatgagtaccgagtaggcgatgccctgccagacggcgaggaagacgattgggatccagctgagttgctcattggtcaacagcgaggtggacagccacttgatgcccagcgccttgccgagctcgggcagcgggttcatgaagatgtacttgaacacgtagccgatgaccagcacggagagggtgtaggggatgaagaagatggctcggaagccattcttgaaggcgatcttcgagttcagcagcaccgacaggaacagggcgatcacattaatcagcaccgtgatgagaatggcgatgaggaacgtgaacaggtaggcatggcccactcggttgtcctggaagagggcgatgtagttcttcaggccgatgaacttgtaatcgccgtagccctgcgagttggtgaaggaatactttacgccatcaagaaatggcaggtacaggaagaaggcgaagatgatggccgccggaaccaccatccagtagtaggcggggtccactttgcgggtggagaaggcggagaccttcttcttggccggtttcttggcagcggtcttggttgcggttgcgtgtgacatgatgttctcctctcctaccgatcactcgaaggtcctggcttggaccttgtcccattcggtctgcatctggttcaggaagcggtcggtgttgccggaggtcaccatggtctgcaggtagccgccgatgttgatggacgaaggaatgtagtggtcgcagaagtcggccagtcggttttcctcgaagaacgggcgcacggtttccagcgcatcgttgccgaagtaggtgtccttcagcggcgtgatggcggactgggcgtcggcgtaggcgtcaagctgatccttctgcatgaggaactcgacgagcttcatcgcttccttggggtgcttggtgttcgcaccgatggtgagcatcacgtcgtcgccggcggtgaggatctgctcgctggcgtcatcggtggccggcatctgggcgaaaccaagttcgatatcggggttgatcagcaggatctgcgggatggcgtaggtgccgagcgggatgatcgcggccttgccttgggcgaagttctgcgtgccctgctggtaggtgacgccggtgtccgcagtggagtaggtgaagagctcggattccttctcgactgcggtcttccacagttcctggaacgtggtcttgccttgcttgagctcggtgtacttcgattcgggaaccagcgtgccggtcagggaggcgagcggtgcctgggtggtccaggcgtcggccacggaaccctgcagcgggttgatgccggcgtccttgaaggtgttgagcatatcggtgaactcgctccaggtggtcggcggattctccgggtcaaggccaaccttgcggaacagagccttgttgtagatgtagccggaggcgttacccgcgaagggcaggccatacaggcgcttcttggaggaatcggtggtctgcaccagattcttggcgatctgcaccatgccggggttgagggtgtccacaatgggttcatcggtgaagtcgtagaacacaccggaggcggcgaagttgccgaagctgatgtcgccgttgaaggtgatcacgtccggcacacgattcttgacgaaacgggtgcgcagatcggtctgggcgttggcggagttgttgatgttgaccttgatggtcgggttctgcttctcaaagtcggcgaccatggacttgaactggtcggcggcctcggacttgaactggaagaaatccagcgtgacggtgcctgcggtgctggagccgcagcctgccaggccgaacccgacggcgatcgcgcacatcacggcggcggtgcgcacggccagacgcttcagtctaggcgttgcatgtggggaatcggacagcataattgttgactcctttatctttcttttcctccggcttcggtgccggcggttcttccactttccaaggtaacggttcggccatttcattcccagcgccagcgagcccacttgcgcaagcaacaaaaagcgcggtattttgtgattaacgcaataaatacagcgaaggggcttgcatgtctgatgtcaacgcgattccacagtggttttccggatccgagcatacgcatcgcgtggcggcggcaattgcccaatacgggccgatagcccgcactacgttggcacagatgctgggactgagccaaggggccttgtcccgcatcaccagcgatctgatctacgccggggtgatcgaggagcttccggccgaggccggcccgtcaggcaagctgcccgagcgattcacgccaagggaaagttcggatcgtcgcggacgcccgcagacttcgctggtgttgtgttcgaacgcacgcaccttcattggtgtcaaggttcatgggatgtcgattgtggccgctgcggtgaacgcgcatggcgaggtggtgtccggccggcacgagatgccgatcggggcggatcagtcggctgagtatgtggtgtcggccatcacgcggctggtgcgcgaatgttccgccgatatcgcctcttccggactaccctcccccactgcggtgggcgttgcggtaggtgggcatgtggtcgacgattcgattgtgacgttcgcgccgttcctgcattgggacggggccacggacttggggacgatggtcacagaggcgaccggcctgccgtgcggggtgttcaatgatatcgattctctgctggtggatgcctcctggttcgggccgggtgtcggcgtggatatgttcgccgtggtgaccatcggcgtgggtgttggttattcgctggccgtgaacggcaagccagtgcagtacccggataagagctatggtctggtgggccacgtgcttatcgatccggaggggccgcgctgcaccagcggacatatcggctgttcacaatgcttgactgacgattcaatcgccgaacagtactctgcgattgtgggtcgcgcggtcagttttgaggactttgcgcgcgatgccaaggaacgcgtgccgcaggccacgcagttggtgaaccggacgtgtttccggttgggatcgctggtggctacggtggcgaatatcgcgatgcccgggcatgtgatgattgccggggagtccgcgtttttggccaagctcggcaccgattcgctacgtgacggcattcgtttctaccgtcacagccagacccagccggtcaagttcacgattatgaaccacgactggcagctctgggccaaagccgccgccagtcgcgtgattgtgaagcatattgggtaggccgttcttggctcccctcagagaggggagccaagaacgttgcttcgccacagttactccgccacgaccagcaattacggacttgcctatcggcaaggctcaatcccaccttcgctcagctgtcgcttcgctcaggccgtggctactgacagcctactaggctgtcagcttaacgccacagccttgagcaatactgcctgctgggggtggagggacgggggacgaatgccgtagcgctgcagggcttcgccggtcaggactacgccttcctcgttccaccagccgagagtgctctggccgttggtcagaccggtcaaatccaagctcgggtcaagcgggctgacacggtaggtgcgctcggggtcaagtccgggcagatgcacgggcgcggccggataggtctggctggtggtcagctgggtgaagcggtagatggcggcgtcacggttcggcatcaccataccgtccagacgcacggccggatcgttggagtcggcgtgcacgcaggtgtcgatggcgaaccagtcgcggtgcttcttgaattcggccacccacacggccagcttggcgagcgcctcgtccggctccttcaacaggttccattcgatgcccatgtgaccgaagaacgccatggccatgcgcagttcctggctggtggcgcgctgggtggagtgtgcggggctggcgcccacgtgctcgcccatcatcgccggcggcaccagcagcgaggtgtagcgctggatgtccgcgcgctcgaccgggtccacgcagtcggagacccagatacgatcggcgtgctccaggatgccaagatccacgcggccgccaccagaggagcagctttcgatctcaaggcccggatgtgcggtcttgaggcccttgaagatgttgtagacggcaagggtctgcgcgtgcacggccgggcggccggagcggcgggaaccgggctcggtgacgagcttgttgtggtcccacttgatgtagtcgataccaagctcgccgacaagctggtccatgcagccgtagatgtagtcgaacgcatccggattggtcagatcgagcacctgctgagtgcggccctgcagcggcagtcggccagcggtgggcgagagaatccaatcagggtggttacgggccacatcggaatcggggttgaccatttccggctcgaaccacaagccgaattccatacccttggcgtgcacgtagtcggcgagcgccttcagggacttcgggccatcgggccagacgtcctgcgcaatctgccagtcaccgaggccggaggtgtcgtcgcggcgggaaccgaaccagccgtcgtccaccacgaatcgttccacgccggagtcggcggccttgtcggcgagcgccttcagcgtatcgaagttgtggtcgaagtacacggcttcccatgtgttgaggatcaccggacggccgtgcgagaacaggcgcgggtgcagggagcgcacgtaggagtggaatcgggcggcgatctcgttgagaccatcgccataggagccgaacagccacggggtgtcgtaggagttctggccttcgccagggccagcgagcgtcacttcgccgccgaacaggagttcgccgccgccgatcacgccggttgtgtagggcagacgttcggcggacagcacggagttgccgctccagcccacgtgcaccgaataggcgtcgccatgctcgaagccgaaaccgggcacgccggcggtcaggagcagggatgcgtcgaagtcagggcggccggcgagctgcggcttttcgaaacggccgacggtcagcggctggcgctgcggactgcgttcacgtagatggtgaccggtggtggtgaggatttcgccggcggattcgggcagcgggaagccgagctcgatcttgccgatctcgagcggggctccggcgtctgcaccaaacaggttggttacggtggccttctgacggaccaggccgccggggagcagttcaaggtgccattcgacttccacgccctgctcctcatcgcgcgcggtgactatgacgccgggcacgcgggccgggccggtggcgcgggcatggccggccacatcggtgtagctttcgccggacacggcatcgagggtggcttccagcacgccgccggtctcgatgttggtcacggtgaacttggggaagagctcgacgccggcgcggcgcagcaccacgcgttgctcgccgatccagctttcggcctgggtgggcaggatggacggccagacggtgtcgtcgagcgcgccggacacgcgctgcggcttcagggcgtcataggcggccagcagggtgtcgggcttggccagcgggcgaccccagtggacgatgcgcggcaggtcgctgccggcaaacaccagaccgatcgccacattggcggcgggctgggtcaggtagacggcggtgagtgcggtaccgtcagcggcggcaccggtgaaagtcgaggtgttctcggccatattgtctccttcgacgtgtgtggattggcattgcactactggtttcgatggtagaagaaatggaatatgttgccttggtgccgcgtgttggttgcgtgaggtaagtaatgcgtccgtgtctatcgccgctgggcgaagaaatcagtcaggatggactgacactcgccttccaacacgccgccgtgcacttcaggactatggccgatatgcggatcgcgcggaatatcccaaatcgaaccgcatgcaccgagcttgggatcccaggcaccgaacgcgatggtgccgatatgggtctggatgcaggcacccgcgcacatcgggcacggctcaagtgtgacggccagcgtgcaatcggcgagattccaggcgcccaaggcttgggccgcctgacgcatggcgatgatttcggcgtgggcaagcgggtcaccatcagcctcacgcgtgttgtatccgcgcccgacaatctggccggccgcatccagcaccaccgcaccaaccggtacgtcaccagcggctgcagcctgaccggccagttccagtgcgcggcgcatcgcctcgtcatattccataccaacgagtgtatgccttttctcatatcgtctcatgatgtgcataatcggccgcaagcttaacgttttcttcatggttcccatatacttttggtggagaaaaatttaagggagaaggcggcaacatggcggtatttgagctcatcctatgcatcattgcggcggtggtggtgagctcgtttgtcagtcgcttcgtgcccaaagtctccacgccgctggtccagattgtgctgggcgtgctggttacgtatctgccgtttttcccggatgcaacgctcgacccggaactgttcatggtgctgtttatcgcgccattgctgtatttggaagcccacgaaatcgataagtcggcgttgctgaaaacgctggatctgagcctatcgctggctatcggactggctatcgtcacgatggcggcggtcggattcactttgcatgccgtctggccgtccatcaccttagcctcagccttagcactcggcgcggcactcggcccgaccgatgcggtggccgtcagctccctcggtaaagaagcctcgctgacgcagcgtcagcgcagcgtgctgaaaggcgaatcactcttcaatgacgcttccggcatcgtcggcttccagttcgctctggccgccgccttcactggagaattcgccgtggggcaggccgccggcgaattcgtgatctccttctttggcggcaccttatttggcctggtgatagcagcagcggccaactggctattcgagaccgtgcgatccctcggctgggaaaccactaccacacgtattctgatggaactgttcctgcccttcctgctgtatttgggcgcggaggaattcaatgtgtccggcattctgtcggtggtggccgctggcctgttcatccgattcgaccgcaccggcgtggggccgaatgtggcacgtacgaatatcgtttccacttcagtatggggtgtgctgagtttctcgctcaacggtgcggtgttcattcttctgggcatgcagctgccgcgcgccatgagggccagctggtctgacccgtatatcagcaataccgtgctgatcggcattattctgctggtcactctggtggtaatcgcgcttcgattcttctggattgcggccatgctgcgcgttgcgcgagatacaatcaccggccagcgccgcaaaatgacacccgaacgctggcgctcggccgcagtgatgacctttggcggccccaagggaaccatcacgctgtcattgatgtttaccatcccgtattacattgccggcggtgcgccgttcccgatgcgtgacgagctgattttcattgcgtcaggcgtgattatcgtgaccttgctgctggccaacttcctgttaccgctattggccccgaaccgtggcaaggatcccagcgcggaaatgattccggtgaccatcgatgtgttacgcgccacggtggaggaattgaccggacgcatcacgccagagaatcgccgtgcgattctgatggtaatcgaccaatacaccaagcgcatcggacgattgcagcagcgcatcggcgataccgatcctcagggattcgagcaattgcagatcgaagcgctgcattgggaaaaggaattcgtgcgcgaccgacttgccgacaccaaggcgcatccggcggcggatacggccacgcaagagctgaacgtcgaagcctgcgagcgcatgcttgaccagattatgaatacgttgcgtcacacttccactgatccgacttcggggcacgcggtatcgcagattcgcggtcgtgtacgcatgttccagcggcagatgagcaattacgccaaacgcacggtgtccaagattcgccacaccacaccattggtgagcgaggaccagattttcgcgcgcacccgcgaactgcaggtcgaggcgattcatcatgttatcggtcggcttattgacgagatgggccaggatacgtacaacaccgagcattgttcggcactgttgctggattatcgtcgtgccgaggcttcattgcaggcacgtccgaccatgagcggcactacggaaaccatcacgcaggtcgaggacgtaaagcgcgagagctacggtatcgaactcggtatgattcaggacatgtacgaagccggcgacatcaaccgagcccaagcccgctccctgaggcgcaacatctacgttatgcaagtggacgctgattccggcatctagtttcccttgctcccttctctgaggggagccaagttggggattgctatttccgtatgattctcttcagtatgtgcagtagtgcttgcagtgctcacttcgctcatgggagaacagtctatgaccgcgccggccacaagcgccctcgatgtccgattgctgtgacggccgcgccaattccagtgatggcggctgactacagcacgccagaggtaatgtcgttgtcgagcagccactggcgcaaatcggcgaactcctcaagactcacattgtgatccagaccgtggtagctcttggttttcagccacgtatgctcttccagccaagcggcggtggcgaacagttcgtatttcgggattacgccatcgttcttgccgtacgtatagaacacggggatatcgtaatcggccaggcgagagtcggcgggggccgtgccgggcacctgaccgggtgtgttgaagccggacagggagacgacggcccggtaccgctcgggattgatacgcaacaaatgcacggcgaccagcccaccttgcgaaaacccaagcggcaccacgtcacggtcggcgggaatgttgtcggccacccatcggtcgactgctgtggcggcggcatacgcgtcgtagtcacgatcatcgccgataggcagggcatcgtgaaaccacgcgtagttgccggggtcgggactgccttcacgggccggcgcgagtgtcagcggcccgcgcagtgccacgaagtcgttatatggagcgatgaggcgcatgatgtccgccatgtcttcttcgctggatccccatccatgcaggcacaggaacagcggatgcgtggcatgctggtcgaagccgccgcgcgaggtgacgctgtgttccacggtgagtggctcgccaaaacgtccgggcacagtggtggattcgcggccgatcagaggctggctggcattcgcttctttgctcataccattccaatatagaggtcttgcgcgctgtgcggaaaacgatggaccatgatttcaatcatattgggtaatccgcgccgaatcgccttgggacttttcaagggataccggcaatctgtcaggcgttaccgctgtctgcggtatctgcggctgcggtgattgtctcaagttcgccgccccactgctgctgcagtgcggtcatcttgctggcctcgccgaacaccatccagcgtttgccgttcagcaatcgccaatcacctttcgtttgctcattatcagcgtattggctcagcagttcggaaatcttgctttcgataggtgcccggctgatggctgcggacgattccgattcaaaggatacgaaggccactctcggatcagtgcacatctgtacggtggtgatgcccggcaaaccgcccgtatcaagcccctgccatccttctttgcacgcgccggcagcttgttcgatgccttgctccatctgtgcggtatcttcgacgggtgccttgtcgttcgactgctgaatcagtccttccgggaacaatacgcccacggccatgccgataaccaagcaaactatggcgcacaccagtgcgatgatgccgcccgcgcccactcccccgtgagtggcgtaccgaggcatggtgactcgcgcagcgatgaccagaatcagggtgatgccgataagcaccgccgccatcaacgcaatgtatcgtcctggcactgccgtcataaaggaaatggcgtaaggcgcgatctcatgaaccgccgaggtggccgataccacgacggctagcagtccgctgacaacggcaagtctgcggcacaatatcgacgttgggctgctggcttttgtagcggcgaatcgccggccggcatcccgtctggatgggcgtcgattctgtgcacgacgtgagctgcgcgaatcgtcatactgaccatcgccgaagaaatcgtagtcctcatcgttgcgggccatcggtgcccccttcctgccgattacacagctagtgtaccgctatggcttgggaatggcggtcattcgggggaatgattcagggcacaaaaagaaccccggcggttgcccgccggggagagaaaggagagagaagaagaaagggggttcaattgtcgggaactgctgcggctcctgatcagctttccgctgacatcttttatataaccactgctttctgggtctacctctaagtttctctgagaaaaacctgagaatacttgcgattgatggaccgcggaagcgtgaggagcctctcacgtttccgcccaaggcgctagacttgaaggcagtatttatttgcccaaggagtttttcacatgctgctgtccgaccgcgacattctcgccgcacagtccgcaggtcatatctcacttgatccgtggacccccgaaatggtgcagcccgcttccatcgacgtgcgattggatcggtacttccgtttgttcaataaccacgcctacacctatgtcgatccggcggaaaaccaaggcgcgctcaccgaacagttcgaggtggctcccgacgaaccgtggattttgcaccctggcgagttcgcactgggttccacgtgggaatacgtcaagttggacccgtccattgccgcccgtctggaaggcaagagctcactgggccgattggggattctcacccattcgactgcgggcttcattgaccccggtttcgaggggcatattacgcttgagctgtctaatgtgtcgacgttgccggtcaaactatggcctggcatgaaaatcggccagatgtgcttcttccagctgagctcgcccgctgagcacccttatggctccaagggcaccggctcgcattatcagggccagcggggtccgacgccgagccgttcctacgagaatttctaccgcgcgcacatcgacgactgagcgttgcgacgtaccattcggccggcggatgccggccatttgcttaatcccaaggagatgtcatgaccaacagcgatggcgggttccagttcgacttccagcagcccgaaaagccggtcaggccaacggttcctccgattcccgggcaagagacggcagcatatagcacagaacccacggcacaagccacaccggctctgcagttcccgcagtctgtgcagtctgcgcagtctgcgcagcccacacagcccacacagtttgtgcagcccgcgcaagtagcgtatgcctcacaacccacgcaagctgtgccgaccgtacaagccgctcagccgacgcagcccatcgatccggccatgacgcaaccgttctcgccgcaattcctggctgcggttgccgcacaagcaccacagccggcggcagccacgcagccagtagtatccgaaacaccaatcgccgctgcgcccggccagcagcaatacgtttgggatcagacgacgcaaagcttccgcccggtggaaccgacagcgccggtgacgccagcagcaccagccgcaccagcggcaccggcgacatcgcctgtttcggtagcttcaaacgccgcgacacaggcgttccaccccaatcaggccgagcagcctgcggtagatgccgaggcaacacaagcgttccagcctgatcaggtcatggcaacacagcctttcgaagctcaggccatgccgaatgccgaaaccgcggccgcacaggcatacggcgcatcatccaccgtatccggtgagaccgttgccatgccggcaacgcaagtagcgtctgccgatgatgctgcagccacacaggtgttccaaccggccgccctggccgcttcggcacaggctcagcctgctgtgatgcctccctccattccgttggatcaggtctccgatgaggacgattccgatggcgccgagcctcgtcacggcggtagcggcaaaaagaacaccagcaagatcgtcggcattgccgtagcagtagtcgccgtgatagcgctggttgtcgccggcctgctctggtggcattccaacagcagcaaggcgagccaagccgtggcattggccgagtgcaaggtagcggccaagcagtacacgaatgctcagaagaagctcaccaccgccatatccaatggccaaaccagcgcgcaaacatccaccagcgatgtggccgatgccaatacgctcaccacgctgaatcaggcgttgcaagacgccggcaatccggctgacaccgccaagtgcgattccagcctcaacgccactgagttgaagtctcacactaaagagctgcagaatgatgccagcgacatggctgacaagacggatgccatcaacaacgcgatcaaggccgttaatacttcaaaggcgacggccgataccaacacactgaaatcgaacctgagctcggctatttcgcaggcgcagggcacgctggataattccgcgggcagtgtggccgatgaaaacacccgcaccgcgctgcaaaacgccatcaccgaggccaatacggtgatgaacgggaccagtccgtccgaatccgacgtcaataatgcgatttctaaactgcagaaggccgagtccgacgtcaccgcctcgatgcaggccaagcagcaggcagatgccgccaagcaagctcaggaagaggctcagcagaaggccgaccaagaggcacagcagaagtctcaagacgagtccaacaatagcgacaacaataacggcggcgacaactccacctctactgacggcaccgacggcagccacaactgaggtctgcagcgttctcctgtttctcatgggcggtaacttcctcatgtggcggctagcacatttccctttttcgcggaataatgccgttttcagcgaccgccccatgggatagttaccgccccatgaggagccgtttggatatagcagtgggccgggctctgaataccagagcccggcccactgctatatgcccacaatcagggctattgcgatggcttaacgcttggccatcgcgcgtagcacaatcttgcgcagttcggaggcaatcagcacgattgcggccaggcagatgcattccacccaagccatcgggctcaatgccacggtgccgaacggaccgttgaggaacggcacgtaaatcaccacgagctgcagcgccacggacaaaccaatcgcaccccatagccacttgttggagaacagacccacgaatgcggactgcagatgcgaacgggaggacagcgcgttgaacagctgggcaaacaccagaatcgtgaagcccatcgtacgggcctcggtcatctgcgcttcatggccgatggcatccaccgagcggtcggtgaacaagccgccggacaggtgcatgtccataccaatcagcgtgacgatggccatgatgacgccgatgtagatgatgtcgccccacatggaggcgtcaatcacgcggtccgtcaccttacgcggtttacgacccatcacatcgtcggtctgcgggtccacgcccatagccaacgccggcgcggcatcggtcagcaggttgatccacagcaactgtgtggcgagcagcggcacggtgacgcccacggtttccggctggcggatgccgaggaagccggcaaacaccacaccgaggaacacggtgaacacctcacccacattggaactcagcaggtagcgcaggaacttgcggatgttgtcgaagatcacgcgaccctcgcgtacggcggccacgatggtggagaagttgtcgtccgccagaatcatcttggcgctctgcttggtcacttcggtgccggtgatgcccatggccacgccgatgtccgcggacttgactgccggggcatcgttcacaccgtcgccggtcatggccacgatgttgccttggcgctgcaaggattcgacgatcttgagcttgtgctcgggggccacgcgcgcgtacacggacacttcggacgtggccttgtcgagcgcggcctcatcgggcagctggtcgagctggtcgccggtcagggccttgccatccttggcgatgatgccaaggtcggaggcgatgcgggcggcggtcagcgggtggtcgccggtgatcatcaccgtgcggatgccggcacgatgggcctcggtcacggagtcgcgcacctcagtacgcggcggatcgataatgccgaccatgccattccagatgagatcggtttcaatggcttcggcctgatcggcgatgtcggacacctggcctgcagcgttgacgcttacaccgggcacatcagccaaagaaccggtttccagcggacggcaggcctcgccaagcgtacggtaggcctcggaggagagacgttcgacggtggcgagaatcgactggcgatcgccttcggtgagcttacggacctgaccacccacgcggatgcgcgtgcagtagctcaacagcacgtcgggcgcgcccttggcgaacacggtgagcttgtctgaatcggtgctgtccttggcgatgatggacatgcgcttgcgttcggaggtgaacggaatctcgccaacgcgcgtgtatcgcttgatcttgcgatcggccttgaccttgcgtgcggccacgatcagcgagacttcggtggggtcgcccacaatctcccaacggccgttctcctcgcgtagttcgccgtcgttcgcgagcgtgccggccacgagcgtggcgacgacttcatcggccacaatctgggcctgctcggattcaggactgacgccgccggtcataaccatgcggccttccggcgcgtaaccggtgccagtgatctgcacttcgccggacggggtgaccacacgttccacggtcatctcgttgcgggtcagcgtaccggtcttatccgagcagatcacggaagcggagcccaaggtctccaccgaatgcagtttcttgacgatggcgttgtgcgcggccatacgctgcacaccaagcgccagcaccacggtcaggatggcggccaagccttccggcacggcggccacagccagcgagacagccaacagcaaggaatcaatcacgtcatggacgtcgttgaagccttccagcacggcgagcgccaccagcaccacgacagcgatgacgcacaccgcaatgccgaggatcttggagacgtaatccatctccttctgcagcggagttttctcatcttcggtggcggagagcatgtcggcgatcttgccgacctgcgtattcataccggtgccggtcacgattgcgcggccggtgccttgcgtcacggaagtgccgttgaagatcatgttggcgcggtcgcccagcgccttggcttcggtgagtgtgtccggcttcttgccaaccggcacggattcgccggtcagtgaagcctcggcgatgcgcaggctggccgcgttgaccagtcggccatcagcggagaccgaatcgccttccgcaaggacgatgatgtcgccggggaccacgtcggcggtgttgatgcgcatgaccttgtcatcgcgcagcaccgaggtctgcggggccgtcatttgtgcgagcgcttcgacggccgcctcggccttggcttcttgcatatagccgagcacagcattgacaatcaggatcaagatgatcacgatggcgtcgaacggcagcacttcgccgccttccgcgccgggctgcgcattggctttttcgatgaaccaagcgatcaccgagataatagtggccgcgatcagcaggtagaccagcggatcttggaattgggccaggaatttcttccatttcggtacgggcggggcgctggcgagctcgttcgggccgaatttggccagtcggcgcttggcttcttcctcgctcaggccgtgggatgggtcgacgttcagggctttggccacgtcgtcggcactggtcagacttggatcagtatcccccaatagcgcttcctgtgcgcgcacctcttccgattccacgaccccgttcgttgcggtcgtggacactgcggattgatctttgagatcatccataatgttctccttggtattgccgcggagtagtcagccttgcggccgctgccgggttttctctcccggctggacgcacaggactgcgcggttatggacaccggcgcaactgctgccgatgcatacgattgccattattccataaccgcgtggcgcacttggcgcacagcgtaatagcgttttgcctagaacaggcgacgcaaccaggcctcagccaaatcaggccaacactgcacgcattcgacgatgtgcgcatagaagccgttaccggcagtttccgcattggccaaggacaggccgtggctgccttcagggaacaggtgcgcctcaatgctcacgccggcggcccggcaggcctggatgagcattagcgtgttctccacgggcacggcgtcgtcggtcatggtatgccagacgaagacgggtggcgttttggcatcgatgtgcttttcgatggagaacttgtccagcaaagcctgattgtgagcttggtcccctagcaggcattggaagctgccgcgatgggcgtacttgccggcggtgattactgggtacgagagcatcagcgcgttcgggcgcacggcgtccgggtctatgccgccctgttcgcggatgtcttcgtcgccgaccgaggtggcgaggttggcggccagatgcccgcctgcggaaaagccgagtacggccacttgcgcggggtttacatgccactgatccgcattggcgcgaatcaggcgcattgcctcggcagcctccagcaaagccaccggatagcggctgggctgcaccgaatagcgcagcacgaatacggcgaagcctttggccaggaattgcagggccactggctcggcttcgcggtcagaagtcatggcgtagccgccgccaggcaaaatcaggatggccgggcgtatacggtccggttccatctcctcgctgttgtcggccacatagccaaagaatcgcgcctcgctgccatcaatgccaacgatggtttgttgaatgtattgcatgccatacatcatacgcgcagagaatagttctcgataagaaccactcgccatatgcggtcttgcccgtatctccaaaccgaataacacttacagcgaatcgtgaagactgcgggccatggcgcggtcgcgcgagcctttggtgagcttgagaccgagggtcacggcaatcaacacaacagtgcaggcgatccacagcgttcgaccgccgaagttgctgatagtccagccaccaatcagcggcgccagcgcaaccgacgccgaccacactacgttgtagacgccctgatacgtgccacgcgccgacgcgggtgccatggcggcaaccgtagtggtggcgatagggaatgtgcccagctcacccagcgtccacagcactacggcaagcgcgaatccgccccaagaatgggccgcggcctgcaccgcatagccgatgacggttacggcgaggcccatcaccagcacgcgtgaattgcccatgcgcgcgaacagtttcatcgcgggaatctgtagcaggcacaacataccgccattgatggtgagcagcaccgaatactcgcccagccctagaccaaggtccgtcatggcaatgggcaggccggaggtgctttggaagtacacaaggaagtagccgaacatcagcagggagaagccgaggaatggagtatcggtgagcacgcgccgccaattgcgagacatggcgcccttgacactggcagccggtgcggcatccgagtgattcggcatctcaatgccggcgaattccgcatgggtaacactgcattcgtcttcatggcgcaccgcacttggcaccgatacagtaatccccaaatgccgcacctcgcggaagaacgcaatcagcaatatcgtgacggctatcatcaccgccgcttcaacgtagaacatcagcgaatacgagatcttgaccagctggttggccacaatcggtccaatcgcgtacccaaaattaatcgcccacgattgcagtacgtatgcacgttgctgacgttcggcaggcaccacatccgcgatatacgcggcgatggccgggctgggcagcgaggcgaacgcaccatagacgaacagagccgcgcctaaagacacaggatcagtgagtacggaaacgaccagcagggcagccgctgcgccgatttcgccgatgataatcatggattggcggccgaatctgtcggacaaggtaccgccgaacaggcagccgatgattgcgccgaagccgtacatggccacgactgtgcccaccacaccctcatcgaggcgcagcgcggaaaccaaatatatcgacaagaatgaggtcacgaagcgacccatccacagaatcagaatcgccaaccataatccccaatacagcagggacagtccgaatatcatacgctgcttcttcactctcaataccttaccggctaccgacggcggaatagccgcgttttggcgcggggtgctgggacaatagcacctatggctatcaaaaaaggaccgaccaaggggtcgggtggcaagcatcgcaacaaactgaagggctacggccccactcccaaggccgaggaccgcgtctatcacaaggcgtacaaggccaagaaagcggccgaacgtcggcagatggccgacccgcgtctggcagcccgccgtcgagtggacaagttcgcttcggcggatacttcggatctggtgtacggccgtaattccgtgctggaagcactgcgcgtaggcgtaccttcttccacgctgtacatcatgtctcgtattgaacatgacgatcgtactcgcgaaatcgtgaaaatcgctggtatgaacggcctgcacatgctggaggccgatcgtctggagatggatcgtatcgcccgctctggcaaccatcagggcgtgattctgaaggtcgatccgttccagtactcctcgctgaacgagctggccgatcgtgctgagaagaaggccaaggcaatggaggccgcgaattcggcggccgcccgtattgctgcgcgaccgctgtttatcgcattggacggcgtgaccgatccgcagaacctgggtgccgtgattcgttcggcggccgcattcggtgccaatggtgtgattctgccggaacgccgttccgcttcagtgaacgccgccgcttggaaggtgtctgccggtgcggccgcgcatatgccggtggcgcgcgtggtgaacctgactaaggcacttgagggcttgaaggagcgtggatactacgttgtcggccttgacggtggcggcgataagctcgtcggcgagactggctttgaatccgatccgctcgttgtagtgctcggttcggaaggcagcggtttgggccgactggtgcgcgaaacctgcgacgcgattgccggcatcccgatcagctcgtctgttgagtcgctgaacgcttcagtggcggcgggtatcagcctgtacgcggtgtccaacgcacggcgcaaggctgcggcggagtgattgtcgcttgaggccgtaataggttgtacatacacggaagcccctctatttgaggggcttctttgtgtgatgggctcacctacagacagtccaccggattgtccgcttaatgactccacactgccgcatccggatcgtcatcggggttgtagccgtcgtcgtccgggtcgctgtaggtggattcgtcgtcaatgacgccggaatcggcctcttcgttaagttcggcgagtgccttggagtcaaggctgtagctcggcagagcgttgtcgatgtagctggtcacggcctcgcccatcggcacgtcgtggccggccttctccgccaggaaccagcgatggtcaagcacctcatggaagaactgagcaggctcgatctgggagcgatattcgcgcggaatcatacgcacggtcggctcgaacacctcacgcatccagtcggtggccacgatttccagatcctcgccctcacgccacgtggaggcacggtaggcgtcaaggtcgttgagcagacgacgggcctggttctcctgcacgtcaaggccggtgaggcgcagcagcttgcggttggcgtagccggcgtccaccacgcgcgggcggaccagcacacgcttgccgtcctcggcggtcttcatttccagctcgtccacgtcgaagcccagctcgttgagcttgttgacgcgctgctcgatcttccacatttcgtccgggttgaacttgtcggtgtcggtcagggcgctccacagcgagtggtagcggtcgactaggcggttgcccacctcgatctcatccacgtcgccgggcagtagcttgccggacgccaaatccataagttcgccgatgatgttggtgcgggccaagtcgatatcgtattcgcgctggccgtcggtgagctgggcttgcaggtcaccggtctcggcgtccaccaggaaggcggagaaagcgtcggcgtcgcgcaggaacaggacgttcgacagggacacatcgccccagtagaagccggccaggtgcaggcgcaccagcagcacggcgagggcgtcaatcagtcgttcggcggtgtccgggcgcaggttgcgggcgaacaacgcacggtacggcagcgagaacttcaagtgccgggtgaccagaatcgcctccagcggctccccttcacgggtatgacggccgatgaccacggcgatcggggtcacagttggcagttcgagcttctgcagtcgacgcaggatctcgtactctcgctcggccacctggcgcgtgatctccttcatggcgtacacctcgtcgcccacgtgcacgaatcgcacgacgtggcgggagatgcctcgcggcaggttggccagcaggtccttaggccaggtggccaagggcttgtgccagggcagcgtgaacatctttgggttcgagctggcggcggtgattttcagtgcttgcggttcggctgaattggcgtgttcgtcttcggctttgacagacgtggccttcagcgcacgcggatccatctggggcaattcgttcaactccatgtgttcgattttacgtgtcgttcgcgatgtgtgctcctttgccacgacttcggcgcgttatgtttacgggaaaacaccgtttggtctctccctcagaccgtctagaaggcaaaagaaaagccccgcagctatgcagggcttttccaacgaggtcataagagaggaagagaataacctcgtttaatggttgacgaagcgattagacctcgccaagtatctattagttcagacgcagctcagtcgacggagcgaacaggtgcatcttggccgggtcgatcttgatcttgacggtcgcgccaaccttcggcagcgcacgcggattcacacgaatcgtggtgagcttgttctggtcggacatgacctgggaagcctcagcggcggagccatcggtgatgatgttgccgtagatgtagccatcggagcccagatcctcgacgttgacgaccttcagggagaaggcgttcgggtcgtcagccggggccaggccagcgtcctcaggacggaagccgaccacgatctggccgttgtcttcggcggtgagcttgttgacggcctcagccggcaggtccacggtgtcctcaccgatcttcgccttgccgttgaccaccgggtgggtgttcaggttcatcgacggggagccgatgaagccggcgacgaagacgttggccgggcgatcgtacagctcggtcggggcgccgacctgctgcaggataccgagcttgatgacggcgatgcgatcgcccatcgtcagggcctcggtctgatcgtgggtcacgtacagggtggtgacacccagctggcgctgcagagcagcgatctgggtacgggtctggacacggagcttggcgtcgaggttggacagcggctcatccatgaggaagaccttcggctcacggacgattgcacgacccatggccacacgctgacgctgaccaccggacagagccttcggcttgcggtcgaggtactcggtcaggtcgagaatctcagcggccttctcgacacgcttgcgaatctcgtccttcggagtgccggcgatcttcagggcgaagcccatgttgtcggcaacggtcatgtgcgggtacagagcgtagttctggaacaccattgcgatgtcgcggtccttcggctgcatcgtggtgacatccttgccaccaatgaggatgcggcccttgttgacctcttccaggccggcgagcatacgaagggtcgtagacttaccacagccagaagggccaacgaggacgaggaactcgccatccttgatatcaagattcagatcatccacggagggcttatcgttgcccgggtagatacgagtgacgtggtcgaaaacgacttctgccataattactaatcctttcagaggcaggtacgtgcctcacgatccgttgtaaagggatttgttctttactgcgcttccgccctcgccaccgacgtacaactttgctttcggaaactgcaagcttcagcgtttacttttttccggttcagtgaaggttctcttcgttgagccgagaactactatacacggaccgtggaccaaggcaagtggcgtgtctgaaatgtagttaactttatgggcgtttctgggggtgttgtgtggttcggcccatgacacgcctgtttctcgaacgtgcgaaccggcacgcccgacgtagagcaggtctgctcttcccggactgatggattccatcagtcgccgactaatgcgacacagactcgaaggtgacgccgttgcgggcggctttgcgctcggccttgcgctcctcggcgtcttcgatgcgctggatgcgcagctggcgccagtcctcgcgcatgtcgcggaaacggtcggccagcgttacgtcatcgttctcggcatcgccatcagtactgctgccatcggccttaccgaacgtgccatcggccttaccgaacgtgccatcggccaccttggcgatgcccagcttgagcagtccgagcaactcacgcaacgtttccggtacgggctcatcgccctcatcggcggacttggtcaggccctcgatgcggcgacgaagcgcgtcggcgtcctcgggatcgatcttgagcccggcgatcagcgactggcgcatggtctcgtaatcgaggttggcaaaaaaattcagctgttgcagcgtcatgaagcccttgagctcggggaatcggtggacgatgtattcctcgcggtcgtcggcggcgcgggtccagtcgcgggtgagctgcggatcccagctggcggtaatcgacccctcgcgcatgcggtagtggtacagcgccttgggcagacggaccacgcgcgtggcctcgccgatcacgttgcagatacgggagagatcctcgattttgcgacccaccgggaaggagaatccggtgccctgataggtggaggcgggtgccaggaaggcccagaaatagccgtcaatctcagccttgacttgctttttgatgacctcgaccggggtcaggacctgcacctcggtgaagtcgttgtggcgatagttggacagcagcggcttgttgttctcggagatggtgtcgaactggaacatcacgaggtcggcgtcatactcgcgcatggcgttcaggcagtcctccaccaacgtgggtgccacggtgtcgtcggaatcggcgaagtatatgtacgcgccgatagcctcagcgataccggagttgcgggcgtcggacaggccgccgttgggcttgtgaatcacgcgtatgcgcgggtcgcgggcggcccaggcgtcgcacatggccgggcaattgtcgggcgagccgtcgtcgaccagcagaatctcgaggttgcgataggtctgcgcaaccacagacttcacgcattcatcaaggaatttctcgaccttatataccgggatgatgatgctgaccaacggctcctgttccatatctccagcgtagcgccgccgtgcgaacgcggcggcgctgcgggttcgcggaccgcgaaacccttagaagtcccagtcgtcgtcatcggtttcttcggctttgcccatcacataggaggagccggagccggagaagaagtcgtggttttcgtcggcgttcgggctcagggcggccaggatcgcggggttcacatcgcaaatctcagccgggaacaaagccgggtagccgaggttcatcagcgccttgttaccgttgtaccgcaggaacttctcgacgtcatcggtcaggcccacgcgatcgtacagcgactgggtgtactccacctcgttgtcgtacagctcgttgagcaggtcgtacgtgtagtcctgcagatccaggcgctcggcatcgctcagctgggcgatgcccttctggtacttgtagccgatgtagtagccgtggacggcctcatcgcggataatcagacgaatcacgtcggcggtgttcgtcagcttggcgtgcgcggagaagtacatcggcagatagaagccggagtagaagaggaacgattcgagcagggtggaggccaccttgcgcttgtacgggttgtcgccctcgtagtagtcgagcacgatttccgcctttttctgcaggaactcgttgttctcgctccagtcgaaggccgcgtcgatctgttcggtggagcacagggtggagaagatggacgagtagcttttggcgtgcacggattccatgaaggcgatgttggtgtacacggcctcctcgtgcggggtgagcgcgtccggaatcagggagacggcgccgaccgtaccctggatggtgtcaagcagggtcaggccggtgaacacgtgcatggtgagcgtgtgctcgtcctcggtcatcttctgccagctggggatgtcgttagagacggggactttttcaggcagccagaagttgccggtcaggcggtcccagacctcaaggtctttctcatcttcgaggcggttccagttgattgcggagacgcggtcgatgagtttcagcggtttgcgcggaatggaaatcggtgccatggggattcctttgcattactcgtcttgggagttgtcggcgggcttgttttcgaactcctccggcacggtcagccggagcagtgctctatagatggttcgtgacattgtgggttccttagagtggcctctggttgttcgatgtgtgcggagaccgccgtctgaggccgaaggcgtacgaaggtacgtcgagtgccgaagaaaggcggtatacgctccatcgaacgatcagagcatgcaggagacgcagccttggacctcagtgccttccagggcttgctggcggatgcggatgtagtagagggttttgatgcccttgcgccaggcgtagatctgagccttgttgaggtcgcgggtggtggcggtgtccgggaagaacagcgtcagcgacagtccctgatccacgtgctgggtggcctcggcgtacgtgtcgacgatggccttccagccaatctcgtaggcgtccttatagtactcaaggttgtcgttggtcatgtaggcggccgggtagtacacgcgcccgatcttgccttccttgcgaatctcgatcttggaggcgatcgggtgaatcgagctcgtggaatggttgatgtatgagatcgagccggtgggcggcacggcctgcaggttctggttgtaaatgccatccttcagaatcgcgtcgcgcagggcctcccaatcggccgcagtcggaatcgcgatgccgtactgctcgaacagcgcacggacccgttcggtgcgcggggtgagcgaacgacgaccatcggtgtacttgtcgaagtagttgccctggccggccgggtgggcgtagtcgctcgtagcgaagctggcgaacgcgcggccatgctccacggcgagcgcgtgcgaggcgcggtaggcgtggtaggcgaccgtcatgaagtacatgtcggtgaagtcgaggccttcttcggagccgtagtggatgccttcgcgggccaggaagccgtgcaggttcatctggccgagaccgatggcgtggccctcctcattggcgcggcgaatcgaaggcaccgcgttgatgctggtgtgctcggccaccgaggtgagtgcgcggatcgccgtctccaccgtgtggcccaagccgccatccatcgtcttagcgatgttgagcgaacccagattgcaggagatgtcgcggccgacatgcgcatacgtgaggtcctcgttgtatgcgctcggctcctgaacctgcaggatttccgagcacaggttggacatggtcacgcgaccttcgatcgggttcgcgcggttgaccgtgtcctcgaacacgatgtacgggtagccggattcgaactgcagttcggcgatggtggtgaagaacttacgggcgtcgatgtaggtcttcttgatgcggtcgtcggccaccatctcgtcataatgctcggtaacggagatgtcggcgaacggcttgccgtacacgcgctccacgtcgtacgggctgaacagggccatctgggccttctgtttggccagttcgaacgtgatgtccggaatcaccacgccaagagccagcgacttgatgcggatcttctcgtccgcgttctctcgcttggtatccaggaagcgcaggatatcagggtggtgggcgttgaggtacaccgcgcccgcgccctgacgtgcgccgagctggttggcataggagaaggagtcctccagcagcttcatgaccggaatcacgccgctggactggttctcgatgtgcttgatcggggcgccgagctcgcgcaggttgctcagcagcagggccacgccaccgccgcgcttggagagctggagggccgcgttgatgccgcgcgaaatcgactccatgttgtcttcgatgcgcaccaggaagcagctgaccggttcgccacgctgggccttgccgaggttcaggaaggtcggggtggcgggctggaagcggccggcaagcatttcgtcggcgtattcgatggcctgctgctcattgccggcggcgagctccagggccacagcggcgcaacgctgcgggaagtcctcaagatagaggcgaccatcgaacgtcttgagcgcgtaggacgtgtagaacttgaacgcaccaaggaaagtgccgaactcaaagccggcggattccacgtgctcgtagatgcggtcgaggaattcagcggagtactggttgaagaccgcagggttgtagtactggttgctgatcaggtattcgagacgctcggcggtggaggcgaaccgcttgctgttggtggccacgtgccctgtcacgtattcgcgttcggcggccttgtctttgtcgaactggatcttgccgtcggcgtcatagaggttgagcatcgcgttgagcgcgtggtaatcgtgcgccgggtcgtactgttccgctgcggtgtcggcagtattgtcgagcggcaggccggtggcggtgaggtcagtcattggaaatccttggaatatggcagaagtgtgtttactcagacagttgctcccctcagtcaacttcgttgacagctcccctcggagaggggagccaatacctcgagggggtcaagatttactgttcggtgaagaagcggacgaggccgtttcgcacggcggcagtgtcttccggggtgcccatgagttcgtaacggtagaggtagggcaccttgcatttggcggcgatgatgtctccggcggcacagtaggcctcaccgaaattggtgttgcctgaggcgatgacgccgcgaatccactcgcggttggctggatcgttgaggaagcgtttgacctgaatcggcactgctttcttgaccacgccgccgccataggtgggcaccatgatgacgtacggttcgcggacgtttagcgccgggtcggcggcccgcaacgggatgcggtagacgttgatgccttcgtcctgcaaacggcatccggccacgaaccgtgcggtgttttcggaggccgacgagaagtagaccaatgcgccgatcgtcttgccttcggccgcgaattcgggctggctcagactcacgcggacaccgtggcggcggcgcggttgtcggcggccacctgctgggcgacttcgcgaatcaggtcggggcggtagccggtccaggagttgtccggcgtgatgaccaccggagcctgctggaaaccggcggcctgcagctgctcaagggtggaggggttctgcgtcaggtccacggtttcaaacggcacacccagcttggtgagctggcgcttggtggcatcgcactgcgggcaatgcggcttggtgaacacggtgacggtcatggcgactccccttgatgtggttctgatgaacagtgaagcgaaggccatattacagcggtgtgatttgaaatcaaggcactatatgtagtggcgcgtgtcacataacaaacctagatatagggtttttcgttgatattccgccattcccatgcacccccgaaaatcggcgtgcagcgacccgcccaatcacatgtggcattgttcacatttgcgtttgaaccgctcttcgactgatcctcaaccgccctgcaaccgccatcttgagtttcgaggggctgttttgaccctttccggagatctatctccgtttcgaggggctggtactcaagtaagcgcatccccaaaatggcggaatgacggtggggcgaagccgtttatacccgtgttctagcgggccaccagcccctcgaaacgggagtaaacctctacggaaggccaaatcagcccctcgaagcggagaacggatacctcggcaccccgtgtggagccagaaggcccggccggatgtccaaacgagcatccggccgggccttaaaagtagttgttcagttatcagaatcgatgcggcgcgatactactccgcgtctttacggctccaacagatcttcgatgcggcagccaagcgtgcgggccaaagcgagcacggtggagacggcagctttgccaaggtctttgcggcgctgctcgtacatttggatggagcgcagggtaacgccggagcggcgggccagcccggattggctgagtccggcgcgcacgcggatcgtgtgcagccgggagtcgccctcggtgcgattatgggcggcccgctcgtcgtacacgtcgacgaatcggctttcgtcggcttcgtgcagagtcgggtgcagtcgcacgatatcgtcgagcgacagcacatcgagaatgtccgagaaccgcactcccctggcccattggcagtatgcgagtacccatccggcccagtattcgggtgttgagccggcgcgcagtgcggctggcggcatatcgagaatgcgcgcccaaccggtttgccgcatgatttcggccaccagctcctcgccggacatgccacacacgtatttgggcgtgcctcgcccgaaaagcgcggccgcctcggaggtggcgaagaagtccatgaataggccgaccggcaacccgcaatcgttcagcgcataatcgaaggcgccggccaagttggccatggcgtccggcaagtatgtctcatcataggcggggatcatcgttggtcactttctcgcggatgatgtcgcgcatgaacaggccgtcgagatcggcttctgcacttttgcggcggtaggcttcgcgagctgtgcggtcgcgctcgttacgcaatccgtggtaggtcgaagcgcgggcgatttcgcagccttggaaccgcagtgccgcgaatgcctgaggactggcgagtacgatctgcttgccgagctcgcccaaccgcatcgcctcagcgagttggtcgatggaaatcgcgttattgacaaaagcgcgggcgaacgagaaatacgaatcgtcggcacgatatccgacgatgacgtcagcctgactggcatccggcagaaacacttgtttcagatattcgatgccttgcgcggcgacggcggtggtcggctggaaacgacggttttcgaccagcatggccagccagttcaggatggtgtagggcggctgggacaggtccaggaagaggagcccgtccgtggtcaacgtgtaccgattcgcgaaaccgtcatccattcccgcgcacgcccattccttggccagctcgacgctgcgcgtgcaatagaatccgcggccataatcgttgttcggcttgaccagcccgtattcaggatgcttgatgacatgcgaagagccatgccacagttcgatcgatgcggtctccattggccggctccttctctctccttacatattcttgattatatcactgtggtgatagtcataagggaaatacgagatgaaaaataccgctgtatacgttcgtacacaacgtgaaatgtatacgaacgtatacaacactgatgtccggagtcatgctccgcagtggcgcagcggacgcgccactacaatcggaatatgggactgaagacgtggaagaagtggacggactggccgctgatggtgctgtccgtggtgtttctggtggtgtattcgtgggaaattctctcccgcacgcatatcgcgctgtgtgaaaccgtcatcaacgtgatctgggtggtgttcgtcgtcgattatgtggtctcgctgtggttggccgacgatcgctggcagtggttcaagcacaacctgttcacgctgctgaccatcgcgctgccgatgctccggcccttgcgactgttgcgtttgctgaccgtgctgcacgtgctgaaccgcacctccggcatggcggtgcgcgggcgcatcaccgtatacgcggtcggcgcggtgggaatgctcatgtacgtgggcgcgctggccgtgtattccgtggagcgcggggcgtccggatccacgatcaccgacttcggcacggcgttgtggtggtcgttcgtgaccgtgaccaccgtgggatatggcgacttctcgccggtcaccttccaaggcaagatcattgcggtggtgctgatgttcaccggcatcgcgttgatcggtattgtgacggccacgctggcctcgtggatcgtggatcaggtcaatctggagacggatcggcgcgaggacgctcgggagaaggaagtggccaaggaagccgcgcaagaggctattgcgacatcagccaatcccgaaatcgacctattgcgcgaggaagtgcgtgagctgaccgctacggtagccggtctgcgcaccgaacttgagcgacgttgattggcgaagcgggacaaacaacgattctgccaagaaggtccgcgtcagttgttgtcaccgcggattgcggcagaatcattgtcgccacggctgttttcttcagtcggctcaacccaacttttgataatttttatttttttgatatttttgataatttttattttaggttgattcagcgaggaggcggtccacatgaaggcaaaggaaaacccattcaagccaacggcaggaggggaaccgcccctgctcatcggccgaggcaaagttatccgcgatttcgagaaaggtctcgataacggagtcggtgccccagggcgcattatgctcgtcaccggcgctcgtggaaccggaaaaaccgtgatgctcactgtgttcggagaccgggccaaagcgcgcagatgggatgtcatcgaagaaacggcctctgccggactatgcgaacgccttgttgatgccttacgaatcgggcgaggggcccttgaccacctcgctatccgaccatcgttgacttttgctggagcgggcatcggcctcggagaagccgaactatccccgaagcgtatgcccgaaacgttgagaagtgccattgccggacggttggatgcgcttgagaagcgccatgctgggttgcttatcaccattgatgagactcaagcggctgagcgatccgacatgattgccatcgccactgccatacagcatcaaatcagggaacgacgcaatatcgccatcgtgttcgccggtctcccacagatgatttctgatttgttcaatgacgaagtcatcacgttcctacgtcgcgcgaaaacgaacatactcacagatattcctcttgatgaagtgcgcgatgctttcgccacaacattccgcgcctccggcatgtccatcaccgacgctcaattaagcactgcagccaatgtgacagccggatacccctatatgattcaactggttggctaccatatctgggatgccgcagacatgcgggactcggataccatcatcgacgctgatgttacggcaggtatcgaggaagcacgtattgaccttgataacgccgtgtgcatcccggagttgcaaggcttatccaaaaacgaccgtgagtatctcgaagccatggcagcgtcagatggtccctctcccaccgtgaatgttgcacagcgcatgggcaaaacgcctaactatgccgccacctaccgcaaacgcctccttgacgccttcgttatccgcgaaacagaacgaggcgaagtcgattttgccgtgcccttcctgcgcgaatacttgcgtcggaatcagtaatcggcacaatgcacagtatcgatatattccgttccatataatgacttttcgcattcagatacacaatggacggcctgttgagtagcactcagcaggccgtccattctatttagctattcagttatcggagacacacctcaggccttgaccggagcgtcagcgggagccgatgccgccgcggccagtttgcggcgcttgaggtacttcatgatggtcaggaccatgccgcggaagccccactcgccacgcaggacagtgttgagcagtccggagtgggaaccgccccactccataccgatgtagttgaaggcgctcatcacggcacccgcgccgccctgcttgacgctcatctcgaagggcttcaggtagatctcgcgaatcgactgctcgttggcccaggtggcgagctcgctcagtcggttggtctcctggtcgttcagcgcgaagtgcttcatgaaggcgtacacgcccttggcctgagcgccagcgacctgctgggaggccatcacgccgaacaggtagccgtcttcggagaagtattcgaaggtacgaccggcgaagtcgcggcattcgaatctgatatcgttatcgattcgatcagcggctcacgatactgcccttgcatcgctgtgccactgttgaatgtgcccggctggctcacctttgggtcaccgccgacacatccttgatgccgatggttatagagtcgcaaattcacgactggcgcacctgcccacgcacctatcctgtcatttcgagcgcataatttgctaccacatccggtcagggcaatcgaccttaatggcgtaaacggcacttctcaatacgtaaacggcatttattcttggctcccctctcagagaggggagccaagaaatatcaagctcggcctcccaggagagagccagaataatgcaccagcaaggcattaggatggagggcatgagcgatttgaacgcgttgaatcttgagtccggcgaagtggttggtgggtatacgctgatctcccggctcggctcaggagctatggggtcggtgtggcgggtgcgcgacgacggcggcaccacctatgccatgaagattctgcgcgactccctgaccgacgagtcagtggcaggctccggctctgcgtccacggccctgcacgaccccgacctcaagcccgatgtcacgccgcgcgagcgcctgcggcgcgaggccatggccttgaagaaggtcaatcatccgggtgtgtgcggcatcgtggatatggaactcgacgatacgttggcgttcatcgtcactgaactcatcgagggcaagaatcttaaggatgatgtggccgccaatggccggtatgtgggcgacgatctggaacgcttggcccgcaagctcatcgaagccaccaaagccgtacatgcggccggcatcgtccatcgcgacatcaaacccaccaatgtgatggtgtcggccgccggaccggtattggtcgatttcggtatcgcgatgggcgagggcgaaagtcacgtgacccgcaccggcctagtgatgggtacacccggattcatcgcacccgagattattgacggtgccgaatccgacgacgccaccgattggtggtcggtggcgtccgtgctcgcttttgccgcaaccggcgcgcctgtgttcggcaccaagccgatgatggcggtacttgagcgcgaggcctcgggcaacgcgaatctttccggactaccggccggcacattggctgccttccgttctgcactggacccggatcgcagggatcgttgcacgccggatcaattgctgaatgccatcgccttggatgcgttgaatcccaacgcttggcagggcgagcaggcgggaccgttcgccgcgggagccgtggctggacaaccggctgcgatcgttgccgaagccgcggaggcgatgcccccttttggcgcggccggcggcgttgaccgcaataatccccgaaccatctggcgcgcggccgaggaagccgctgaggctcccaccatggccgtgttctccggcaataagggcgataacggcgatggcgaaaccgtcgtattctcgccggctggcgccgctaccgccacgctgcccttagccgatatgccgccacgtccgccggccggtgcggagcaggccacgccgctggccgagcgcaccaccgtactccccacgccgcagccgtcatcattccccccgtccggcaccgcccagagcagctgggatcccgcaagcaaccagcccacagcggtggaccccgccattcgcccggcattgcagcgcatcatcgaccaaaccgcccaagcggcccccaccgaaaccatggtccaaaatcctcccatgcccaatccggtggacgtgaagcgaggggaatatctgcagcgcggcaccctgccattgatcctgctggcggcgccgctggcggcactggcggcaaatgctccgctcgtggccatcatcgcggccactgcgttgttgtggctactgctcaccctggcctataacaccgaaccccagcttgagcgcgagggcaaacgcggcggcgagcgcaaaaactccgattcgtggattcgcgtggcgacttttccctggcatctggtcaaagccctgctgctggccattccccgcatactgctgctagtcatcatctatatggcgggaaccgccgtggccaccgcggctctggcactgcccgttcacaccatctcctggtatttcaccgcggattggggtattccggtgccgttgctcaatgatgtgccgttctccgcttccgggctggcgctgggcggtttcatggccatcggctggctggtcactgtgttcgccccacagtcgatgatgattcggctggggggcggcgtactgcgcgggctcaaacacagtcgcccggcgggcgcgccatccaccgaagtgggtggggctccacctgctccagtggcgccggcgcccaagggcggcgggcgcggcaccgtgctgttcaccatatgggccatcatcaccgtggccttgtgcgcgatgccgattctgggcatgccgatcaactggatgccgttcgcctagagcggggcggaatctcacacatcagccatccgcacacatggccgttgtgtatccgatacgttcgttccgtcacacttttacagggaattcacctcagatcagctctgggcgcagtcctcctcaggcccggtcattatgatggggcccaaacattgaagcgattgcaaggggatagctatgtcagatccgaagcgtcaggccaagcgtgccacacgcgctgagcgccgagcgaccgaggaggccgcccagcaggcacgggccgagcaggcagccaaggagcgtaagcagcagaccatcatcggctgcattgtggtggccattattgtggtgctggtggccatcgctggattcgccgtatacaaggctatgcggccgtccaacaccagcagcagtagccagcaaagcaacatgaccgtggacgaggcctatagcaagctcaagaaagtcagtacccagccggctaacgccgacgacaaggccggcttcgtaatctccaacaaagggtatggccagaaagccgagggggctcccaccgtatccatctacatggaaccgctgtgccccggctgcgcctcggtgaaccgccaactcgacccgacgctcgtcaagctgatgaacgcaggccagctcaacatcgatttgcacttcctcaatttccagaacaacaagagctccgacaactactccaaccgcgtgttcaacggtgccatctacattgccgagcatgatgacgatcccgaccacctcatgagctacctctccaacatctacgctgaggatttccagccgggcgaattgtccaattacgagccggtaaacaacgccaagctggagaagcaggccgtcaaggccggcgtgagcgaggatgtggccgccgcggcgttcagcggcaagaacgaatacctcgactggctcaccgcctccaacaactacacgatcctgcgccccgaactgttcaacagctccggcgccttctccgcccccacactcaccatcaacggcgaatactgggatctgaagcagctcacgctggcggacacgaatatggtggacggcttcctcaagtccattgggctggatgctgaccaggtaggcgtggaaggcaaaatgccatccatcggtgccagcggaaagccgatttcggtcgcctcctgatgctgcgtggccgaataagttgacgccgcgacatatgcaataccgcctgcggctcggcttaaattgaccactcgggaagtaccggtatactagtcatttgttcgcaacgatttacgcgttaagaacaatcgcctctttagctcagatggccagagcggccgccttgtaagcggcaggtcgtcggttcgatcccgacaagaggctcgacgcgtagaaaagtggcgtattatatgatacgtagatttttctacgcatataattcttaccttgggtaagtactccaggagccttcccccaactatgggcttcctggaatgagggcggagcgtcccccaaccagctccgcgccttcaggggggcgggaacatccccttctctcccgccccctttttcttttcttttttgagctcagaacaatctgacgagcaggaatggtgacggtggccggtgaaaccgcagtacgggccggaacaaccgttacgatgggtggcgtaatcgttcatccagcaggaagagtatggcaatggcacggcgttggaccccgcagcggtttgttacactgcgtcgcatccgcgtaatcgcctgtatcgcggcgaccagtatcgcgctggctggatcattcgcgttcaccgcgcgtaaatccgtggccctgaacatcaacgggcaaaccacccaagtcaccacatatgcgatgacggctacccgtcttctggaggaacaaggggtggatatcaagacccacgatatcgtcactacctcgtccggcgaccaactcgccaatcatgccgtggtcaccgtacagtccgcctaccagaccaccatcaacatcgacggcaccgccgtgccgttctggaccgtggccaccagcgccgaccagctactgggatttttcgaggaaaaccagaacaacgccgcgaagatcaccgtcgacatcaagaacgtgtacaaccagctcaccggcggcctggtgatcaaccagtccgggccggtcaccgtcatcgccgacggcaaaagctcggtggcccccaatggcaagctgccggccgcctccatcctcgattccaagggcatcgtgctcaacaaggaggatcgcgtcagcgttgagaaagacagcgacgagaccattctgcgcgtacgccgcgtgacccacggcgaggagacgcgcacgtccgtgattccgttctccacccagaccatcatcgacccgaatctggctgaagggcaggccgatgtgcgccagcagggcgtcaacggcgagaagacgcaggtgtacgacgtcacctatgtggatggcgtggccgaatcggagacgctgaaatcggagaccgtcacctcgatggccatcgaccagatcatcgccgtaggcgccgccaagtctgataccgataaaggttccgataagaaatccgactccgccgataacggcaaggccgattccggttccaacaatcagcacgagtcgtccaacaacaatgccggcaacaccggcggcaacaactccggcaacaccagcaattccggcaacaccggcggcaacaactccggcaacaccggcaattccggtaacactggcaacaccggtaacaccggcaactccggcaacactggtaacaccggcggcggtacgaacaacaattccggctcttctggctccgattcaggcacaaccaccacgccctccggccgcctgtggcacgccaccgtagcccaggctcaggcctatgccgccggtgccgccgcgcagcgcgggtggacaggcaacgactgggattgtctggtcaaactatggacccgcgagtccagttggctgtggtatgccgaaaacgcaagctccggtgcctacggcattcctcagtcgctaccagcagacaaaatggctgcgttcggtgccaattaccgtgacgatgccgccgtacagatcgattggggtctgtggtacatcgcacaagcctacggcagcccgtccaaggcatggcaacattccgaacaagtcggttggtactgatcggttacgaagcccacaaggaacacacgcttatgaacgacaccattcccgccactggtcacctgttaggtgccgccgatatccgtcgtatcgcggccgatgccggcatcagccccaccaagaaattcgggcagaacttcgtcatcgaccccggcacggtccgtcgtatcgtacgcgaggcgggagtgaccgctgccgatcatgtcatggaagtcggccccggcctgggatcgttgacattggcgattttggaaaccggcgccaccatgaccgcagtcgaaatcgatccgccgctggccgaacgactgccgggcacagtcgccgaattcatgcccgaagccacgtcacgactcaccgtcgtcaatcgggatgccttaaccgtcaccccggagaacgtgcctgatttcagcgatgacgcatcgtttacgctggtcgccaatctgccgtacaacgtggccacgccgattctgctcacgctgttggagcgtttcgacaacctcggctcgttcttggtgatggtgcaaaaagaggtggccgacagactcgccgccaagcccggttccaagatctacggcacgccgagcgtgaagctcgcctggtatggcaccgccgaacgggtgggcaccatcggccgcaatgtgttctggccggctcccaatgtggattccgcgctcgtcaaattcacccggtatcaggccgatgacccggctgccccgggaactgcgaacagcacagacgacggcacacaacgggaactcgtatttcgtctgatcgatgcggcattcggtcagcgtcgcaagaccctgcacgcggcattgaagaccattgcgccctccgaggcattctccatcgccggcatcgatccgacccgtcgaggagagacgctcaccatcgccgaattcaccgctctggccaaggccatcgaatcgtgtggagatggagatgaggcacaatgagtccggtaatctcacatccacgctcagccgctgcccgacatcagtccgatgagctctcccccatcaccattacggtggattgcccggcgaaaaccaatctcaccttggaagtgggacctgctcacgacgaatggggcggacgccacgaactggacaccatctactgcgcaatcggcgtatacgacaccgtcaccgcaaccgccaagcaacccggagcaggattctctctggagctcgaaggcgcttatttgggcgacttggcctcctcacgcagcgacatgcgccgcaaccatgcggtactggccctcttcgccatggcccaggcggccgagcgcgagccggatgtggcgttgaccatcaccaagcgcattcccgtgggtgccggactaggcggcggttcagccgacgccgcggcgaccatgctggcggtcaatcgtctctgggagctgaactggcccatagagcgcctgcgcaccattgctgccacgttgggcgcggacatgccgttctgcctgaccggtggccttgcatacggcaccggtttcggcgaacgcatcacggatatcgcccccggcagccgcgatgagctggcgctgatagaacagggattcagcggcgaagtattggtcggcgcataccagtcgcaactcagcactcctgaggtctaccacacctttgacatcgtgggagccgcagaaggcgaccgcaatcatctgcaggctgcggcaatcagcctgcatccccgcagcgggcaggccatcgacgccgccacgcaggcgggtgccagccatgcattcgtctccggatccggcccctcagtggtcgctttcgccgccgacgaggcagcggcacaacgcattatcgaggtgtggcgcgatacagctgtggtcgatcgtattattcgagccaaatctcccgaacaccccaatatcagcgtcagacagtgacgctaaggtagcaaccagccacccgacccatgaaagaagtccaccgatgacgtatcaggttgatgaacgtgaagcccgcaaggcgtacgtgcgccgccgccagaccatcgtcttttccatcagcggcgcggtattggcagtagtgctggtcatagccctactgttcaatttccacgttttcggcctcggcgaagtggagactccggccagccagccgaattacggcaacgcggcgccgtgcgcggtcaaggacagcagcggcaaagcgcaatacgtgtccaacgcttcggtcggcattcgcgtgatgaacggcacctctcacggccaattcgccaaggccgtgggtgaagctttggccaatcgtggattcagcgtgcagaaaatcgataactattccagcaccgacgttgaacgcaccaccatctacttcggcaagaacgccattaatcaggcgtatacgctgatcggcaatttcaccgacgccaccatgatcatgacggctcgcgaggatcagctcatcgatgtggtcatcggcgccacgttcaacgatctgcaggacaccaactccttcccgcaatccggtaagaccatcaccaatatcgagggttgcaaggccgccgatagcatgaccaagctgcccgccgacaccaaacacgacgcatacacggcgcagtaaggcgcatacagcttcatcttcgcgaaaaaccgtacgctgacacgtattcagcgtacggttttttggtatcggactagtatcggactactgaatctcggcgtaccagcgcttgagttcttcgacggccacatcgtggtccaccggaccgttatccaagcggtattccagcatgtgcttgtaggcgcggccgatcatcgggccgggctccaggcccagcaactccataatttcgttgccgtccagatccgggcggatcgcgtcgaagtcctctttcttcttgagttcgcggacgcgctcctccatctcatccatggcctgggagaagatcatcgccttgcgtttgttttgtgtggtggcatccgcacgcgtgagcctgttcagccgctcatagaggtgcccggcatccttgacataccggcgtacggccgaatcggtccacggctcgtccacatagccgtggaagcgcaggtgcatattcaccagttccgagacgtcctcgaccagatggtggtcaaaacgcagcgccttcaaacgcttgcgggtcattttggcacccaccgcgtcatggtggtggaagctcaccttgccgcccgactcgaaccggcgggtcttcggcttgccgatatcgtgcatcacggcggccaagcgcagcgtcaggtcgggggcgggcaccgggccgtccgggccggtttccagggcgatagcacgttcgagcacaatcatcgtgtgctcgaagacgtccttgtggcggtggtgttcgtcgatctgcaattgcagggccggaatttccgggaagacgatgtccgcaagaccggattcgaccaacgcctcaaggccggcgcgcggacggtcggagagcagcagtttggtcagttcgtcgcgcacacgctcggcggatacgatgtcgatgcggtcgcgcatcgaggtaatcgcctcggccgcgtccggcgcgatacggaagcccagctgggccacgaatcgcacggcgcgcatcatacgcaacggatcgtcgtcaaaggactgtcgcggatccaccggcgtgcgcaacacgcccttggacagatcactggcaccaccgaacgggtccacgaattgcaggtcgggcacgcgcagagccatcgcgttgacggtgaagtcgcggcgggacaggtcgccctcaagcgtgtcgccataattgacctcgggcttacgcgagtccggatcgtacgtgtcagagcgataggtggtgacctccaccttgacctcggtgccgtccgggcggcggcgcatggcacccagcgtgccgaacttgcgccccatgtcccagaagccgtcatgcccccaccggcgcagtatcggctcgaactgctcaggccgtgcggatgagcagaagtccaaatcgtggctctttctatggagcagcaaatccctgaccgggccgccgaccaatgccagctcgtaaccctgttcggcgaacagtcgaccaagttcgatggcttcaggccatacttcgaaatccaatgggcaccttcccgcgtgcgacgtttttctgccctaccagcataccgttaccccacctgcacacggggttgagtaaggtggagaatatgattacgcccgccgaccttgcccgcatgctggggcaaacaccagattcggcggatagccatacccaagaccacctgctgtatacgtccgaaactccgcatcattccgccgattcgggcgattcttccgatgtcggcggcaccgcgagccactccaccaatcaggccgttcatcaagacgaagtagacgcagtaccgactgcgcaacattccggtgtgcctggcacacccgcaacgcccgccacacccgaaccatccgaatccgaaatatcggacgccgccagcgacatgcccgcaccgaagccgatgatgcccacaccggccaccgtcttcggcatgcatgccaccgtcaccatcgccactaccagcggcactatcgaggggcaggctgatggtatcgccggcgaggccggtgccgagacgattgccgaggtcgagccgattatcgccacggcacaaacgtccgtaaccatcgtcacgaacgatcccgcggcgaccgctcacgcggccgtagatgctgccgttgcggtcgccaaggccgccgccgcgcacaccacagcgataccgactccgcgcgacgtgctgatgccgcctgcggcacgtaccgcaccggccgcaacgccggtcaccatgccggtctcagcgccgtctgcagcaccagtgaggcccgcaacgtcagcgcatcccacgccggccacggtcttcggccggcacccgtccggagatgttgcctcgccggaaccggcagtgccggtagaaccggtgacgccatccggcccgactccggccatgatgccgcaacgccgtacgtcggacggtccgaccacattcgcttcactggatgcccaggaactgccggtcgtacgcgaatattcggcaggcggtctgattttcgatgaccagaaccgcgtggccattatcgcccgtcattcccgctccggccatctcgaatggtgcttgccgaaggggcatatcgaaaaaggcgagaccccgcagcagaccgctgtgcgcgaagtgcatgaagagaccggcatcctgggcgaggtgatcgattccatcgccaccatcgactactggttcaccggtaccacgcagcgcgtgcacaagctggtccatcacttcgcgctcaaacagaccggcggtgaactgacggtggaaggagacccggatcatgaggcggaagacgccatctgggtgcgttttgaagatttggatgacgtgttgagctatcccaacgaacgcaaaatcgcgtggctctacgccaggaagaagaacaggcaggcaaacgagtgaacctacccggagtcttacgacattgcacacgtctggcacacgcactggcggccagcgtcgccgttgtggcgatgctggccgctccattgaccgtctacgcgaacgatacgacggacacgactgattcatccgatacgacggacgcaacgggcaatcagaccgagaatcagcccaagcagagcattgccatcacgcaaagcacccccatcgtcacctccaaatcgggctatcgtgtcaccgcggtcatcagcaatacggacagcacggccacgtcaagcggcacactgcacctgaccaccaatgcgttgttcacctttgtctcgcgcaccgatattcagaattgggccgagaacaacgcccccatcccaacccccaacgagttgggttccgttgacgtgccatcgattcccgccggcggcactgccaccgtcaccatcgaggtgaacgccaatcagcagacccttgcctccatagggagttggggaccgaaaccgctgatgctgtcgtatatcgttggcaatcagatactcgccgatttgccgagttttctgacccgatcttcggatgggctcaacaccgcgacaacaccggccatgaacctgaccgtggccatgccctacaccgccagcggctggcaggtcgataataaggccatcagcaatcgcattgccgaaaccaccacttcctcgacatcaacatcgtccaagtccaacagcacggacaaggccgacaagtccgataacgccgacgccagcaacgcggccaaagccactgatacgcaagccatatccttatccgaacaggatgccgataccgcgcgatcccttgggcagacattcgccaagcaccgctcgctgcaagtgatcgcggatcctctgtattggcgtcagtccgcagtgcaaccgtccattgccggcatcatgcagcccgccgacttcgacatcaccgcctataccgcactggacgataccgcggcctacgaaaaggccggcatcaccactgagcagtggaacgccaagcaggcggccgcatggtatgccgacggaggcgactccgaaacaccctccgcgtacgcatggcagggcaacaactgttggacgttggatgcgctgaccgcagcacgcgagcagggctatgacacggtgattgccggtgcctctttcgatgccgaccagactgaagccgtacacacaggcacctacgtggtgcatacgcctgccggcgatgtcaccgtgctgaaggagcaatcgaccttgggcacgctgtccaagggccaagccaccagcacggacgcgcaggccgagtccagcgatgccggtcggttggcccgactggtcgctcagagcgcgttctaccagatggaacagccctatacatcccgatacctgcttatgacgttctcccgcaccacggaggccagctggatagatcaggtgatgagcgccttcgagcaggcgtcttggttgaatctgacggacctgaagaccatggccaaggccgatccgtacaatgtcagcgattcggtcaatcccgacaaggccgatgatgccaacaccgccaatacccggtcggcattgagacagttggccgacagccggcatgacatcatgcgcatggccacctccatattgaggaacgagattgattccgacgaggtctcgtcgttggacccgcaggccctggcccggcaggacgccaatgacaccgcctcgcatagcaacgatccgacgcaatggattggctctttactggtgctgcatgacgatatggcgctgcggtccatgtctggctccccccagccgacagccacgcgaaaagccatggtcaaagccacgaaaacactggccagcgatcttctgaacggcgtacgcatcaacccatcggaatcaatatccgtgttcagcgaatccgcgaaaatgccaatcaccgtcagcaatgaccttccctacgccgtcagcgtgcaggtcaactcactgactgactccatgcagatcgtcacctcgcgaaccgctgacatcgatattccctcgcatagcgacgctcaggtgaccttcaccatccgcgtttccacttccggctcatcgacggcccatgtgtcgttgaccgaccgggaaggcaacagcttcggcaacacgcaggacaccgcgatcaccagtgtgatgcgcatcagtgatgccagcggcttcattatcatcggcttcgccgtgctactgggcattatcggcctgtggcggcagttccatcggaagaaggaccccgacgaatgagttcaagcgtaggtcgtaattccctgatcatggccacgggaaccgctgcttcccgtgtgaccggtcagctccgcacgattcttctcgctgcggccatcggcaccaccggattggcggccaacgcctatcaggccggttccatgattccccaatccgtgttcacgctggtgtccggcggcatcttcaacgccgtgctggtgccccagatcgtgcgcacgttgaaagaaaaagacgcccaagaacgactgaatcgcctgattacgttggccatcggcatcctattggccatgaccgtggtgatggcggcggccagccctctgcttgcccgcctgtacgtgggtagcgacgatcaccagatgatagccctgaccacctcgttcaccctgtggtgcatgcctcaggtgttcttctacggcctgtatacggtattgggtcagatcctggccgccaaagaccatttcctcacgtatgcgtggagctcaaccggtgccaacattattagttgcgccggttttactggctttattctgctgttcagcaaggccaatgaacagcccctcgaattctggaccgccgacaaaatcgcgcttaccgcaggcacctggactttgggcgtggccttccaagcgctgatactgttcctgccgctggcccgtatcgggttcaagtacaaacccagcttcgggcttggcggctttggactcaggtctatgggtcccgtggcgttaggctctttgggcgtggtgatcaccagtgagatctgcggcattatccttacccgtatcgccacatccgcaccgcagcgcgcccacgaactgacgggtgccagcctgttcagcgtggcaggcaacgcgacctatcagaatgcgtacacactgttcatcctgccctattcactcatcgccgtatcggtatccacggctatgttccccaaaatctcccgttccatcgcagctgcgaatctggatgaggcacggcacgacctagtcagcgcactgaataatgtgggcctgctcatcatgttcttcgccgccgccatggtcgtgttccccgaaccgatcatccgtgcattgcttccgtccgtctcgatggacgagactatgttgatctcctatgcgcttatcgccttgtctatgggcattccattggggtcggcgttcctgctgatccagcgcacgttctacgcctttgaggacggccttcaccccttcctgtccgcggtgatgcagtatggattcacctcaatattcatgatcatcggcatgatggtacttcctcctgagcattgggtactcggcatcgcctgctcggtgaccctcggtggattactggcgttgccgctgacgttgatgatgttgcgccgcaagttcgaaggcaatcttggcggtcgggagatcacgaggacatatgccaaggccattgtggcggcactggcttccggagttgtggtctggctgatcaaacgaccggtagtcgcactgctcggcgcggatattcgaccagtaggcgggcacatgagctggtggtctgcgctggtcatctgcgtggtgctcaccattgtgctggccgtagtatatgtggctgtgttgtgggtggtacacaccccggaactcatcagcgcctatcactcgatactggcccgtctacacaagactccggccagtgaggacgttgctgtgacagcccagccggaaaaaagtcgacgctacgtaaatcaatcctgagacggagcccgtcaaggatagccccgcacgtagaatatctaagaccaatctcgaacaccaatcacacggagccgaacgcactatgaaaccgcaactcggagacacgattctcaaccgatataccttggtatcatcgttgcgtgaggagcctggcattcaggcatggaaagccaacgaccgtgtgctggcaaaggattgccagctgttcatcattaccgatcgcagcgctttcgccgcaatcgataagctcgctggtcgcatcgccgccactcgccctgatcgtgtgattcccatactgaaataccgtatggaatccgacgtacttctcattgtcatgccggtggatagcggccaatgcctgactgactacatggtagataccgccaagccgctcagctacagcgccatccggtcgattatcggagaatgcgccgacgtgctgcgcgaggtcattgcggatactcccagcggcatcgtcatcacaaccgacaccgttcgagtgactacctccggtgtgcaaattgccgatgcaccatgtgccacgatgctggccgatacgtccgctaccgatctgcgtacggacggtcctgaacggtatgcgattcgccagcttgcggcattactctataccctgctgacacgcacgccaagccaagcgacacccacattcaatctgcgtgccttgccgcaagacacccctggcgaattccgcgtgatttgcaagcgtggattggccttgagcgagcccgacgatcatacgttgccaatggctgcccttgtagaactcgacgccttgttgggtaattggaagccgctctctgaactgagcgatgctgatattgctttgccgagcgtggaaagcgattgctcgattaccaaggcgatactgaagcctgccaacgagactgatatcgtgcctattcccagcacgttgattaacagcagcagtcttccggaattgtctattaccccttccctgccggttcagacggccgccgtccccgctccgcacgcgatgtcaccggttcctctgcctgatgggtccagtactgctgacggtaaccagtctcagtctgatgcccgccgtctgtttgacttcaacctttctgacgcctgggagcacgaaaatctttccggtgaaggcaccggtgactggtacagcgaaatgaatccggcccccatcggcggtccgggtgataatactcggttgacagtgcctattgttaccggcggtattcccgatgccaccgtgggagagacaaccagtcgtattcccgtgttcgacgccagcggccgtgctgtggctcctggtgaggaatcgctgcgtgccttggaagaggagcaggcccgcattgccgaagtaagcgccattcctccgagcttcacaccgaaggatgtgccggatgacgaggttgacagcaagctgcccgatgaacatctgttcggcaaactgtcgaccaaggtcgttgccatcattgtggctctgatattggtagtggcagcggctgtttgggcagtgcatgcgttccgatcctccggagacaatcctgccgatgcttccagcaactccagtgaaggtgactggcctgatatcaatgctgacgctgtgccatttggtggcagcgagaacgcgacgaacggtggcaccactgacgattcttcaaaatcgagtgatgccactcagagcgaatccaaggactcggcatcagacaagtccaagaagtccgagactgctgattcgtcgtccaagaagaccaaggccaagaagtccggcgataaggattccagcgctgttccgcaaccgagccatgagaacaacacggcgtttacgatttccagcgccaacttcctgtcgaatcctggcggccaatccgggtacgcatactacatgcaccttgaccagccgcaggatgcgtaccgcatggttatcaccatccgcacatccggtggtaagggctatattcgcgcaaataccactggggaccccactcaaggcaagcaggtggccgaattcacctttgctgaaggtggtactactgaggtgaagttcaccaaagccgtcaagacgcaggatctgctgctgtgggtgccatcggatagcctgccgcagaaccagctgtacatcgaaaaggtggaggtcttctaatcggcatctatgccgataactgacccaagaaggggcggtaccgttcgcatacattcgacggtaccgccccttcttcgcatctggctgaatgacacggaatatcgtatgggggtgtgacaatgtttcacgtgaaacataacgtcatcattatcggttctggtcccgctggctacacggccgccatctatcttggccgcgcaggtctcaatcctgttatggtcactggtgcgttgtcgccaggtggacagttggtcaacaccactgaggtggagaacttccccggattcccggaaggtattcttggcccggatcttatggatcgcatgaaggaacaggccaagcgcttcggtacaacctatatcgcagacgatgtctcttccatcgaggcgtgtgagagtgattcggtcaagccgacctatcgtgtaacactctccgatgactcccaattggaggcatcgtcgcttatcatcgccacagggtcgtcattccgtaagcttggggtgcccggcgaacaggagctgtccggacatggcgtctcgtactgcgccacctgcgatggcttcttcttcaggaacaagcctatcgtggtcgtaggcggtggcgattcggcttttgaagaggcattattcctgacccggttcggttcttcggtcaccttgattcaccgacgcgatagcttccgcgcctcgcagatcatggtggaccgagccaaagccaatccgaccatcactctgatgaccaacacagtggtgacctccattaccggcacctcctcccccacacagaacaccggtgcacctattgccattcctggcttgacgctcaaacgaccggctgtagcaccggccagtgtcagcagcatcgccgtacgtaatgtggtgaccggagaagaaagcacgctggacaccaacgccgtattcgtggctatcggtcatacaccagccactgattttgcggccggtgttgtggaccgtgacgatgatggatatgtcgtggtgcagggtgccagcacggtgaccagtgcgccaggcatctttgctgcaggcgattgcgtggatcgtacttatcgtcaagcgatcagcgcagcgggcatgggctgccgtgcagcgctggatacgcaggcctatcttacggactgatggtggcggactgatggtggcttgctgttctggctgctgcctgtgacataggagcaacgctaggtcagtgttacagcatgccgcccttggatagtacgtatcggtcaaaggcatagaaagacccctcaggcgacggagaatcacgatgtgtgattgtccctccagcctgaggggttttctattgcgacaggggctacagcgcgggcatacgcccctgccaggaatcacgcagaggctataacgtcttgcgcatacaacgcactgcacagcaataatgccggcgacaacacgaatgttcttatcgtgttacacccatttggaatcggcatcgccttggctcggcaccagcagctgcaggatgcgatccatatcctctggtgacgaaaagacgatttcgatgcgaccatgcttggtgctgcccttaatcgacaccttggtatcgaaatgattttccaaactctgctggatggcggaaccaacccaaggattggtcttagacgtcttaggcttcttcggctgctcccccgacgcaatcttcatggcgacgatttcttcggtgctgcgtacagaaagaccttccgcaataatacgagaagccagcttgtccatttcctccggatcgctcaggcccaatagcgcacgcgcatgaccggacgatagcacaccggcagccactctcttttgcacagaagccggcaggttcagcagtcgcaaggtattggcgatttgcgggcgagacttggacaccgacttggacagttgtacttgtgtcaacccgaactcttcaatcatctgctggtaggcagccgcctcttccagcggattcaaggccacacggtgcaagttttccagcaatgcatcgcggagcatatcatcatccgcagtggttttgacgatggcgggaatcgtctccaacccagccaactgagaagcacgccaacggcgttcacccataatgagctcatacgggctgtccaaatgaccggcaaacggattcgtgctggattccgtctcgtcgtgcttggcggctttggccgcagcaatctggcttgccggacgcttgcgcacgactatcggttgcagcacaccaacttccttaatggaagcagacagctcattcaactcatcctcgtcgaagatggtacgaggctgatgtgcattgggcccgatatcagacagtttgagttcagccagataaccaccggctaccggcttgagctcgtccttcttatctgtgtcagcggtctttgccgccgatgcagtcaaagatgtttcacgtgaaacatctttgacagtgacggatgtacgatgtgccgtctgagacgcagacgacttgccgccctgctgaggtgcggcgaccttaccggtttgaggtttctccgtaccgaaaaacaggtcgctaggatgagtaatggtgtccaatgcgggcatggatgcgcgtttaccggcggctttcttgactgccttgctggacgatatcgtctgaggcacggcaggttttgattcctgctgggcagtagccttcttggcgggggttatgtcagcagtggcctccggagtagacgaatcctccgcaatcattgcgggctgctccgccaccggctcctcccctggcaatgtggggaacaaagcgccaaggcccttaccaagtcgtgattttgatgccattacttgttcctcctcgcatcaatggtgtcaaggacttgttgcgaacgctgtgcgatttccaaagctgcttcaccatacgatatggcacctatgccacgaggatcataggcaatcaccgattgggagaaactcggcgcttcggagatcttgactgaacgcgggatggtggtattcagcacaatgctgggatagtgtcccttaacctcgttatatacttcacggctcaataacgttcggcgatcgaacatcgtgacgagcatggtggacaccagcagtacgggattgaaatgctcttgcaccaaaccaatcgtgttaatcagctggccaagaccctccaatgcgtaatactcagcctggataggaatcagcatctcggtcactgcacacatggcgttgatgaccaagaggcccaagctgggcgggcaatcaatgaacacgtaatcatagtgtttatctgattgacgtaggtagaggtctagggcctccttcagcaacgtgtttcggttgggcagatcagccacttccaactcagcaccgctgagatcgattgatgcaggcacaacatcaagtgtgggaaaatcaggacagaccgtgataacatcacccagatcggaacgcccctcgataacgtcatagaccgagggctctcccgatgcatgagatacacccaacgccgtagaggcattgccctgcgggtccatatcgatgaccaacacctgcgcgcccttgttcgccagcgccgcagcggtgtttaccgtggatgtggttttacccactccccccttctggttggccacggcgatacgacgagtccgttgaggctttgggaaatcggttttcttgagtacatcgtagcgtgagctttcatcagccatttggctaccaagcactgaaccgtgaccatcgaatattcgctgaagcgtttcggaagccgattctataggttccgactgatgatccttggtggccatcgctcctccttgcacagacgtaagttccagtgttctcattcgtatggacatgatgctcgttatccacaattgcgatatgcaatgtggataagtgtggataagtgtgaatgacgttgagtgttagattatgtattcacagacgaaaaacattgaaaaatcaatgttttcatcattatgcacatcgtcccgtaaaaatgtggataacttttacgcacatatggaaatgtggataactcaatcagtactccactcatcgcttatccacaatcaccacgtgggtaggctcaagatccggcccgacagccgcctcaacgacacgtggacgacgaccaccgaattttgcaatctccttgccagccttgtcgatttcagcctgagcagaccgtcccttcagtgcgatcaactgtcctgacggtttcagcaacggcaacgtccagccagagagtttggtcataggagcaaccgcacgacacgtgacaacagcgaacggatgaatttcccgcttccgtacctgctggatgacggcatcggagcgtccacgaataatctcaacgttctgcagttgcatcaggccaacacattcatgcaaccattcgattcgccgctccatcggttcaatcagcgtgaagtcatgatccggcaaacacgcggcagccaccaatccaggaaaaccaccaccactgccgacgtcggcaactgttttgaagcgaataccattcgtcgcattccgaacgtacggcacaatcgcagcggaattcagaatatgccgttcccaaatgatatcgacgtcacgggggccgatcaatccacgaggttcaccctcttcggcaatcttggcatggaaacgctccaacttcagcaacgcatcacccaagacctcagcaagtacaggtgacccctgcagctgatccgtcatagccatctccctcaccatgtttcacgtgaaacaatcaacatggagaatggcgccgctcattacgacgccattctccatgcggtcactttagtttgttcaaagacgacatccgtcgaacgtccctgtcatctcaaaaaaactcgccgagcaattactcctgatcaagctcgtcgtcttcggcggtatcctcgactctattcttgagatacaccgtcacgtaacgatgaggctcctcaccgtgcgagcgagacttcagcccctcttcccgaaccacatcgtgaacgactttacgttcgaaggaattcatcggcttcaagtcatacggctcgccggaatccttcactgcgtcaatggcatccaaggcgatatcacggaggtgctgacgcttgcgcttcaggaaaccgtcgacatccacaatcagatgagaacgctcgccggtcttctgctgtacagccagacgagtcaattgctgcagagcatcaacgacttcaccattacggccaataagatgtttgatgtcagtatcgtcatcagcaacgatttgcacggtggggcggtcattacgcacgcccatctcaatgtcgccctcatagtcggcgatatccagtaggccttcaaggtaatccgcggcgatgtcagcctcttcgttgagctggtcgatcgacttcacgtcatcctgtgccatacgctactccttcatgtcgtgtttgaattccaagtctaagccctgctcccccgaacagagaaagtaatgtcggtgcgtgttgaatgtttcacgtgaaacatcgaactcgcaccgacatagtcgtcacttctttttgcgcttacgcacgggctgttgacgctgatagccctgagtggccttacgctcggcctcttccttggccttggccaatgcttcttcttccagagagggcaggccggcctttgcgcggcgagcattctcattacgatgatcgcgcttctccttgtccgccgcagccggagagccaggggtcgggaatgcgtacacctgccacaatgtgcggcagaggttgcacacgttgttggtcagccagtagaccagcacggcgaacggcatggcgacaccggagaagatgtacatcaccgggaagagccacagcatagccttctgcatggtctcggtctgcttgttcatcgaagcagctgccatgttgcgcttcatgctgaagtactgcataaaccacaggcagaaacacatcaggaacacgaagataccgatgaccgccttgccactagcggcagcactggtgaagttatcggtcacgctgacaatgccgaacacatcggtttgggtgaattgcttggcggttgctacgtcgaacgcgcccaacgcatcgcgtttaccgttggcaatgtatggaatggccgacagcgtatagaacatggacatgaacaccgggccctgaatgagcataggcaagcaggagccagccggattgacgtcattgtcttgatacagtttcatggtttcacggctcatggcctccctggaagcctgatccgtcttgcctttgtacttgttctgaatacgctgcatcttcggcgccaatgcctgcatcttgcgcatcgacttcatctgcttgtagaacagcgggaagatacaagcctgcaccaccagcaccaggatgataatggcaagcacccatgagacaccaatcgggctcacgcccagcatcacgaagaagtcatgcacgatcttcatgatccaggtctgcaaccactcaacgggagtcaggattttatatagaaatccccaaaacccgctatcaagcagaaattcatttgagttcatcgttgggcctctctttgggttgtggccaatggtgtcagtcgaggctcttcatgagccttcgaccacgaaaacctgtaaaaaacggaataccgttgtggaacatcgtcgattcccccacgactccacggccggcaacgcagtaatctcagcacggcgagcactccccctttgaacgcgccataccgttccaatgcctcaatggcataattcgagcacgttggataatacttgcaacaaggcggtgtgtttgccgagatgtgctgttgataccagcgcaccccaccaatcatcaccgccttgaaagaagctgtcatgcctcagccaccttatgcgccaccgtggcaaaagccttcgcgatctgctgatctagcgaagcgaacgatgcggtcgctgcactgggcttggcgcgcaaaacgatatcgcaatgcgcgggcagcagatcctcatgggctctggccaatacacgaaacctacgcttcaccgtattacgggtgaccgcatgtcctaccgatttggagacagctaatcccaaacggcgatgcaccgtccggtcgtcatcatcatgatggtcgtcgggcaccaaatagtgcacgacgatatccttgccacctgctttgcgccggcgtttcagcacggtgacgaaatcacgatggctttgaagcctctccacctcgactatgcctgtggcactgatcggaatgatcaggcggagagggtcttgcggcccttggcacggcgacggttgatcaccgcacggccagaacgggtgcgcatgcgcaggcggaagccgtgcttcatgtggcgacgacggttgttcggctggaacgtcctcttcat

SEQ ID NO: 2 - skipped

SEQ ID NO: 3 - DNA, 19 bp, Bifidobacterium longum
ccatgagcggtttcacgaa

SEQ ID NO: 4 - DNA, 20 bp, Bifidobacterium longum
ttggacggtgcctgtgatta

SEQ ID NO: 5 - DNA, 12 bp, Bifidobacterium longum
cgggcaatcaac

SEQ ID NO: 6 - DNA, 25 bp, Bifidobacterium longum
acttgacgtaccgttttgagatttc

SEQ ID NO: 7 - DNA, 23 bp, Bifidobacterium longum
ctaagcatggcaaggctgatagt

SEQ ID NO: 8 - DNA, 14 bp, Bifidobacterium longum
tgcgaccaacacgc

SEQ ID NO: 9 - DNA, 25 bp, Bifidobacterium longum
gggtccaataagaaggttccatatt

SEQ ID NO: 10 - DNA, 20 bp, Bifidobacterium longum
gcatgtgccaacagctcatc

SEQ ID NO: 11 - DNA, 35 bp, Bifidobacterium longum
cggatgacaaggtagataatccagtgagcctatac

SEQ ID NO: 12 - DNA, 20 bp, Bifidobacterium longum
tatgttgccggcatttatca

SEQ ID NO: 13 - DNA, 20 bp, Bifidobacterium longum
tgcgcgttcatgtcaataat

SEQ ID NO: 14 - DNA, 20 bp, Bifidobacterium longum
ggcgtagcaagttcaaggag

SEQ ID NO: 15 - DNA, 20 bp, Bifidobacterium longum
aataaccgctgcaggaacac

SEQ ID NO: 16 - DNA, 20 bp, Bifidobacterium longum
gtgcaggacggtaatggagt

SEQ ID NO: 17 - DNA, 20 bp, Bifidobacterium longum
gcttcgggtctggatcatta

SEQ ID NO: 18 - DNA, 20 bp, Bifidobacterium longum
tgctgacaagtggagtctgg

SEQ ID NO: 19 - DNA, 20 bp, Bifidobacterium longum
ccacgtctacgagcaactca

SEQ ID NO: 20 - DNA, 20 bp, Bifidobacterium longum
gaaagcgaagagtggtctgg

SEQ ID NO: 21 - DNA, 20 bp, Bifidobacterium longum
ccggctgatttgatgagatt

SEQ ID NO: 22 - DNA, 18 bp, Bifidobacterium longum
tgccgctgtactggtcac

SEQ ID NO: 23 - DNA, 18 bp, Bifidobacterium longum
gcatgtgccaacagctca

SEQ ID NO: 24 - DNA, 20 bp, Bifidobacterium longum
ccaacacgtatctggcactg

SEQ ID NO: 25 - DNA, 20 bp, Bifidobacterium longum
tcggagccaaagaaggtaga

SEQ ID NO: 26 - DNA, 20 bp, Bifidobacterium longum
ataccgcgtatgctttggac

SEQ ID NO: 27 - DNA, 20 bp, Bifidobacterium longum
aaacggtaaccactcgcttg

SEQ ID NO: 28 - DNA, 20 bp, Bifidobacterium longum
atgggatcgatgcatgaaat

SEQ ID NO: 29 - DNA, 20 bp, Bifidobacterium longum
ttctcggcaataaaccgttc

SEQ ID NO: 30 - DNA, 20 bp, Bifidobacterium longum
ccagcggttatttcgttgtt

SEQ ID NO: 31 - DNA, 20 bp, Bifidobacterium longum
ggtggcatgatccttatgct

SEQ ID NO: 32 - DNA, 20 bp, Bifidobacterium longum
gctatcttcaccgcattggt

SEQ ID NO: 33 - DNA, 20 bp, Bifidobacterium longum
ccagtcagggaaggtcacat

SEQ ID NO: 34 - DNA, 20 bp, Bifidobacterium longum
tgaaatacacgcaacccgta

SEQ ID NO: 35 - DNA, 20 bp, Bifidobacterium longum
aatgcgtcaaaaccgatacc

SEQ ID NO: 36 - DNA, 20 bp, Bifidobacterium longum
ggaaagcaatgaggaagctg

SEQ ID NO: 37 - DNA, 20 bp, Bifidobacterium longum
gatttgatgcaaagcaagca

SEQ ID NO: 38 - DNA, 20 bp, Bifidobacterium longum
gtgagtaccgtttccgcaat

SEQ ID NO: 39 - DNA, 20 bp, Bifidobacterium longum
ttccttggttcccgtgatag

SEQ ID NO: 40 - DNA, 20 bp, Bifidobacterium longum
gctgggattttggaagtgaa

SEQ ID NO: 41 - DNA, 20 bp, Bifidobacterium longum
tgttacccccggcataataa

SEQ ID NO: 42 - DNA, 20 bp, Bifidobacterium longum
accggtaacgttcagattgc

SEQ ID NO: 43 - DNA, 20 bp, Bifidobacterium longum
gcaataccgccttgacctta

SEQ ID NO: 44 - DNA, 20 bp, Bifidobacterium longum
ttgtaccaccacacgtaccg

SEQ ID NO: 45 - DNA, 19 bp, Bifidobacterium longum
cgcgagttcaatggctatg

SEQ ID NO: 46 - DNA, 20 bp, Bifidobacterium longum
acatcgacctccatctccag

SEQ ID NO: 47 - DNA, 20 bp, Bifidobacterium longum
atacgtaacagcggctccac

SEQ ID NO: 48 - DNA, 20 bp, Bifidobacterium longum
aagtacgatgtgcgctacca

SEQ ID NO: 49 - DNA, 20 bp, Bifidobacterium longum
catcacggtcaggatgtcac

SEQ ID NO: 50 - DNA, 20 bp, Bifidobacterium longum
cgaatacacggacatcaacg

SEQ ID NO: 51 - DNA, 20 bp, Bifidobacterium longum
gagaatcgagcagctggaac

SEQ ID NO: 52 - DNA, 20 bp, Bifidobacterium longum
tgggagaggagttcatcgac

SEQ ID NO: 53 - DNA, 20 bp, Bifidobacterium longum
gtatccagccatgcgtaacc

SEQ ID NO: 54 - DNA, 20 bp, Bifidobacterium longum
taatgggcggacggaaagtt

SEQ ID NO: 55 - DNA, 20 bp, Bifidobacterium longum
tgccctccgtgaaatacagg

SEQ ID NO: 56 - DNA, 20 bp, Bifidobacterium longum
caacgatgtccatatcgcct

SEQ ID NO: 57 - DNA, 20 bp, Bifidobacterium longum
gcgccctgttgttgatgatg

SEQ ID NO: 58 - DNA, 20 bp, Bifidobacterium longum
ccgattccgccattcgtttc

SEQ ID NO: 59 - DNA, 20 bp, Bifidobacterium longum
ggccacatcgaaaatcacgg

SEQ ID NO: 60 - DNA, 20 bp, Bifidobacterium longum
gaattggcttgcagagcggc

SEQ ID NO: 61 - DNA, 20 bp, Bifidobacterium longum
acagaatcaggtcggcttgc

SEQ ID NO: 62 - DNA, 1584 bp, Bifidobacterium longum
atgtcatctctgagcagtaacggtcagccgtctacacgcagcagacaggccaatagcggtgaccgaaccaccgctcagctcagtgatatccgccaaaagcagctcagccacgtgctgtactggcgattcttcgtcaatctcgccctcatgcttatcgacgccgccatgtacatcatcgccggagctacggtgctcaatctgcgccatgaggcaacgccgctctattcgagcagattcaatttcacgattgactccaccgtttaccttattattatggcctgcttctgggtgtggtcgctctatgttgccggcatttatcaccgccatgttatgggtgacggttaccagctcaacgtgctgctggtcaaaggcatggtcgtgtgctgggtggtgcagtgcgcgttcaactacttcttcaatctgggtctgaccctcacgtcgctctgcttggtggtgattgccggatggttgctcaccatggtggaacgcattgccagccgtgcattcattacgcgtagtcgtcgcaagggcgcctacgcttatggcacggtgatcatcggttccccgcacggcattggtcgcacgctacaattcctcggtcagcgtcggcaactcaactaccgcccggtggcagtatgcccgattcatctcaatcccgataccggattgattgaacagagcgccgaccatgagacactccgtgaggagatgcaaaagaacaagggctgccagctgcccgtactcgagtacagcgatcataatcttgctgaacagattattgacatgaacgcgcagaccgttatggtggctgacgagctgcgtcgctattcggataattacgatatcttctccgtgcgcatggaatcgttcggtctggagattgccatgctggcttccgccgctgacacttctaaccatgagattcaggttcgatccatccaaggcaccacggttatcacgcagcgtcttgcgcaatacacgccagcccgtcgtttgaccaaacgcttgtttgatttggtgatttcttcactggcgattatctgttcgctgattatcaccattccggtggcgatcgccatcaaagtcacggacggcggaccggtgttctacaagcagacccgtatgggcctgcgcggcaagccgttccagatgtacaagttccgctcgatggtagtgaacgccgacgcgctcaagaaggagctcgcaaaagaaaccggtcagaccgaccgcttcatcttcaagatgaagaacgatccacgcatcaccaaggtggggcacttcattcgccgcttctccattgacgagttgccccagttcctcaacgtatggatgggcgatatgtccgtagtggggccgcgcccgccgctgcctgaggaatatgcccgttacaaccgtctgtacgccacccgcatgctggtcaagcccggcatcaccggtccgtggcaagtgtccggccgctccgatctgtccgccgaggaaagcgaggcccttgatgtggcttacgtgcagaactggtcgattatgggagacatcgtgctgctgttccgcacggtgggtgcagtgctgagccataagggagcgtac

SEQ ID NO: 63 - DNA, 1728 bp, Bifidobacterium longum
atggtgctgattgtaatcggcgcactgctgttgattattgcagcgctcgcggcgtggctcggcctttccgcgctcaaagcgaaaaatgaagtggaagcagcgattcaggccgcaagccgcatccaatcacaagttcaagccggcgacaccgacaaagcgcaagccagcattgaagcattctcccagcatatcgacgctacgtatgcgcagaccaagcagccggtatggaaactggccacattggtgccctattacggttctgacgtgaaggccgcgcgagacatggtgcacattttggaagacgtgtcgaacaacgcattgccgaagcttgccaaggcggcacaggccttggatttcaacagcatcggtatcaaagacggcacgattcagctgggggatatggccagcgtgactcaggatcttgccgccgccaatggagtagtggcggatgccagcgtagacatgggcaagattggtgatacgcatattccgcagattaccgaggcggtgcagcaggggcgtagcaagttcaaggagcttgccagcctgacggatacggccagtcggctgacggatgtgctgcccaagatgttcgacttggatagcagtgatggaggtggtagcggcagaggcccgcgaacctacctggtgctggcacagaacaatgctgagctgcgtgccacgggaggcattccaactgcgtgggccacgctcaccgtcgatacaggcaaaatcagcatgagcacgttcggcgatccgcctcggaatggtctgttcagccaggatgaagccgcgagcgtactgacggcggaagaacgcaatctcttctccaccaagatggccacggactacccggacatcaatttcactcccgatttcccccgcgtcgctgatatcgcgagtcagatctggcatcgagccggtcatgacgatgtggatggcgtcatcagcgtggacccggtgttcctgcagcggttattgaaggttgccggccccgtgacgctctccgatggcacggtgatgagcggcgacaatgccgagcagcggattctgaaccagatttatattgataccgatacgcaggcggagcaaaccgacttcttcacgatggcggccagtgagatcttcacgcatgtgctcaagaatgtggacggcaagaatcagcagctggtgcaaacgttccaggagtccgtatccgacggccatctgtatgtatggagtgctcatgaggatgagcagcggcgtatcttgggtacgaccatcgccggcgaattgcagtcgaaaccggctcattcggttacgggtgtgtacttcaacgatgccactatgggcaagatggactggtacctgaagcgtgaagtgaccagtacatatgacaaaacctatcccagtggcgccaagcaatacaccgttcacatcaaactgacgaatacggccgatgccgccgaggtgaatgccgctccggatctgttgcgcggctatgaccataacggcaacccccgtacgggggagatcgaaacggtgctgtacgtctacgcccccgatgaagggcgcattgtggattggacccaggatttcgatcagttcgctgtgcacgatggactgacggtgggtgtgaaaaccgtgacattgcggccgggggaaagtttcgagaccacggtgcatgtgctggccagtcccgcggccgatgaaaatgaaatgattttgagacagacccccttggttgat

SEQ ID NO: 64 - DNA, 1503 bp, Bifidobacterium longum
gtgaataaggaagaacggagcatagctgtggatgaagctgaacaggtgcaggacggtaatggagtcaccattctcgatttattcaatgcggtaagaaagcatgtgattaccgcagtggtcacgctggtcattgtgatggtggcaatctgcgcgtacacctttacccgcactccgcaatacaccgcaacttccgaactcttggccacttatcgcagttcagcggctgcgtcgggcgcatccagcaatgcaagcgagctgagctctggcgccaattacatcaatagccagattcaaacgtatccgcagttggtaaaaaccgagtctgtattgcagccggttattgatgatttgggtcttgacaccacggtaaaggaattggctgagggcgttaccgcttccaacccggatggcaccatgctggtggatatttcggttaatgatccagacccgaagcaggcgtccagcattgccaattcggttgccgaaaacctgagaaaacaggttacttccacgatttacagcgatgagggcgataagatcatctctcccgtcaacctaactgtggtgcagcaggcgtacgctccggcttcccccagttcacctaacgtcaagctcaatttggcggcaggtcttgcggtcggtgtcattctcggcatcgtggttgcctttatcaaggatttgctggacacccgtgttcgccgcgattctgatgttaccgctgttatcgatgctcccgtactggggtcgctgagccgcaatgaggcttatgccggtacgtcgccggtgattatctcccgcccggcctcccgcgaggcagaagagattcgacgcctgcgcaccaatgtgatgttcgtgctgcccgatgagccgttatccaatgtaattgtggtgacttccaccggcccgtccgaaggcaagaccacgctgagcgtgaacctggcgactgcattcgccgaaaacggcagcaaggtactgctgatcgacgccgatgtgcgcaacccctcggtgagcaaggccctaggcattgagggtgcagtgggcttgacccatctgattaccaaccgtgtatcgtcgcatgatgcgattcaacgctactggaagccgaacttccacgtgcttcctgctggaaaacaaaccatgaaccccagcattctgctgaattcccgcgctatgaaggcactggttgagcaggtttccggagcctatgactatgtgattatcgataccgcccccatgcaggtggccaatgatgccgccgtattcgccaaggaagggccagaactgctgctggtggccggcttgggagtgacggaaaagaaactgctccggcagaccgggcacgaactgagcacactgagcatcgatcccgtgggcttggccatgaattacggcgagacggagaagccccagaagggtggctattactactacggcgacgagtccgacgacaacggcaagaagcgccaaatccagcacaaaaagagcgagaaaacgaagaaggac

SEQ ID NO: 65 - DNA, 966 bp, Bifidobacterium longum
atgtaccggggagtgaaggtcattcccgtcacgaccatcgacgccaagggactggccgccctcacgtcctctttcttcgccacgttgaaggcgatcaaggcccgtccggatgtgatccactaccatgcggagggcccgtgcgtgccgcttcgtctggcgcattggttcggcatccgcaccgtcgccacgattcacggcctcgactggcagcgcgcgaaatggggacgtttcgcctccacgtatctcaagctgggcgagcgcacggccgcgaaatgcgcggacgaggtgatcgtgctgagccgtggtgtgcagcagtatttcaaagacacatacgggcgggagacacgtttcattcccaacggcattgcgccggtagaatccgtttctcctgacgtgattgctgacaagtggagtctggagaaggattcctacattctgttcttgggacgcatcgtaccggaaaagggcgtgcattacctcatcgaagcgttcaagcgattagacactgacaagaagctcgtgatcgcgggcggcgcatcggattccgccgaatactacgagtcgattaagcaggccgctaccggagatcagcgcattattctgaccgggtttattgaaggacgtgaactcgaagaactgtatagcaacgcatacatatatgtattgcccagtgatttggaaggtatgccaatgagcctattggaggcattggcttacggctgctgctgcctgacctccaatatcgctgaatgtgctgatgtgctgtgtgatgagtccggaatgatgcatggagtcacgttccgacatggcgatgtgaacgatttggccgacaaactcggtgagttgctcgtagacgtgggtaaggtacgaaaaatcaagaccggcgcggccggctatatcactggccgctatagctgggacaaggttgttcaagcgaccctcaagctctaccgaggagcagataaa

SEQ ID NO: 66 - DNA, 1341 bp, Bifidobacterium longum
atgaggattttactggtcaacaaatatttctaccgcaaaggcggtgctgaaacatatttcttcgcgcttgcggagggattgaaagcactcggccatgaggttgcgttcttctccatgcagcacccaaacaatgagccgagttattggagcaagtatttcgtatccgaaaaggactacgtcggcaagatttccgcgttcaaaaaagtgaaggaagcggcgacgttggtgtattccttcgaagcgaagcgcaagtttgaggcgctgctcgaagaattccagccagacattattcatataaataatgtgcatcgccagctcactttgtcgattctggatgcgccttatttgaagaagcaccgtgttccggtggtgtatacagcgcacgactatattctgctgtgcccggcttacacgatggtggacggttccggcaaggtttgcgacgattgccttgactgtcacttcttccatgcggtgaagaaaacttgtgtgaaaggatcgaaagcgaagagtggtctggcgttccttgaagcggaattcctgaagaaccatcattcctacgacaagatcgacaaaatcatcgcccccagtgaattcatgaagcacaagctggatgagggtggatatgccggcagaaccgtggccatgcagaacttcctgaccaccagccaaatggacatggcgcataaggtagccaacacgaataagttcaataccgttgagccgtatttcttgttctttggtcgactttccaaagaaaaaggcatccttacattggtgagggcgttcctgcgggctgcaggcttgatgaatagtggggttgcaggcagcaaactcctcccagccaattggaccttgcatatcgtcggcgatggtcctgagcgccaggctatcgaaaatctcatcaaatcagccggccctgaagctgaacgccgtatcaaactccttggctacaagaccggagaggatcttcagcgcgaggttggcaatgctcgcttcagcgtgctgtgctccgaatggcgggagaacatgccttattcaggtttggaatccctggcagcgcagactccaataatcggcgcgaatatcggaggaattcccgagcttgtggtggaagggaaaaccggattcaggtttgaatccgggcagttagatgatttggcaaaccatctattgcaagcgtcagcactcaatggtgatgaatatgcagtcatgcaacaggaatgcggcgactatatcaatcgcagagctcaacaaagcctttatatccgttctcttggggaactatacatgcgctgtttgcagattccaacccagcaaagggatgtcgaggaggagaaa

SEQ ID NO: 67 - DNA, 1062 bp, Bifidobacterium longum
atgaagaacacaattgatttgcataatgccgctgtactggtcactggcgctgcgggattcatcggctcgaatcttgcaaagcaactgcttgattctattgaagggattcatgttatcggtttcgataatgtaaatgattattacgatgtgcgtcttaaggaatatcgccttaaccagctctctcattatgaagggttcactttcatcaaagctgatttggcagataaagacgcagtaaatgatgtattcgagcaataccgacctaccgttgtggtgaatcttgccgctcaagctggtgtgcgatattccatcacgcatcctgatgcttatattcagtcgaatctgattggtttttataacattcttgaggcttgtcgccatcatccggtggatcatcttgtgtatgcatctagctcctccgtatatgggtccaataagaaggttccatattccacggatgacaaggtagataatccagtgagcctatacgctgctacgaaaaagtctgatgagctgttggcacatgcctactcaaagctgtatgacattccttctacgggcctgcgtttctttaccgtgtatggacctgccggacgccctgatatggcgtatttcggtttcaccaataagcttcgcgcaggagaaacaatcaagattttcaactatggcaattgccgacgtgactttacctatgttgatgacattgttgagggcattctgcgcgtgatgcaaggtgcgccttcgaagcagacaggagaagatggtctgccggttccgccttatgcggtgtacaacattggtaacgggcatccggaaaacctgctcgaattcgtcactattctgcaggaggagcttctacgagccaaagtgcttcctgcagattacgacttcgaatctcataaagagctggtccccatgcaaccaggcgatgtgccggtcacgtatgcggatactgcggccttagaacgcgattttggctatagaccttcaactccgctgcgtgaaggcttgcgtcgatttgccgagtggtacaagaccttctacctcgatgactctgataaa

SEQ ID NO: 68 - DNA, 1248 bp, Bifidobacterium longum
atgaaggattttgattcattgaagattgccgttgctggtaccggttacgttggcttgagcttggctacgcttttggcgcagcatcatcaggttaccgcggtggatattgttcctgcgaaggtcgacatgatcaacgcccgtaagtccccgatccaggacgattacatcgagaagtactttgcggagaaggagttggacctcactgccacgctggatggtgaaagcgcataccgcgacgccgatttcgtgatcatcgcgactcccaccaactacgacagcacgaagaactttttcgacacctctgcggtggaggccgtcatcaacctggtgatgaaggtgaatccgggcgcgatcatggttatcaagtccaccatcccggtcggttacaccaagtcgattcgtgagaagaccggttccaggaacatcatcttcagcccggagttcctgcgcgaatccaaggcactgtacgacaacctgtacccgagccgcatcgtggtcggcaccgacccggaggaccggcatctcgtcgaggcggccgagacgttcgccaagctgctgcagcagggggccatcgaggagaacatccacacgctgctcatgggcttcaccgaggccgaggccgtgaagctgttcgccaacacgtatctggcactgcgcgtctcctacttcaacgagctcgacacctacgccgagtcgaagggcctgaacacgcgcgagatcatcgacggcgtgtgcctcgacccgcgcatcggcacgcattacaacaacccgagcttcggttacggcggctactgcctgccgaaggacacgaagcagctgctcgccaactaccaggacgtgccggagaacctcatccaggcgatcgtggattcgaacaccacccgtaaagacttcatcgccgaccgcgtactcgagcttgctggtgcctatggccccaacagcgaatgggatgccagcaaggaacatgagaccgtggttggtgtgtatcgcttgaccatgaagtccaactccgacaacttccgccagagctccattcagggtgtgatgaagcgcatcaaggccaagggtgcgacggttatcatctatgaacccacgctcgaaaacggctctaccttctttggctccgaagtggtcaacgaccttgatgagttcaagaagcgctcgcactccattgtcgcgaaccgttatgactcttgcctcgatgacgtaaaggacaaggtctacacccgcgacctgttccgcagggac

SEQ ID NO: 69 - DNA, 1062 bp, Bifidobacterium longum
atgggtgagagtatatgtttcattatgccaactatggacggtggcggtgccgaacgagtggtctctattctctctggcgaattcgctcgtagtggatgtgatgtgacgttgttcttaactaacagcactcataccgcgtatgctttggacaagcgcgtccatgtcgatacatcctgcgcggaaagcaacccgaattcccttgatcagattaaagctattcgggcgaagatgagagcgatgccgaatacggtatttatttccttcatggatagtcaaaatttgttcactctaatagcgggaattggtatgcggaaccgcataattatctcccagcgtaatgatccacaccgtgcttttggaaagcgtcggctggttagggctattcatccgtggctatacgctcttgcggactgcgtggtattccaaacacaggatgcacttgagtattaccccaaatatgcggctggtaagtaccgtgtgattcttaatcctctcaataatagcatgctgccacgctatgaaggtgaacgatccaagcgagtggttaccgtttgtcgtttgaatgagcagaagaatttgccgctcgccattgatgcgtttgcagaattccgcacacggttctgcgactataccttcgagatttacggcgaaggcgcactggaaaatgatctaaagcgttatgcagtttcccgaggggttggcgatagcgttcatttctgcggcttccggaaggatgttcatgcctgcattttcgatgccgccatgtttgtcatttcctcggattttgagggactctcgaattcaatgattgaagctattgcgttgggaattccgacgattgctacggactgcccaatcggtggggcccgcatggtcattgacaatggcgtaaatggatatcttgttccggttcggaacaaggagcgcatggttacggctatgtgcagtattgcaggcgatactggtgtgcaggaacgctttagcaaagctggcgtgcggttgcgtgaacgtttgtcggttgactctatttcgaagcagtggctttcggccattaaagagaaa

SEQ ID NO: 70 - DNA, 828 bp, Bifidobacterium longum
atgaagattttggttaccggtgctaatggatatttagggcgcggtgtggttgatgagttgcttaagcgtggaaacgaggtaatcgccacagacttcgcctgtgaccatgtgaattctgcggctcattgcgtgcccggagacatcttctcgattgaagatccctatacgtacttcggcgagcccgatgtggtgttgcatctggcttggcgtgatggttttgtacacaattcgaatgcgcactttgaggatttgcctaagcatgttgcattcctgaaaaaactgtgcgaatccggaatccagcaagtggcgtgcatgggatcgatgcatgaaatcggattccatgaaggcagcatcaacgctcacaccccatgctggccgatgagcatgtatggaatcgccaaggatgcgctccgtaacgcattgcagaccatagcgttgcagaacaaagtaaagttccagtggcttcgtggatattacatcgtcagcgatacgcaatatggcagctccattttctcaaaaatcgttgcggcggagatcgaaggtaagaaagagttcccgttcaccacaggtcagaaccagtatgattttctagattatcccgatttctgtcatcaagttgccgcggcggtgaatcaggatgaagtgttggggattatcaatatctgttccggtaagcccgaaaaacttgctgatagggtggaacggtttattgccgagaatgggttctccatcaaattgaaatatggtgcattccctgatcggccctatgactccaaagccgcgtggggcgatgctttgaagattacccgaatcctcgatacggaacat

SEQ ID NO: 71 - DNA, 507 bp, Bifidobacterium longum
atgggtactttgctcgagcaggataagtatcgatacgccgttgagaaaatgcctagattccagcggttatttcgttgttgccaagagtgcaggttcaagcctatgcagttggtgtatcgactgctgtttcgctggtgccgtcagaggaatttcatcgagttaagccatcaaacggttatcggtggtggcctgtatatcggacatccttattgcatcaccatcaatcctcaagccgttattgggcggaatgtcaatatccatcgaggggttgttattggccaggagaatcgtggaaagagaaaaggtgctctaacgcttggtgatgacatttggattggaatcaatgcgtcaatagtgggaggagtgaaggtcgggaacgacgtaatgattgctcctggggcctttgtgaatcgcgacgtgccaagtcactcggtagttattggcaatccttgcattatcaagcataaggatcatgccaccgagggatatatcaatcataaaagtcag

SEQ ID NO: 72 - DNA, 1014 bp, Bifidobacterium longum
atgggagctcacaatagcattagacgctatcttcaccgcattggtgaggaaatacgatctacggcggaaatagcgaaattgacttcatggccggctgcagtggaaacgcttattgctaaggcggatatccaaattatgtgccgtaatgggtatgcggaaccgccgaatgcgcgtcgtcgtctgattcgtaagcatgaaacactgcttaagtatttcgagaaacgatatggagatttcgcttctggctatcgctataaggtaaatcttccagccgtaccggaggaactcaaaggttgcatctggttatgctggtggcaagggcttgaccatgctccgcgtatcgtccaacgctgtgtagaatcgattcgcgaatatgcgggagatcgacgtgtgattgtgattaccgaggacaattatcgtgattatgtgaccttccctgactggatgatgcgcaaatatcatgaaggcactattgctcgcacacatttgtcggacttgctgcgtttatcgttgctggctcagtatggcggattgtggttggacgcgacgttctattgcgctggcgatattgaagactgttttggccagccattgttctctatcaagcgccccgagtatttgcatgcaagtgtggcgcagggatattttgcaaattactcttttggatgtgatgccgaccatcgttggatatttgccgtgatacgtgatttcttgcttgaatattggcgtacaaatgattttatggtcgactacttgttcttggattatttaatcgtactagtgcaacgacattgcactgcggttaaggaggcgtttgcagcaatcacccccaataatccacaatgcgatgacctgttcaagtgtttaggtgatgtctttaatgagcgtcattgggagtcattaattgccgatacatcattgttcaaattgacatggaagcaagagtttcccaccgaaatcaatggtgtcgaaacttattatggaagattgctcaacggcaatttgcgtcgaaat

SEQ ID NO: 73 - DNA, 1341 bp, Bifidobacterium longum
atgattcgcataacgaagaccaaaacactccagtacgcgtggctgtaccttatgttactgattccgggcagctgcgcgatgtcacgctatctgaataccacattggtgtatggcgtgattattgctatatatgccctgcttgcgttgttgagcgcaaaatataggaatgtttatgtgctgtcgttttgccttttgcttgcattggcaacgattgttatccgattgaaaacaggaggtgtggggcccctaagttttctttccaacgcagcgatgctggttgtcacctatatcgcaatgactattgatcggagaatgtttcttacccgattcgtaagaattgtttgtttctttggcatcatcagtgtgctattttgggcggcgttttgcattaacccttcgctggtgaatgcatggcctgcaacatcattctggacgcagaacttggggacgggtcaatgggccactgtgcttcatggaaaaggactctggctttactcgtatcttgaaatacacgcaacccgtaattgtggtttctacactgaacctggcgtgtatcagattgtactcaatgctgttttattcgtcctgttattttggaaaaagaaattatattttgataacgagaagcaatatcgtacggcgaccgtcattgtcttgctcacactgattacttgccagtcgacgaccggttatctttctatgatggtcatcttgttgtgcttcttctttatgcgtggcagagagcgaggcatacgtacgctgaaacaaaagcttgcagtgctagtggtcgccattacggcggtgctgatcactgattatttgcttcgcggggaagagagtctcctttatgttcaagtgctgaacaagctatttggtggaggcattggcggtggtgtcaatttagaggatagcacgggacaatatcgttggattacagtgatggctagtttgaaggctctttccatggacccgttcggtatcggttttgacgcattctatgcgatacgagactcatttgacccagctgcagttgccgctagcattgcgacctatgccgcagtgtatggaatgattttctggctgacgatgatgattatgattttctatccaatgattcgacgggaaccaaagaaaatactcattgccgtatttgcttttatgtttatcaattccacggttagcgagacgtatttgttctatccgggtctcatgatgttcccgatttatctcagctcctatttcacacataagcagtccagtgtcgttggacatgcgattgctacatgtaatcctcgccattcgctaatggtttccaatctgatgaatgctaaagaggtgatg

SEQ ID NO: 74 - DNA, 930 bp, Bifidobacterium longum
atggaacggactctgctgcttgttcccagcggtagcttctattatttcaatagtatgaaacttcctaatgtggtggttttccctgtgttccgcgaagttcatggcgcgtccgaaatggtttggaaagcaatgaggaagctgaggcttgctgccagctcgctgttctatactgattggtacaaggatttgcagtcgttttccaagatcattgtttttgattttacggtatggctggatccggcgttattgcgcaacattaatagacataaaaatcctgacgcgaaatgttatctatattcctggaatattgttcgcgacaagcaggttgtccttggtcatcttacggcgtgcaggaagtatggtttctcatattattcgtatgacgaaaatgactgcaagcaatatggattccgcttcaacaccatcatgtatgacgagaacttgcgtctcccggaacgtgctctgacgtcagatatcctgtttcttggttttctcaaggatcgcaaggcaaaaatgcttgctttgcatcaaatcatctccgatgctggcatgaaaccggaattcgtaattgttgaaaacggtaatcagcatgaagatttgccattcaccattaggcactcatatgttaattatgcggattatctcgatatggtttcgcaaagcaaggcgattttggatatcacgcagcaaggtcagaacggattctctatgcgcgtgatggaatccattttcctcaacaagaaactcgtttcgactaacatggctctattgtcagcgaatttttatgatcccaataatattctggtcattgatttgcagaaccctgatgaagaagagcttaccgtgttcctgcgttccgagtttcacccatattctcaagagacaagacactactattccgtcggctcatggatcaatcgtttccaacaa

SEQ ID NO: 75 - DNA, 1392 bp, Bifidobacterium longum
atgaaatcggcggtagcatacacattcgcatcgctgttttctaaaggtttggcctttgttactgtgccaatttttacccgaatcatgtcaacttctgagatgggcacagtcaatctgtacaattcttggcagtcgatactgacggttgtggcgacgctctcgttgacttacggcggatatatggtcgcgttgaaggaatatgagcatgagcgcgataggtacgaatcttcagtgctgacgctcacgacgttcacatcaatcgtattctttgccgtatattccgttgctcccaatttttggagtcgcatacttggcctagacaaatcgctgttgctgctgatgctagttggtttcctattgctgccggctacggagttctggctggcaagacagcgttacgagtataagtacaaggcagcaacactggtgacgattggctccgcaattgtggcatcagcactttccattgtcgctgtattgtatatgcgaggaagcggaaaagcggccgaaggacgattgttcgcgaattatgccgtgctatatgctgttgctcttgtgctatgggtatacatcatggtgcgagggcgcaagttcatttccatgcggtattggaaattctcacttgctctgagtgtgcctcttattgcgaatcagttcgccacgcagattctgaataattccggtcgcgtgatgattggttggttcgttgataattccgctgtgggcatttatggcacactttcctcggtgagtaccgtttccgcaatcgtatggtcggcaattaattcttcgtttatcccattcctctatcggaatattgatgattccgaaggcaagaaaagagttcggagcctcgcttcgattctgctgctcacctatgctgcggtatgcgtattgatgactttcctagctcctgaggtggtcaagataatcgcaactgatgaatatatggcagcgatttacatcatgccgccaatttctgcagccattttccagaacgctatttccaatatgtatgcaaacgtgttgttgtatcacaaaaaatcttcatacataatgattgcctctatttgtggcgcagtactgaatattgtactgaatgcagtactgattcctctatttggataccaggcagcggcctattcgatgttgattgcattcgtattcttgtcgtatgtgcaaatgcgtgtgtccaaaaaactgcacttcactatcacgggaaccaaggaaaccgtatatgatgacaaagtcattatcggtatacaatggctggtaattgtgctttccgccattgcgattcctctatatcacttcacgattattcgttatatagcagcatttgtcctgatggttgcctccttgttcctatacaaaaagagcaaaatatctgtc

SEQ ID NO: 76 - DNA, 492 bp, Bifidobacterium longum
atgaatcatttccgtaatgctgagaaaaatgctgctcattaccgaaagctgggtttaaagctgggggggggcttcgagattctcaatggctgggattttggaagtgaaccgtggttgattgagatcggcgataatgtcaggattacatctggtgttagatttgtgactcatgacggtggcgtgtgggtattgcgtcataagtatcctgagttatccgatatcgatctctttgggaaaattcgaatcggcaataacgtgcatattggttttaatgccattattatgccgggggtaacaatcggagataattgcattatcggatgcggcactattgttacgcatgatattcctgcaaattccatcgtagtgggtgtgccgggtagggtgatcgagtccgttggtgaatatgcggctaaacatgatgatgattttatgcatactaaaaagatggctactgatgagaaaaaagctttcgtacttggccatctaaga

SEQ ID NO: 77 - DNA, 1149 bp, Bifidobacterium longum
atgacagcgaagattctggtaacaggcggcgcaggttttattggtagcgagatcgtaaaacaactgagcgctcatgatgaatacgaaattcgcgttctagatgcattgaccaaacaaattcatggcaacaatcctgaaaagtcatatcttttccaatccataaaagattgttgtgatttcatccgtggagacgtgcgtgatttcacaacagtccagaaagcccttgaaggggtagatgttgttttgcatcttgcggcagaaaccggtaccgggcaatccatgtacatgatcaaccagtacaacgaggtcaatgtcatgggtttgtcaaatatttttcaagcactatcgctcaagggggaaagcaacactatacgcaaagtcatcctgtcgtcatcgcgttctgtgtatggcgaaggcgagtatcaatgcccaaactgtggcgtagtctacccccgtggacgcaaaactaaagatatgatgcaaggcgatttcactatgcattgcgacaagtgcaataccgccttgaccttaatgcccaccaccgaagacagcaaaaccaccccaaattctctttatgcgttcaccaagctttcacaagagatgatgattcagacaatgtgccctgcgatggatattgattacaccatcttccgtttccaaaatgtgtacggagcaggccaatcattgaagaatccttacactggcattctttccatcttctcctcattgcttttggacaataaagacatcaatatctttgaagacggcaaggaaagccgcgacttcatccacgtaaaggatgttgcttccgcggtcatcaaatctatcaatacggccgcatcgaacggagaaatcatcaacctgggcagcggaatcggaacaagtgtcatcgaaatagctgagacattgaaacgaatctatggcagtaccagcaatctgaacgttaccggtgatttccgtatcggagacatcgcacataatgtcgctgatacccaaaaggcacgaaagctgcttgatttcactccgtcgatttccctgcaggaaggtttgaccgagttttgcgaatgggtgctgggacaagaaaccgacaacagtcgttacgaacaatcccttacagagatggaacgttcaggaatgtttattcgaaag

SEQ ID NO: 78 - DNA, 579 bp, Bifidobacterium longum
atggccggctcctgttccaaggccgcctataggccacgcccggccaggccggacgacgacccggctcccgacatcctcgcccgcgagttcaatggctatgcgccgcgcacccatctggcctccgacccggcctacgtgagggtcggcagttcgtgggcgtacgtctgcctgcccggcgacctggccaaccggcagatcgccggccattcggtcggcgtcgggcacgacgccgatctcgtgttggccgcgttcgccgcgctgcgcttcccgctggatgagatcgaggtgttccacacggaccgcggcggcgggttcgccggggaacgcgtcgaacgcgtgctcgacgtgttcggcgtcacgcgttccctttccaggccgggcaacccgtacgacagcgcggtggtcgaatccaccaaccggctcgtcaggaaggaactcatccacaggaacgtctacacgaacgtggagcaaccacgctcggacgtcaaccggtacgtgtggtggtacaaccaccaacggctccactcgaccctcgggtacctgagccccgtggagttcacacaacaaggaaaaaccctc

SEQ ID NO: 79 - DNA, 156 bp, Bifidobacterium longum
gtgcaggggatacgtaacagcggctccacgaaagcggccgacaaccgcactcccgaggagaacgagctgatcgaattgcggaaacgcgacaggcagctggagatggaggtcgatgtttcagaacaagcggcgccggtattcgcacgaaagcaggcg

SEQ ID NO: 80 - DNA, 1020 bp, Bifidobacterium longum
atggctgatgaagttttctctccgaagaacgttattgtgaccggtggctgtggttttatcggttcaaatttcgtgcattacgtgtatgaccatcatcctgatgtgcatgtgacggtcctggatgcgttgacgtatgcgggcaacctggagaacatcaggggcatcctgggcgaccgcgtggagttcgtgcacggcaacatctgcgacgcggaactgctcgacaagttggttcctggtcatgatgcgatcgtgcattacgcggcggagtcgcataacgacaactcgatcgcgaatccggagccgttcctgaagaccaacgtggagggcacgttccgcctgttggaggcggcccgcaagtacgatgtgcgctaccatcacgtgagcacggacgaggtgtacggcgacctggccctggacgatccggccaagttcacggaggagaccccgtatcatccctcgagcccgtacagctcgacgaaggcgagctcggacctgctggtgcgtgcctggcaccgcacgttcggcatccgcgccacgatctcgaactgctcgaacaactacggcccgtaccagcatgtggagaagttcattccccgtcagatcacgaacatcctcgaggggctgaagccgaagctgtacggcaacggggagaacgtgcgtgactggatccacacggacgaccattcgacgggcgtgtgggcgatcctgacgaagggccgtatcggcgagacgtacctgatcggcgcggacggcgaacgcaacaacatcaccgtgctgcgtgacatcctgaccgtgatgggcaagtcacccgatgatttcgattgggtgaaggaccgtccgggtcatgaccgccgttacgcgatcgattcgacgaagctcaggaccgaactgggttgggagccgacgcatacggacttccagaagggcctggagcgcacgatcgagtggtatacggagaaccgcgcgtggtgggagcccgcgaaggccgccaccgaggccaagtacaagcagcagggacag

SEQ ID NO: 81 - DNA, 957 bp, Bifidobacterium longum
atgggtctgggtctgccggatttcggcccggtgcagaacaacatcagcttcaacgcgacgaagggcgtgacgcgcggcatccacgcggagccatgggacaagtacatcagcatcgcgaccggtgagatattcggcgcgtgggtcgatttgcgtccgggcgagagcttcggccaggtgtacacgacccgtttggacccgtccaaggcaatctacgtgcctcgcggcgtgggcaacagcttccaggccttgcaggacgggaccgtgtacacgtatctggtgaacgcgcactggagtctggaacagaagaagacgtacacgttcgtgaacctcgcggacccggagctgggcatcgagtggccgattccgttggaggagtccgaacgctccgaggcggacctgcatcacccgatgctcaaggacgccaagccgatggagccgaagcgcacgctggtgacgggctgcaacggccagttgggccgtgcggtccgcgcgtacgcggaggcgcatggtctgcgtggtttcgaatacacggacatcaacgagttcgacttctccgatccggccgcgtacgacgagtacgattggagcctgtacggcacgatcatcaacgccgaggaactatccgcggacaagtgcgaaatcggggagaaccatgctcgggcatggaccatcaacgcccaagggcccgcgctgttgtctcgtgcggcgaaggatcatcacgtcacattggtgcatgcgagcaccgataaggtttacggagccgattcggaagccaaagcgatcgccccggagagcgtctacgggcagacgaaggctgcgggcgacatcgcggtggcgaatgcgccggaacactacatcctgcgacgctcggaatccgccgattcccggaacatcgtggacacgctgttccagctgctcgattctcacgccgaatacggcgtctatgccgtcggtgac

SEQ ID NO: 82 - DNA, 897 bp, Bifidobacterium longum
atgaagggcatcattctcgccggaggttccggcacccgcctttacccgctgaccaccgtcacgtcgaagcagttgctgccggtgtatgacaagccgatgatctactatccgctcagcgtgctcatgcttgcgggcatccgtgacatcctgatcatctccacgccgaaggacctgccgaacttcgaaaagctcctcggcgacggttcgcattacggcgtgcatttttcctataaggtgcagcccagcccggatggtttggcgcaggcattcctcttgggagaggagttcatcgacggcgagccgtgcgcgctcgtgctgggcgacaacatcttctacggtaacggtctgggcgccacattgcgcaaggccgtcgctaaggccgaaggcggcgagggcgcaagtgtgttcggctactatgtcgacgatccggaacgctatggtgtggtcgagttcgacgagcataaaaaggccgtctccatcgaggagaagccgaaggagccgaagtcgcattacgcggtgacgggtctgtacttctatgacgagcgtgtggtcgagttcgccaagcgggtcaggccgtcggctcgtggcgaactggagatcacggacctgaacaagatgtatttggaggacggctccctgaacgtgcgaacgctgggtcgtggttacgcatggctggatacgggtaccatggattccctgtacgaggcgggcgagttcgtgcgcaccgtgcagcgcgcccagggcctgcccatcgccatcgtggaggaaatcgcctacgaaaatgggtggatttccaaggaggagctcctcgaatcggccgaacgttacggcaagagcccctacggcaagcatctcaaggatgtggccgaaggcaaagtcgtgattgttcctaacgac

SEQ ID NO: 83 - DNA, 217 bp, Bifidobacterium longum
gtaatgggcggacggaaagttggacgttttggcgtccggattggagtccgcatgttttcgatagaggatcggcgcagggccgttgacctgtatttcacggagggcatgaccatcaggaaggtcgtcgccaagctcggctacccgtccgagggcgcgctggcgaaatgggttcgcgaggacccgcgctgcacggttcctttggccttccataagttct

SEQ ID NO: 84 - DNA, 144 bp, Bifidobacterium longum
atgctacgccggctcgtccccgtccccatcaaacttgtgctcatcctcgtaggcaacgatgtccatatcgcctcgatggagtttcttgagtgtttcagccactcgcgcctgctcatcatcaacaacagggcgctcgccggctaa

SEQ ID NO: 85 - DNA, 432 bp, Bifidobacterium longum
atggcttcattgcttcagggattcgaagaggttcagctggtcaagccggtgggcaagaccgttctgaccgtcaccgattccgccattcgtttcaacaaagccaccgctgaagtgctcggattcccggcgtacgtcaaggtgctgattaacgacaagaccaggcagatcgccgtgaccccgaccaccgccaaggccgacaacgccattaagttcagcaagaccgaaggcaagcaggctgcttcggtaagcgtcaaggaagccacgctcattgaagcagtgaaggcatacttcactctgcccgaggctccggaaggcgaaatcgcctaccagtccgtcaacggtaccgcctaccccgaaagcaagaccgtgattttcgatgtggccaatgccaccgctggcaccatgaagcgccgcggccgcaaaaaggccgcc

SEQ ID NO: 86 - DNA, 558 bp, Bifidobacterium longum
atgcaaatcatgtatgtatgcaccggcaatcaatgccgttccgtgatggccgaatactacacccgagccaagcttgccgaccgaggaattggcttgcagagcggcaatatcaccgtgcgcagcgcgggtactctgcactatcccccgcatcccgctgatccgatggttatcgatttgctgaagaacgacggcattgacgcgaattcccattcttccacccctctcaccaccgatatcagccggcaagccgacctgattctgtgttttgagcgtgagcaaatttccgatttgcttgaacagaatccactggctattcgcaaagtatttctgttcaatgacttcgtgaacgcttgcaaacatatgcatgccgagggtccgattgccggcgataccgccgcagacaggctcatcgaaatcatggattgcgtacctatgctgcggccgtttttgcctacggcactcgaaaccgaagaccctcatcgtcaatcacgcgaggtgtttgaacgcgtgtatgcggaaatcaagcacggcgtcgatattatgctcggcgctgtggcc

SEQ ID NO: 87 - protein, 528 aa, Bifidobacterium longum
MSSLSSNGQPSTRSRQANSGDRTTAQLSDIRQKQLSHVLYWRFFVNLALMLIDAAMYIIAGATVLNLRHEATPLYSSRFNFTIDSTVYLIIMACFWVWSLYVAGIYHRHVMGDGYQLNVLLVKGMVVCWVVQCAFNYFFNLGLTLTSLCLVVIAGWLLTMVERIASRAFITRSRRKGAYAYGTVIIGSPHGIGRTLQFLGQRRQLNYRPVAVCPIHLNPDTGLIEQSADHETLREEMQKNKGCQLPVLEYSDHNLAEQIIDMNAQTVMVADELRRYSDNYDIFSVRMESFGLEIAMLASAADTSNHEIQVRSIQGTTVITQRLAQYTPARRLTKRLFDLVISSLAIICSLIITIPVAIAIKVTDGGPVFYKQTRMGLRGKPFQMYKFRSMVVNADALKKELAKETGQTDRFIFKMKNDPRITKVGHFIRRFSIDELPQFLNVWMGDMSVVGPRPPLPEEYARYNRLYATRMLVKPGITGPWQVSGRSDLSAEESEALDVAYVQNWSIMGDIVLLFRTVGAVLSHKGAY

SEQ ID NO: 88 - protein, 576 aa, Bifidobacterium longum
MVLIVIGALLLIIAALAAWLGLSALKAKNEVEAAIQAASRIQSQVQAGDTDKAQASIEAFSQHIDATYAQTKQPVWKLATLVPYYGSDVKAARDMVHILEDVSNNALPKLAKAAQALDFNSIGIKDGTIQLGDMASVTQDLAAANGVVADASVDMGKIGDTHIPQITEAVQQGRSKFKELASLTDTASRLTDVLPKMFDLDSSDGGGSGRGPRTYLVLAQNNAELRATGGIPTAWATLTVDTGKISMSTFGDPPRNGLFSQDEAASVLTAEERNLFSTKMATDYPDINFTPDFPRVADIASQIWHRAGHDDVDGVISVDPVFLQRLLKVAGPVTLSDGTVMSGDNAEQRILNQIYIDTDTQAEQTDFFTMAASEIFTHVLKNVDGKNQQLVQTFQESVSDGHLYVWSAHEDEQRRILGTTIAGELQSKPAHSVTGVYFNDATMGKMDWYLKREVTSTYDKTYPSGAKQYTVHIKLTNTADAAEVNAAPDLLRGYDHNGNPRTGEIETVLYVYAPDEGRIVDWTQDFDQFAVHDGLTVGVKTVTLRPGESFETTVHVLASPAADENEMILRQTPLVD

SEQ ID NO: 89 - protein, 501 aa, Bifidobacterium longum
VNKEERSIAVDEAEQVQDGNGVTILDLFNAVRKHVITAVVTLVIVMVAICAYTFTRTPQYTATSELLATYRSSAAASGASSNASELSSGANYINSQIQTYPQLVKTESVLQPVIDDLGLDTTVKELAEGVTASNPDGTMLVDISVNDPDPKQASSIANSVAENLRKQVTSTIYSDEGDKIISPVNLTVVQQAYAPASPSSPNVKLNLAAGLAVGVILGIVVAFIKDLLDTRVRRDSDVTAVIDAPVLGSLSRNEAYAGTSPVIISRPASREAEEIRRLRTNVMFVLPDEPLSNVIVVTSTGPSEGKTTLSVNLATAFAENGSKVLLIDADVRNPSVSKALGIEGAVGLTHLITNRVSSHDAIQRYWKPNFHVLPAGKQTMNPSILLNSRAMKALVEQVSGAYDYVIIDTAPMQVANDAAVFAKEGPELLLVAGLGVTEKKLLRQTGHELSTLSIDPVGLAMNYGETEKPQKGGYYYYGDESDDNGKKRQIQHKKSEKTKKD

SEQ ID NO: 90 - protein, 322 aa, Bifidobacterium longum
MYRGVKVIPVTTIDAKGLAALTSSFFATLKAIKARPDVIHYHAEGPCVPLRLAHWFGIRTVATIHGLDWQRAKWGRFASTYLKLGERTAAKCADEVIVLSRGVQQYFKDTYGRETRFIPNGIAPVESVSPDVIADKWSLEKDSYILFLGRIVPEKGVHYLIEAFKRLDTDKKLVIAGGASDSAEYYESIKQAATGDQRIILTGFIEGRELEELYSNAYIYVLPSDLEGMPMSLLEALAYGCCCLTSNIAECADVLCDESGMMHGVTFRHGDVNDLADKLGELLVDVGKVRKIKTGAAGYITGRYSWDKVVQATLKLYRGADK

SEQ ID NO: 91 - protein, 447 aa, Bifidobacterium longum
MRILLVNKYFYRKGGAETYFFALAEGLKALGHEVAFFSMQHPNNEPSYWSKYFVSEKDYVGKISAFKKVKEAATLVYSFEAKRKFEALLEEFQPDIIHINNVHRQLTLSILDAPYLKKHRVPVVYTAHDYILLCPAYTMVDGSGKVCDDCLDCHFFHAVKKTCVKGSKAKSGLAFLEAEFLKNHHSYDKIDKIIAPSEFMKHKLDEGGYAGRTVAMQNFLTTSQMDMAHKVANTNKFNTVEPYFLFFGRLSKEKGILTLVRAFLRAAGLMNSGVAGSKLLPANWTLHIVGDGPERQAIENLIKSAGPEAERRIKLLGYKTGEDLQREVGNARFSVLCSEWRENMPYSGLESLAAQTPIIGANIGGIPELVVEGKTGFRFESGQLDDLANHLLQASALNGDEYAVMQQECGDYINRRAQQSLYIRSLGELYMRCLQIPTQQRDVEEEK

SEQ ID NO: 92 - protein, 354 aa, Bifidobacterium longum
MKNTIDLHNAAVLVTGAAGFIGSNLAKQLLDSIEGIHVIGFDNVNDYYDVRLKEYRLNQLSHYEGFTFIKADLADKDAVNDVFEQYRPTVVVNLAAQAGVRYSITHPDAYIQSNLIGFYNILEACRHHPVDHLVYASSSSVYGSNKKVPYSTDDKVDNPVSLYAATKKSDELLAHAYSKLYDIPSTGLRFFTVYGPAGRPDMAYFGFTNKLRAGETIKIFNYGNCRRDFTYVDDIVEGILRVMQGAPSKQTGEDGLPVPPYAVYNIGNGHPENLLEFVTILQEELLRAKVLPADYDFESHKELVPMQPGDVPVTYADTAALERDFGYRPSTPLREGLRRFAEWYKTFYLDDSDK

SEQ ID NO: 93 - protein, 416 aa, Bifidobacterium longum
MKDFDSLKIAVAGTGYVGLSLATLLAQHHQVTAVDIVPAKVDMINARKSPIQDDYIEKYFAEKELDLTATLDGESAYRDADFVIIATPTNYDSTKNFFDTSAVEAVINLVMKVNPGAIMVIKSTIPVGYTKSIREKTGSRNIIFSPEFLRESKALYDNLYPSRIVVGTDPEDRHLVEAAETFAKLLQQGAIEENIHTLLMGFTEAEAVKLFANTYLALRVSYFNELDTYAESKGLNTREIIDGVCLDPRIGTHYNNPSFGYGGYCLPKDTKQLLANYQDVPENLIQAIVDSNTTRKDFIADRVLELAGAYGPNSEWDASKEHETVVGVYRLTMKSNSDNFRQSSIQGVMKRIKAKGATVIIYEPTLENGSTFFGSEVVNDLDEFKKRSHSIVANRYDSCLDDVKDKVYTRDLFRRD

SEQ ID NO: 94 - protein, 354 aa, Bifidobacterium longum
MGESICFIMPTMDGGGAERVVSILSGEFARSGCDVTLFLTNSTHTAYALDKRVHVDTSCAESNPNSLDQIKAIRAKMRAMPNTVFISFMDSQNLFTLIAGIGMRNRIIISQRNDPHRAFGKRRLVRAIHPWLYALADCVVFQTQDALEYYPKYAAGKYRVILNPLNNSMLPRYEGERSKRVVTVCRLNEQKNLPLAIDAFAEFRTRFCDYTFEIYGEGALENDLKRYAVSRGVGDSVHFCGFRKDVHACIFDAAMFVISSDFEGLSNSMIEAIALGIPTIATDCPIGGARMVIDNGVNGYLVPVRNKERMVTAMCSIAGDTGVQERFSKAGVRLRERLSVDSISKQWLSAIKEK

SEQ ID NO: 95 - protein, 276 aa, Bifidobacterium longum
MKILVTGANGYLGRGVVDELLKRGNEVIATDFACDHVNSAAHCVPGDIFSIEDPYTYFGEPDVVLHLAWRDGFVHNSNAHFEDLPKHVAFLKKLCESGIQQVACMGSMHEIGFHEGSINAHTPCWPMSMYGIAKDALRNALQTIALQNKVKFQWLRGYYIVSDTQYGSSIFSKIVAAEIEGKKEFPFTTGQNQYDFLDYPDFCHQVAAAVNQDEVLGIINICSGKPEKLADRVERFIAENGFSIKLKYGAFPDRPYDSKAAWGDALKITRILDTEH

SEQ ID NO: 96 - protein, 169 aa, Bifidobacterium longum
MGTLLEQDKYRYAVEKMPRFQRLFRCCQECRFKPMQLVYRLLFRWCRQRNFIELSHQTVIGGGLYIGHPYCITINPQAVIGRNVNIHRGVVIGQENRGKRKGALTLGDDIWIGINASIVGGVKVGNDVMIAPGAFVNRDVPSHSVVIGNPCIIKHKDHATEGYINHKSQ

SEQ ID NO: 97 - protein, 338 aa, Bifidobacterium longum
MGAHNSIRRYLHRIGEEIRSTAEIAKLTSWPAAVETLIAKADIQIMCRNGYAEPPNARRRLIRKHETLLKYFEKRYGDFASGYRYKVNLPAVPEELKGCIWLCWWQGLDHAPRIVQRCVESIREYAGDRRVIVITEDNYRDYVTFPDWMMRKYHEGTIARTHLSDLLRLSLLAQYGGLWLDATFYCAGDIEDCFGQPLFSIKRPEYLHASVAQGYFANYSFGCDADHRWIFAVIRDFLLEYWRTNDFMVDYLFLDYLIVLVQRHCTAVKEAFAAITPNNPQCDDLFKCLGDVFNERHWESLIADTSLFKLTWKQEFPTEINGVETYYGRLLNGNLRRN

SEQ ID NO: 98 - protein, 447 aa, Bifidobacterium longum
MIRITKTKTLQYAWLYLMLLIPGSCAMSRYLNTTLVYGVIIAIYALLALLSAKYRNVYVLSFCLLLALATIVIRLKTGGVGPLSFLSNAAMLVVTYIAMTIDRRMFLTRFVRIVCFFGIISVLFWAAFCINPSLVNAWPATSFWTQNLGTGQWATVLHGKGLWLYSYLEIHATRNCGFYTEPGVYQIVLNAVLFVLLFWKKKLYFDNEKQYRTATVIVLLTLITCQSTTGYLSMMVILLCFFFMRGRERGIRTLKQKLAVLVVAITAVLITDYLLRGEESLLYVQVLNKLFGGGIGGGVNLEDSTGQYRWITVMASLKALSMDPFGIGFDAFYAIRDSFDPAAVAASIATYAAVYGMIFWLTMMIMIFYPMIRREPKKILIAVFAFMFINSTVSETYLFYPGLMMFPIYLSSYFTHKQSSVVGHAIATCNPRHSLMVSNLMNAKEVM

SEQ ID NO: 99 - protein, 310 aa, Bifidobacterium longum
MERTLLLVPSGSFYYFNSMKLPNVVVFPVFREVHGASEMVWKAMRKLRLAASSLFYTDWYKDLQSFSKIIVFDFTVWLDPALLRNINRHKNPDAKCYLYSWNIVRDKQVVLGHLTACRKYGFSYYSYDENDCKQYGFRFNTIMYDENLRLPERALTSDILFLGFLKDRKAKMLALHQIISDAGMKPEFVIVENGNQHEDLPFTIRHSYVNYADYLDMVSQSKAILDITQQGQNGFSMRVMESIFLNKKLVSTNMALLSANFYDPNNILVIDLQNPDEEELTVFLRSEFHPYSQETRHYYSVGSWINRFQQ

SEQ ID NO: 100 - protein, 464 aa, Bifidobacterium longum
MKSAVAYTFASLFSKGLAFVTVPIFTRIMSTSEMGTVNLYNSWQSILTVVATLSLTYGGYMVALKEYEHERDRYESSVLTLTTFTSIVFFAVYSVAPNFWSRILGLDKSLLLLMLVGFLLLPATEFWLARQRYEYKYKAATLVTIGSAIVASALSIVAVLYMRGSGKAAEGRLFANYAVLYAVALVLWVYIMVRGRKFISMRYWKFSLALSVPLIANQFATQILNNSGRVMIGWFVDNSAVGIYGTLSSVSTVSAIVWSAINSSFIPFLYRNIDDSEGKKRVRSLASILLLTYAAVCVLMTFLAPEVVKIIATDEYMAAIYIMPPISAAIFQNAISNMYANVLLYHKKSSYIMIASICGAVLNIVLNAVLIPLFGYQAAAYSMLIAFVFLSYVQMRVSKKLHFTITGTKETVYDDKVIIGIQWLVIVLSAIAIPLYHFTIIRYIAAFVLMVASLFLYKKSKISV

SEQ ID NO: 101 - protein, 164 aa, Bifidobacterium longum
MNHFRNAEKNAAHYRKLGLKLGGGFEILNGWDFGSEPWLIEIGDNVRITSGVRFVTHDGGVWVLRHKYPELSDIDLFGKIRIGNNVHIGFNAIIMPGVTIGDNCIIGCGTIVTHDIPANSIVVGVPGRVIESVGEYAAKHDDDFMHTKKMATDEKKAFVLGHLR

SEQ ID NO: 102 - protein, 383 aa, Bifidobacterium longum
MTAKILVTGGAGFIGSEIVKQLSAHDEYEIRVLDALTKQIHGNNPEKSYLFQSIKDCCDFIRGDVRDFTTVQKALEGVDVVLHLAAETGTGQSMYMINQYNEVNVMGLSNIFQALSLKGESNTIRKVILSSSRSVYGEGEYQCPNCGVVYPRGRKTKDMMQGDFTMHCDKCNTALTLMPTTEDSKTTPNSLYAFTKLSQEMMIQTMCPAMDIDYTIFRFQNVYGAGQSLKNPYTGILSIFSSLLLDNKDINIFEDGKESRDFIHVKDVASAVIKSINTAASNGEIINLGSGIGTSVIEIAETLKRIYGSTSNLNVTGDFRIGDIAHNVADTQKARKLLDFTPSISLQEGLTEFCEWVLGQETDNSRYEQSLTEMERSGMFIRK

SEQ ID NO: 103 - protein, 193 aa, Bifidobacterium longum
MAGSCSKAAYRPRPARPDDDPAPDILAREFNGYAPRTHLASDPAYVRVGSSWAYVCLPGDLANRQIAGHSVGVGHDADLVLAAFAALRFPLDEIEVFHTDRGGGFAGERVERVLDVFGVTRSLSRPGNPYDSAVVESTNRLVRKELIHRNVYTNVEQPRSDVNRYVWWYNHQRLHSTLGYLSPVEFTQQGKTL

SEQ ID NO: 104 - protein, 52 aa, Bifidobacterium longum
VQGIRNSGSTKAADNRTPEENELIELRKRDRQLEMEVDVSEQAAPVFARKQA

SEQ ID NO: 105 - protein, 340 aa, Bifidobacterium longum
MADEVFSPKNVIVTGGCGFIGSNFVHYVYDHHPDVHVTVLDALTYAGNLENIRGILGDRVEFVHGNICDAELLDKLVPGHDAIVHYAAESHNDNSIANPEPFLKTNVEGTFRLLEAARKYDVRYHHVSTDEVYGDLALDDPAKFTEETPYHPSSPYSSTKASSDLLVRAWHRTFGIRATISNCSNNYGPYQHVEKFIPRQITNILEGLKPKLYGNGENVRDWIHTDDHSTGVWAILTKGRIGETYLIGADGERNNITVLRDILTVMGKSPDDFDWVKDRPGHDRRYAIDSTKLRTELGWEPTHTDFQKGLERTIEWYTENRAWWEPAKAATEAKYKQQGQ

SEQ ID NO: 106 - protein, 319 aa, Bifidobacterium longum
MGLGLPDFGPVQNNISFNATKGVTRGIHAEPWDKYISIATGEIFGAWVDLRPGESFGQVYTTRLDPSKAIYVPRGVGNSFQALQDGTVYTYLVNAHWSLEQKKTYTFVNLADPELGIEWPIPLEESERSEADLHHPMLKDAKPMEPKRTLVTGCNGQLGRAVRAYAEAHGLRGFEYTDINEFDFSDPAAYDEYDWSLYGTIINAEELSADKCEIGENHARAWTINAQGPALLSRAAKDHHVTLVHASTDKVYGADSEAKAIAPESVYGQTKAAGDIAVANAPEHYILRRSESADSRNIVDTLFQLLDSHAEYGVYAVGD

SEQ ID NO: 107 - protein, 299 aa, Bifidobacterium longum
MKGIILAGGSGTRLYPLTTVTSKQLLPVYDKPMIYYPLSVLMLAGIRDILIISTPKDLPNFEKLLGDGSHYGVHFSYKVQPSPDGLAQAFLLGEEFIDGEPCALVLGDNIFYGNGLGATLRKAVAKAEGGEGASVFGYYVDDPERYGVVEFDEHKKAVSIEEKPKEPKSHYAVTGLYFYDERVVEFAKRVRPSARGELEITDLNKMYLEDGSLNVRTLGRGYAWLDTGTMDSLYEAGEFVRTVQRAQGLPIAIVEEIAYENGWISKEELLESAERYGKSPYGKHLKDVAEGKVVIVPND

SEQ ID NO: 108 - protein, 72 aa, Bifidobacterium longum
VMGGRKVGRFGVRIGVRMFSIEDRRRAVDLYFTEGMTIRKVVAKLGYPSEGALAKWVREDPRCTVPLAFHKF

SEQ ID NO: 109 - protein, 47 aa, Bifidobacterium longum
MLRRLVPVPIKLVLILVGNDVHIASMEFLECFSHSRLLIINNRALAG

SEQ ID NO: 110 - protein, 144 aa, Bifidobacterium longum
MASLLQGFEEVQLVKPVGKTVLTVTDSAIRFNKATAEVLGFPAYVKVLINDKTRQIAVTPTTAKADNAIKFSKTEGKQAASVSVKEATLIEAVKAYFTLPEAPEGEIAYQSVNGTAYPESKTVIFDVANATAGTMKRRGRKKAA

SEQ ID NO: 111 - protein, 186 aa, Bifidobacterium longum
MQIMYVCTGNQCRSVMAEYYTRAKLADRGIGLQSGNITVRSAGTLHYPPHPADPMVIDLLKNDGIDANSHSSTPLTTDISRQADLILCFEREQISDLLEQNPLAIRKVFLFNDFVNACKHMHAEGPIAGDTAADRLIEIMDCVPMLRPFLPTALETEDPHRQSREVFERVYAEIKHGVDIMLGAVA

The invention claimed is:

1. A formulation comprising an ingestable carrier comprising a stabilizing excipient having a water content of less than about 10% and an isolated strain of *Bifidobacterium longum* AH1172 having NCIMB accession number 41714.

2. The formulation of claim 1 wherein the ingestable carrier is a pharmaceutically acceptable carrier.

3. The formulation of claim 1 wherein the carrier does not occur in nature.

4. The formulation of claim 1 wherein the formulation is in a form selected from the group consisting of a capsule, a tablet, a pellet, a powder, or combinations thereof.

5. The formulation of claim 1 wherein the strain is present in the formulation at more than $10^6$ cfu per gram of the ingestable carrier.

* * * * *